United States Patent 7,745,391 (HUMAN THROMBOSPONDIN POLYPEPTIDE) - sequence listing, part 228

SEQ ID NO: 600696 - DNA, 744 bp, Homo sapiens
  misc_feature (35)..(35): n is a, c, g, or t
  misc_feature (44)..(44): n is a, c, g, or t
  misc_feature (70)..(70): n is a, c, g, or t
  misc_feature (170)..(170): n is a, c, g, or t
  misc_feature (182)..(182): n is a, c, g, or t
  misc_feature (196)..(196): n is a, c, g, or t
  misc_feature (201)..(201): n is a, c, g, or t
  misc_feature (210)..(210): n is a, c, g, or t
  misc_feature (213)..(214): n is a, c, g, or t
  misc_feature (217)..(218): n is a, c, g, or t
  misc_feature (221)..(221): n is a, c, g, or t
  misc_feature (232)..(232): n is a, c, g, or t
  misc_feature (249)..(249): n is a, c, g, or t
  misc_feature (260)..(260): n is a, c, g, or t
  misc_feature (271)..(271): n is a, c, g, or t
  misc_feature (300)..(301): n is a, c, g, or t
  misc_feature (303)..(303): n is a, c, g, or t
  misc_feature (309)..(309): n is a, c, g, or t
  misc_feature (314)..(314): n is a, c, g, or t
  misc_feature (319)..(319): n is a, c, g, or t
  misc_feature (351)..(351): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (383)..(383): n is a, c, g, or t
  misc_feature (447)..(447): n is a, c, g, or t
  misc_feature (452)..(453): n is a, c, g, or t
  misc_feature (469)..(469): n is a, c, g, or t
  misc_feature (471)..(471): n is a, c, g, or t
  misc_feature (482)..(484): n is a, c, g, or t
  misc_feature (487)..(487): n is a, c, g, or t
  misc_feature (500)..(500): n is a, c, g, or t
  misc_feature (503)..(503): n is a, c, g, or t
  misc_feature (505)..(505): n is a, c, g, or t
  misc_feature (511)..(511): n is a, c, g, or t
  misc_feature (515)..(515): n is a, c, g, or t
  misc_feature (524)..(524): n is a, c, g, or t
  misc_feature (526)..(526): n is a, c, g, or t
  misc_feature (531)..(531): n is a, c, g, or t
  misc_feature (533)..(533): n is a, c, g, or t
  misc_feature (539)..(539): n is a, c, g, or t
  misc_feature (546)..(546): n is a, c, g, or t
  misc_feature (552)..(552): n is a, c, g, or t
  misc_feature (559)..(559): n is a, c, g, or t
  misc_feature (561)..(561): n is a, c, g, or t
  misc_feature (568)..(568): n is a, c, g, or t
  misc_feature (582)..(582): n is a, c, g, or t
  misc_feature (589)..(589): n is a, c, g, or t
  misc_feature (598)..(598): n is a, c, g, or t
  misc_feature (619)..(619): n is a, c, g, or t
  misc_feature (624)..(624): n is a, c, g, or t
  misc_feature (626)..(627): n is a, c, g, or t
  misc_feature (629)..(629): n is a, c, g, or t
  misc_feature (632)..(632): n is a, c, g, or t
  misc_feature (635)..(635): n is a, c, g, or t
  misc_feature (644)..(644): n is a, c, g, or t
  misc_feature (652)..(652): n is a, c, g, or t
  misc_feature (661)..(661): n is a, c, g, or t
  misc_feature (664)..(664): n is a, c, g, or t
  misc_feature (675)..(675): n is a, c, g, or t
  misc_feature (681)..(681): n is a, c, g, or t
  misc_feature (686)..(687): n is a, c, g, or t
  misc_feature (693)..(693): n is a, c, g, or t
  misc_feature (702)..(702): n is a, c, g, or t
cccaggcccaggctcaagctcaagcccaggctcangctcaggcncaagcccaggcccaggcccaggcctnccaggcatcacagcagcagcagcagcagcagcagcagcagcagcagcagcagcaacagccaccaccacacttccagtctcctggggcagccccccagggngggggtggtggngacagcaagcccanccctncaccccagngtnnctnnganctgaccccgtntaagacggcggagcatnataaggacatntgcctcactgncaccaccagcaccatccaggtggagcacnngnccagcncttanagatncgtgctgccacccactgggaagaggaagaagnggcncnggngtcntctntctgcaactctcggngggaaaagtcctttgcttagttgacaggccttggctccatactattgggcctctggaaaggatntcctnnacaggataccatcctntntcgaactctcnnnaanaggaacatcagcnctncngatggnggantactgagcngntgggngnatccancagcctnccctcncaagcanancttctanaactgggggtcggngctcaanggaaggatntgctatgacctcatagaaccntgtgnanngnggncantaccctatncttacccnccttatacngtntgggctgatgngactanaggcnngccctnccagatcangcacggagccccatgtggcaccaggcttttgtgctttactgc

SEQ ID NO: 600697 - DNA, 689 bp, Homo sapiens
  misc_feature (35)..(35): n is a, c, g, or t
  misc_feature (44)..(44): n is a, c, g, or t
  misc_feature (70)..(70): n is a, c, g, or t
  misc_feature (170)..(170): n is a, c, g, or t
  misc_feature (182)..(182): n is a, c, g, or t
  misc_feature (196)..(196): n is a, c, g, or t
  misc_feature (201)..(201): n is a, c, g, or t
  misc_feature (210)..(210): n is a, c, g, or t
  misc_feature (213)..(214): n is a, c, g, or t
  misc_feature (217)..(218): n is a, c, g, or t
  misc_feature (221)..(221): n is a, c, g, or t
  misc_feature (232)..(232): n is a, c, g, or t
  misc_feature (249)..(249): n is a, c, g, or t
  misc_feature (260)..(260): n is a, c, g, or t
  misc_feature (271)..(271): n is a, c, g, or t
  misc_feature (300)..(301): n is a, c, g, or t
  misc_feature (303)..(303): n is a, c, g, or t
  misc_feature (309)..(309): n is a, c, g, or t
  misc_feature (314)..(314): n is a, c, g, or t
  misc_feature (319)..(319): n is a, c, g, or t
  misc_feature (351)..(351): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (383)..(383): n is a, c, g, or t
  misc_feature (392)..(392): n is a, c, g, or t
  misc_feature (397)..(398): n is a, c, g, or t
  misc_feature (414)..(414): n is a, c, g, or t
  misc_feature (416)..(416): n is a, c, g, or t
  misc_feature (427)..(429): n is a, c, g, or t
  misc_feature (432)..(432): n is a, c, g, or t
  misc_feature (445)..(445): n is a, c, g, or t
  misc_feature (448)..(448): n is a, c, g, or t
  misc_feature (450)..(450): n is a, c, g, or t
  misc_feature (456)..(456): n is a, c, g, or t
  misc_feature (460)..(460): n is a, c, g, or t
  misc_feature (469)..(469): n is a, c, g, or t
  misc_feature (471)..(471): n is a, c, g, or t
  misc_feature (476)..(476): n is a, c, g, or t
  misc_feature (478)..(478): n is a, c, g, or t
  misc_feature (484)..(484): n is a, c, g, or t
  misc_feature (491)..(491): n is a, c, g, or t
  misc_feature (497)..(497): n is a, c, g, or t
  misc_feature (504)..(504): n is a, c, g, or t
  misc_feature (506)..(506): n is a, c, g, or t
  misc_feature (513)..(513): n is a, c, g, or t
  misc_feature (527)..(527): n is a, c, g, or t
  misc_feature (534)..(534): n is a, c, g, or t
  misc_feature (543)..(543): n is a, c, g, or t
  misc_feature (564)..(564): n is a, c, g, or t
  misc_feature (569)..(569): n is a, c, g, or t
  misc_feature (571)..(572): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (589)..(589): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (620)..(620): n is a, c, g, or t
  misc_feature (626)..(626): n is a, c, g, or t
  misc_feature (631)..(632): n is a, c, g, or t
  misc_feature (638)..(638): n is a, c, g, or t
  misc_feature (647)..(647): n is a, c, g, or t
cccaggcccaggctcaagctcaagcccaggctcangctcaggcncaagcccaggcccaggcccaggcctnccaggcatcacagcagcagcagcagcagcagcagcagcagcagcagcagcagcaacagccaccaccacacttccagtctcctggggcagccccccagggngggggtggtggngacagcaagcccanccctncaccccagngtnnctnnganctgaccccgtntaagacggcggagcatnataaggacatntgcctcactgncaccaccagcaccatccaggtggagcacnngnccagcncttanagatncgtgctgccacccactgggaagaggaagaagnggcncnggngtcntctntctgcaactctcggngggaggatntcctnnacaggataccatcctntntcgaactctcnnnaanaggaacatcagcnctncngatggnggantactgagcngntgggngnatccancagcctnccctcncaagcanancttctanaactgggggtcggngctcaanggaaggatntgctatgacctcatagaaccntgtgnanngnggncantaccctatncttacccnccttatacngtntgggctgatgngactanaggcnngccctnccagatcangcacggagccccatgtggcaccaggcttttgtgctttactgc

SEQ ID NO: 600698 - DNA, 117 bp, Homo sapiens
  misc_feature (49)..(49): n is a, c, g, or t
  misc_feature (51)..(51): n is a, c, g, or t
gatctatataatttaatgtatcaccttcattgtaaatttagcaggaaangnatcacaattatgatttttttttttgcaccagtgaaacaataaagatgctattaccaatttgggggc

SEQ ID NO: 600699 - DNA, 1080 bp, Homo sapiens
  misc_feature (490)..(490): n is a, c, g, or t
tagggttgggggggaaaggggggccaattccaaaaaaacgggggggtaaaaaaggggttgtgggggacaaaatttttggggtaaattccgggggaaaggcggctccattgtggtgggtcccaagagaaaaaagtgaggaggcgggggcaggggggttaatcaataaccaatcagtgaggtggtattcgcggaactattgaaacaaattggggggcaagagggagcactgaagaagcgaaattccacagtgacttgcagacacctggagaatctatatctcgagaacaccacccatcagcgaaaaggcacaacaggggaggttacggtagggaccactacacaacggtggcaaacaacaaaccatatatacaggcgcgcacagcggcggaactcaggagtggagcagagcagaacaaacagagaagcggcggccactacgaatggtgcggagaacaagaggtgagggacgaacagatcaacagagaaagcnccaccatactaccagacaacgagctcgacacaagcatcaaaccagtgacagagtcatcagaggagacgacccacaataatcaaacaccgtacgacgacccaccaaccacaaccaccacaccgagagccagacacatcaaggacaagcaccaaccgacgagacgcccaccagaccagcctcaccccacgctactaacacagcagacaatggtaaccaacaacagagccaccagccatacacgagggtgcaacacaaacaacagcgagaggaccccaaacgagcagaacgcacactcaccaacaagacgccaacctaaacaaagccccaacgagagataatacaaacgcacagcacgacaccctaattagaaccaaccaccaacatacaacccatccgtaaccagagacaccacatgcaccaacacatcacaccacgtcactaaaaccagccaacacaaccccagcaactcctctactgacacacaacacgcgcacaccaccaacaccgctagcaatccacccaacaactgcatctgacttcacaccactccatgcagcacacacacaaacaccacctgtcccacaacacac

SEQ ID NO: 600700 - DNA, 424 bp, Homo sapiens
gattaacgtatgagtatcacgactgggcattaactttcattttaaattcaggagtacatgtgcaggatgtgcaggttgttacacaggtaaatgtgtgtcgtgggggtttgttgtacagattatttcatcacccaggtattaagcctagtatctattagttgtttttcctgatcctctccctcctcccaccttctaccttctgataggctccagtgtttgttgttcccctctatgtgtccaagtgttctcagcatttagctcccacttataagtgagaacatgctgtatttggtttcctgtttctgcattagtttgctaaggataatagcctctggctccattcatgtccctgcaaaggacatgattttgttcctttttattggatgcatactattccatgttttgtatttttttcagacttctg

SEQ ID NO: 600701 - DNA, 275 bp, Homo sapiens
gaagcccaaagggggtcaaggagggagggtccaagttggctgaatgtacctctccagctctggttcctgcttgagtccctcaccgtttcttccccagaccctcagatttatatttcctatttctctgtgtatttatatacaacatttattaaatataaatatccccagggacagaaaccaagtgcccgagctcagggcagctgtgctgggtgagctcttccaggagcaccttgccaccattcttcccgttctaactttgaaccggcgttgcgcgt

SEQ ID NO: 600702 - DNA, 152 bp, Homo sapiens
gcgcattacgtcccagaagttccacaatcctcgttacgactcctgatagttctttatttttcaaaatgtatttgccatgggatgctaattagcaataggtgtcataatgagaataacccaaactggtctaacatgtgacaacatgattgaca

SEQ ID NO: 600703 - DNA, 330 bp, Homo sapiens
ctacggacaatctcttgctctcccgcttctagaacatgcacacggactcagggggacacgtgagctagcgtggacgatactttcacacttacacatgaaatactggaacgccttggacttcacacggctcttaatacctttgcagatgaggagcgcgtcctgggaagctcatcaaaccagtgctctctgtttttcttggccttccccttccacgcacgcaccttcgtacgactctcgtacaccgtcctttacggatgacgacgggggtgtgtcgtcctgcttacgggccttaccggtacgctacgcgctccctggcactcatccggggct

SEQ ID NO: 600704 - DNA, 123 bp, Homo sapiens
  misc_feature (59)..(59): n is a, c, g, or t
  misc_feature (101)..(101): n is a, c, g, or t
  misc_feature (108)..(108): n is a, c, g, or t
ctgggcaggatgtgagtacactcagaaacagaagtagttctcatcaagaacgtatgtcntgcctccacgaaatgtgaggtggccctgcactagaggatcanggtcccnagccctacaaaacag

SEQ ID NO: 600705 - DNA, 372 bp, Homo sapiens
taatcaccccagatgtctctagcagtttctagttgtgtcagcttaacaagtcttcccttcttctgtgaaaaacttccctctattccaactgtaatgttctagtgagggtatctttccttcctggccactgtgaccacagaggtatagacactggattaaagttaagctaatcagatttctccctaccatggggaacttaagaaacagaaagaagacatcccaaatgttttctaattgtgaagcagggacatgtgagcttggaagttagtgatggccatgtttttcgctaagtgagaaagacactctgaaagattaaaggagaagaacagagaaaactggaaagaaaagtagtaacagcagtggtattggtgg

SEQ ID NO: 600706 - DNA, 128 bp, Homo sapiens
ttcgactctgactccccagcacgcaattacatggcagccaatgtacattcttctttatatggaaacaaggtcttgctcgtgctgcccaggctgccagtgcagtggctatgactctcgtgctcactgcc

SEQ ID NO: 600707 - DNA, 1076 bp, Homo sapiens
ttcagccctcagctgcccggggagcatggaccatctgcgggcgcatcgggagccgactgcctgtggagccctgaggatgggtatcgccgcttcctgtgaaacccccccaccctaacgaactgaactccgccctgttgagcatgtcgcgcaccttgagcccttccaccatcagccctgtccccctaccaggcttgcctgtcttcccaagggctgcggcaaatctacagggaccctgagaccctcgtgttccgaggactcctcttcgtggcagttggggcaggacttcactgacgcaccctcgggtgctgaccgtgggatgacccagcacccgtgagatgagacatgctggacgactccagggcccgccgaggaacttgatggtctgtagcaatctttacgtatttggaggagcacatacggcattctgctgcccagaaaagggcaacagagtactgataacaccagataccatggaaacactccaagcctccaaaattgcctaccccaccataacgtcatttaaatcatcgggcatgtgccacaaggtatcatcatctcctaacctacgttggaacgagagcagcacttcccccatgggatgccccgaacacccggaaaagtggatacccaatggcccctaaccatccagccaggaatccctcgcatgagcgccagccatgagtggacatacagaccacacagaagacgaagagagcgagcccacctggccccccctgagggggaccccggtagcgacagcgtggggagagcagaccagcccccaaggaaaaggagaccacaggcgcatgagcccaccactggcagggcgccagccggtacattcgcacaggacggagacaaacgaccaggagtcaacagcaggaacgaacaaatcgggcacgctccgtacgcgcatagcacgaacgggaaggagcgaggcagataagccacacgagaaggaggggcagaacagaccggtaggaaagcgcaccaccaggcacaaggcgcggccagtcagcactgacacagcgaacgacggcacagacgatcggagcgacgcggcagccacccgcacc

SEQ ID NO: 600708 - DNA, 265 bp, Homo sapiens
aaatgattccccccttttttaaaaccttttttttgacccccccttgcccccccctgtttttgtttttcccgggtttcaaccagttgggggcaaaattgggggattcgctaattggactgattgtttaagggggccttagttggttttcccccggtaatttgtaggtttttggggggcggggcccccctttccaaaaaataaaaaaaggccctccccttttttgcccagggtcccgggcccctggggggcggtaggggggccccca

SEQ ID NO: 600709 - DNA, 148 bp, Homo sapiens
cgcaaggattctgctgggcaccagaaatgcaccgcgcgacaccttactgtgacactatgaaatgctacacgcgtgagtgccgagtcattaccaagagcgctcaggggcaggcagccagttgttagttacttgcccgcggggcacctgc

SEQ ID NO: 600710 - DNA, 116 bp, Homo sapiens
gtcgactgctcactcacctgggattgggaggctgttgacagacaggctgacagcagcattcagtgagtcatagtgagggcacatagcttctggatgtatgaggggcttctgggtgt

SEQ ID NO: 600711 - DNA, 171 bp, Homo sapiens
tgctgggattacaggtgtgagtatctcagctgagcaaggggtgactttgaatagaatgagaggcaggtttgccctgagcagttcccagcttgacttttccctttagcttagtgatttgggggccccaagattgattttcctttcacaggtggttgttgagtggggagcaga

SEQ ID NO: 600712 - DNA, 216 bp, Homo sapiens
  misc_feature (43)..(43): n is a, c, g, or t
ttggggggcccccccccccccgggggtttggcaattaaagggntcttttttggggggggtttttttttttagggggttttccttttcacccccggggggggggcccccttttttttcaaaaaaaccccccccggggggggggggggttttttttttcccctttttttccccccccgggggggttttccccctttttagggggggggggttggcgga

SEQ ID NO: 600713 - DNA, 98 bp, Homo sapiens
  misc_feature (34)..(34): n is a, c, g, or t
taagagtggcaaaatttttaaatttagaaatttnttttttttaaactaaagctatataaagcttgtggattaaacagaataaatttctaaatttaaaa

SEQ ID NO: 600714 - DNA, 751 bp, Homo sapiens
ggatctggagcatgtagaggttttacagaagaaatttgaagagtttcaaacgagatatggctgctcatgaagaaagagttaatgaagtgaaccagtttgctgccgaatactcatactaggagctactaccctgaggaggaactgatcaagactaagcaggatgaagtcaatgcagcctggtgagcggctgaagggcctggctctgcagtaggcaggggaatgctctttggggcagcgagaagttcgagcgctttaacagggatgtggatgagactatcagttggattaaggaaaaggagcggttaatggcctctgatgattatggccgtagacctggcaagtgttcaggctctgcttcggaagcacgagggtctggagagagatcttgctgctctagaagacaaggtcaagagccctgtgtgctgaggctgaccgctgcaaagtccgcaccttctgagtgcaacacagattcaggtggaagcgagaggaagtgattacaaagtggggagcagatccagacctgtggtggaagagagacatgcacggctcaatggatccatacaggtttgcaacgcttccttggtgatttcgtgaactcacaggtgggtgactgagatgaaagcctcatcaatgagatgagcttgcagtgatgtagtggggtgaagccctgtagatagagacaagagcaaaaggtgaaattgatgccatgaagaagttgaaattggggatgaattggacaggattgttggtt

SEQ ID NO: 600715 - DNA, 831 bp, Homo sapiens
tggttggttggttttccatgaggttatcggaccaggggctgacctcaggcactttctgtaggaaactgtaatttctgtaaaaatggttatttaaccctcctccaccccatcagcggtggccctgagggctgacccggaggccagtggagctgccggggtgtccacgggggagggccaaggcctgctgagctgattctccagttgctgccccagcctttccgcctgcacagcacagagggtggtcaccccgaggaacagccaggcacctgctcctctggcccttccggggggaggggagctgccttctgtcccgtgtaactgcttccttatggcccagccgggccactcagactggttggaagctgcacgggcagcttttgggtctcctgtggggtattcacaacagccggggactggatttggatgtatttaaaaccacttttaaaataaaagagtcggtggccttaaaaaaaaagaactaaaaataagaaactaaagaagaatgaaacaacataacaccaacatgacaaaaaatctaagctataaaaaacaaacgacggggggggggggagcaaaataataccacgcgggggcagcaccccagactacgcccgaccccacctttctgcgaacaaagaggggcccccaaatgagagggcacttaaacaccgacacgaccgcccgccatacaaccgacgcgacgaagaacacaccaccgcggcactggggaacaaccccaccgggcgggacaacgggcacccccacagaaaaccgcggaaaaaaacggagcgccgggcacaccgcatctggcaaatcgccggcatcacaatc

SEQ ID NO: 600716 - DNA, 310 bp, Homo sapiens
caagatcagactcggaatacagcaagctataagcaagccaattacacagagaaggtatccataaattatttcaggccaaagggtctaactgtcagataaattttgtttggtttcgtttgagagcagggactcatggtcgcccaggctggagtgcagtaggcagatcttcgctcactgtaacctccggctcccagattcaagcaaatctcccgcctctactaaaaatagcaaaattagctgcgcgtggtggcacatgcctgtgatcccagctccttgggaggctgaggcacgagaattgcttgttccgctg

SEQ ID NO: 600717 - DNA, 256 bp, Homo sapiens
actgattctgcgaaaataccccctttttattagtggcatgctcattcactttatctttatattcaaataagttatttcgctttcactgttttaacaaaaaaaaaaaaaaaaaaaaaatacagccctccccaatcgaagatttcaactttttaattcacacggaaaaaccaagacaatttcacaacttctggacacaaccatcaacacaggacattttttttacaggcaaatcacttaaaacaaaaaagatcccaga

SEQ ID NO: 600718 - DNA, 80 bp, Homo sapiens
atggggcatggaggagaaggcggggccagcgccagctgccgggagccgccggccccccgagggccgcgccgtcgcgtact

SEQ ID NO: 600719 - DNA, 239 bp, Homo sapiens
gcttagctgcaactggcaaaggagaagggtagatttaggtgtgacaacagtttgcttcagagaggtaagggtctgtttctctatctccatgtgacatctttcaacagctttcgcctgacaacgactgtttcctatgtagaagccaccttgtgtttttaagcagaggcaaacctctctcttctcctctgtttcgtgaaggcaggggacacagattggagagattgagccacgatcagcct

SEQ ID NO: 600720 - DNA, 944 bp, Homo sapiens
ctataaacatgtaggagaattatagccagtcttcagttataaccactccaccctcctcactttctctctctctctctcttttctttctcctgctactgggatttaatgggaacacatatgtaaaaccctgtcactagatcagcgtggctcttcttccctatgaactctatacagtacctttctccatccgtcgtctctcacataatgaccacagagcctgcagtataccaacgaaaaccaatattcgcattacaggttgctcctgtcacttccagacagctttcctgcctgtgtgactcaacctaattctggcacagttccataacatccacgattcgctcagcaccaatgcccatccacatatgtaccatgtaccactccatggcgaagagctacatgcatcgacccacgacttcctaggagcttgggaccatactgcattaccttaatccacatgtcctagatggacctattcgcgtggaaggaactctcacactcctgtcatcacatgatcgggcattcctatcggcggattcagcaccccatgctccatgccctttatggccaccaattccttaaacaaaaattctacagacgacatatgtgttcgcataaagacttcccctaattttacaacttaccaccaacatcgggaccccgctctcacaacaccctatgacccggtcgcatgctttctcaatcccgcgcggcgaggcatctatggactaattccccgtccgccagactatagcacaattcacacgggagttaaacaaacgttcgcgttcacgctcctattcaacggatggtccccaaggacgtcaacgtcaagcttctcacgctacgacctctgcatccctcacaagtcactacgtactgctagcagttcagccatcacagcgtccacgaccaacgtcacccatcgttcgatatcagaacacgca

SEQ ID NO: 600721 - DNA, 310 bp, Homo sapiens
atggatagaaggagttcgacttggatgacctgtagggtatagatgacctggaaaccatgccagatgaccttctgaccacgtagaatgacactatgtgaatctactattgcccccctagtccaggagactaataagcagcccccccagacggtgaacccaattggccatctcccagaaagtttaacaaaaaccgaccaggttgcccccttcaccttcttacaacctcttcccctttccccaggggtcctgtcctccactccatcatacctttaatttagagctgggcagtgaagtggatatcactgaagga

SEQ ID NO: 600722 - DNA, 378 bp, Homo sapiens
gacttgctagtgtggtaaactgcctcacaaaatacatggtaataacttttctttaaaaaaaaaaaaaaaagacagcctttacaccatttctagttggcacactattttggcaatggttatgcaccatttcaattcccccattgtgacccctatcacttcatttgatatccctttttgacccacccatctcctttcattatatgggcattgttccatagatttgacaaagaaagtttacactttttgaattaaagatgcaaagttatgcaaaaactttaattactgttgtgaaaaattaaaaaataaaagagaaacaaggcagaggaagagggtgttaagctctcctcgacctgttggattggtggttaacagattgat

SEQ ID NO: 600723 - DNA, 261 bp, Homo sapiens
ctaagactttgtgcgtaactcgtggtttggtttaatccacctcaaccgcctgctatgatggataagattgagagagtgaggagaatggcttacgatctagtgagggagacgatttggtatatgattgagatgggggctagtttttgtcatactggaaagaaccatagtctaccatgtgataagattgagagagtgaggagaaggcttacgtctagtgagggagagatttggtctatgattgagatgggggctagtatcagt

SEQ ID NO: 600724 - DNA, 410 bp, Homo sapiens
gtttttgagggcttcacttgataatgaccatgggaagaatctggggtgcaaagttccacgtgcattagccgaaattattcattcaactagaaagacaattttgcatccactaatacataaaaatcagaaaggagaattgggaaaaagcatattcttagaataacatttagcatccaccaaagtgaaggacataggtttctggcacagttgaaaccttagttggaaaaccaaaccttggcacagtgccaattatttatcttttgatcaggacatttgaaataggcagagaccaccaaaaaaggacaaagtattgaaaagtagctgctcattttttactgccaatattcctgaactttaaagaatatcacatctaatcaaccgcaatagaattgggcattcagacgtcgacg

SEQ ID NO: 600725 - DNA, 435 bp, Homo sapiens
  misc_feature (39)..(39): n is a, c, g, or t
ctccctctattatccacaacaagccatcgtgtttgccangtcagtggggagagattatatgactggggtttacgaggatatatagtcatagaagatttgtggaaggagaactttcaaaagccaggaaatgtgaagaattcacctggaactaagtagaaaacttcatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtta

SEQ ID NO: 600726 - DNA, 458 bp, Homo sapiens
  misc_feature (75)..(75): n is a, c, g, or t
tgtgtagtatgagtatgtctacccaatgatgagctagaacatgaacacattaaggagctgttacacaacaacatntagagaggacataagtgactgatggaactgaaaaacaagaatcagaacttcaaacgcaaccacaagtatcaataactgagtagacgaagcaaggaaagaacttcagagcttgaagacaatcttgctgaaataaaacaggcagacaagattgaagaaaaaagaataaacgggaatgagagaaatctccgaggtctatgagattatgtaaaaagaccgaacctatgactgactggggtaccttaaatagatagggagaatggaaccaagttagaaaacatccttcaggatatcatccagaagaacttttccaacctaacaagaaaggccaacattcaaattcagaaaatccagaaaaccccagtaagatactccatgagaagatc

SEQ ID NO: 600727 - DNA, 467 bp, Homo sapiens
  misc_feature (39)..(39): n is a, c, g, or t
  misc_feature (446)..(447): n is a, c, g, or t
  misc_feature (449)..(449): n is a, c, g, or t
ctccctctattatccacaacaagccatcgtgtttgccangtcagtggggagagattatatgactggggtttacgaggatatatagtcatagaagatttgtggaaggagaactttcaaaagccaggaaatgtgaagaattcacctggaactaagtagaaaacttcatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaacnnanatggcctcgctggcctca

SEQ ID NO: 600728 - DNA, 868 bp, Homo sapiens
  misc_feature (35)..(35): n is a, c, g, or t
  misc_feature (73)..(73): n is a, c, g, or t
  misc_feature (92)..(92): n is a, c, g, or t
  misc_feature (97)..(97): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (150)..(151): n is a, c, g, or t
  misc_feature (196)..(196): n is a, c, g, or t
  misc_feature (219)..(219): n is a, c, g, or t
  misc_feature (236)..(236): n is a, c, g, or t
  misc_feature (242)..(244): n is a, c, g, or t
  misc_feature (255)..(255): n is a, c, g, or t
  misc_feature (257)..(257): n is a, c, g, or t
  misc_feature (291)..(291): n is a, c, g, or t
  misc_feature (301)..(301): n is a, c, g, or t
  misc_feature (389)..(389): n is a, c, g, or t
  misc_feature (416)..(416): n is a, c, g, or t
  misc_feature (502)..(503): n is a, c, g, or t
  misc_feature (510)..(510): n is a, c, g, or t
  misc_feature (514)..(515): n is a, c, g, or t
  misc_feature (517)..(518): n is a, c, g, or t
  misc_feature (524)..(524): n is a, c, g, or t
  misc_feature (526)..(526): n is a, c, g, or t
  misc_feature (528)..(529): n is a, c, g, or t
  misc_feature (531)..(531): n is a, c, g, or t
  misc_feature (537)..(537): n is a, c, g, or t
  misc_feature (539)..(539): n is a, c, g, or t
  misc_feature (543)..(544): n is a, c, g, or t
  misc_feature (554)..(556): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (578)..(578): n is a, c, g, or t
  misc_feature (580)..(582): n is a, c, g, or t
  misc_feature (585)..(585): n is a, c, g, or t
  misc_feature (589)..(589): n is a, c, g, or t
  misc_feature (592)..(595): n is a, c, g, or t
  misc_feature (597)..(597): n is a, c, g, or t
  misc_feature (603)..(603): n is a, c, g, or t
  misc_feature (605)..(605): n is a, c, g, or t
  misc_feature (611)..(611): n is a, c, g, or t
  misc_feature (621)..(622): n is a, c, g, or t
  misc_feature (625)..(625): n is a, c, g, or t
  misc_feature (628)..(628): n is a, c, g, or t
  misc_feature (630)..(630): n is a, c, g, or t
  misc_feature (639)..(639): n is a, c, g, or t
  misc_feature (641)..(642): n is a, c, g, or t
  misc_feature (646)..(646): n is a, c, g, or t
  misc_feature (649)..(649): n is a, c, g, or t
  misc_feature (661)..(661): n is a, c, g, or t
  misc_feature (665)..(665): n is a, c, g, or t
  misc_feature (670)..(673): n is a, c, g, or t
  misc_feature (675)..(675): n is a, c, g, or t
  misc_feature (677)..(677): n is a, c, g, or t
  misc_feature (679)..(681): n is a, c, g, or t
  misc_feature (683)..(683): n is a, c, g, or t
  misc_feature (685)..(685): n is a, c, g, or t
  misc_feature (687)..(690): n is a, c, g, or t
  misc_feature (694)..(694): n is a, c, g, or t
  misc_feature (696)..(696): n is a, c, g, or t
  misc_feature (700)..(700): n is a, c, g, or t
  misc_feature (703)..(703): n is a, c, g, or t
  misc_feature (707)..(708): n is a, c, g, or t
  misc_feature (711)..(711): n is a, c, g, or t
  misc_feature (716)..(716): n is a, c, g, or t
  misc_feature (724)..(724): n is a, c, g, or t
  misc_feature (729)..(729): n is a, c, g, or t
  misc_feature (734)..(734): n is a, c, g, or t
  misc_feature (736)..(736): n is a, c, g, or t
  misc_feature (741)..(741): n is a, c, g, or t
  misc_feature (745)..(745): n is a, c, g, or t
  misc_feature (749)..(749): n is a, c, g, or t
  misc_feature (761)..(763): n is a, c, g, or t
  misc_feature (765)..(765): n is a, c, g, or t
  misc_feature (781)..(781): n is a, c, g, or t
  misc_feature (783)..(783): n is a, c, g, or t
  misc_feature (861)..(861): n is a, c, g, or t
aaaaaacagtcctttctactatttttttcctctgnacctcaagcacatcccttttcatctatttttttttcanggtggcaaaaactcaccanaaatntcagcttaaaagatggnganaatctcaanacccttcccctccaaacataagannccttccaaaggctcctactagttttcaaaatacatgcccaaaaanttttaggatgcaaggcagatttnaccactttgtggaaatntctcannnccagcactgtntntcactctcttgggctgggcctatgaacatggaangcagcagttncatgcgtttttttctccattccacacagaacacagagcagacgctgcccagcttcagacatgtgtggtgaccaaacctgatccctgtngactcacacaaacgtggcatgtaaggnggagcgttacaagaataacaaaaatagctcctcaaaaaacaaaaggcttcatgtatgcaacagcattagttttgaagctcatatgnnctttatnttannanntttttnananntnaaaatntnaatnnttttttattnnnttttttaattntttttnaantnannnttnaaanatnnnnanaaaatnanaaaatnaaaaaaaaannatnatntnataatttantnnaaantanaattataaaaantaanatttnnnntnantnnnantnannnnaaanantttnttnatannatntatanaataattntttcnataantnttttntttntaanaattttaaaacnnncnaaatttaaaaaaaatnanaaaatcccacaaatcacaacataactcttcaatcatctcaccacacatttcattcccactaaaaactaaaactcatanattttaa

SEQ ID NO: 600729 - DNA, 333 bp, Homo sapiens
  misc_feature (39)..(39): n is a, c, g, or t
ctccctctattatccacaacaagccatcgtgtttgccangtcagtggggagagattatatgactggggtttacgaggatatatagtcatagaagatttgtggaaggagaactttcaaaagccaggaaatgtgaagaattcacctggaactaagtagaaaacttcatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtta

SEQ ID NO: 600730 - DNA, 199 bp, Homo sapiens
agcaggctgtagaacatgagcgtatggccaggggaggtgcagctgacgtcagccctcctgcctgagcgaggaggacgagttgctgtgcctttttggggagtcgcctgcacacccctgccgcgtggagggcgaggccggtcaatcttggcaactcccccaatggaggatttcccggtcacaccggcaggccaaggaccac

SEQ ID NO: 600731 - DNA, 634 bp, Homo sapiens
  misc_feature (212)..(212): n is a, c, g, or t
atctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgctataaatctatcaaattcctggggaagncaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaa

SEQ ID NO: 600732 - DNA, 365 bp, Homo sapiens
  misc_feature (39)..(39): n is a, c, g, or t
  misc_feature (344)..(345): n is a, c, g, or t
  misc_feature (347)..(347): n is a, c, g, or t
ctccctctattatccacaacaagccatcgtgtttgccangtcagtggggagagattatatgactggggtttacgaggatatatagtcatagaagatttgtggaaggagaactttcaaaagccaggaaatgtgaagaattcacctggaactaagtagaaaacttcatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaacnnanatggcctcgctggcctca

SEQ ID NO: 600733 - DNA, 687 bp, Homo sapiens
  misc_feature (212)..(212): n is a, c, g, or t
atctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgctataaatctatcaaattcctggggaagncaaaagcagattaataaactgagatagaaaaaataagctagtagtttacatgtttaagaatttttggttgtatattaaaagatcaagtgaatagtcactggcctctaaaatatttagaaatctccaccgcgcctggcctggtttctctatttaaatctgaagaattttcataatgccaaattttttctggcacagttacttatgtttttcttttctttctttcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtta

SEQ ID NO: 600734 - DNA, 1117 bp, Homo sapiens
ggcgcggccttcatgagtgtacggctgtcgtggtaagggatcatggactacttgcactccgccttggattcggttttcgtctatcagacattcaggtacctccaatgatgggtggatactaatgtagatccaggagtctatagggcaaagaagcaggctggatggtcatctgcggctgtaaccattctatgaggggtacaagctacgtttgagagtgacctggtcagttcttcttgctactgacacattgggctacagaggctctgacccaggactagataacagacgctgcagagactcgggttgacaagggccttaaggaaaggatagcctgctataataggattccgtgttcggccaggggtggtgccgagaatagcgcccacgggtccgtaatgggtaggcagtctttagcgggcgcactccgttgtcccgtacaatgtgtcgtggaagctcagggcgtcacataggtttggctcccaaggtcgtgcagggtcgcggttagccgaaggaaagcagaggcttggaccgtcacatctagagagggcctcgtgaagcaagtgacgtgtatagtgtctttacatggtgtctagggttgacgatgattacgcagcagtaactgggactgcggtgaaggaagcgtataatccgtacaatgtcgtagtccaatttccgatacagagaataatcaggaaggaaatcggtgaagcgatcccaaggtgggatcgagccagaagccaagataccgaacaaaagtgaccagggagacggacttgcccgttgtgtgcttcgaccattctttgtcagagacaggcacaagaagaccagtcgcgcgccctatgtggaaagacgggagcgccaacaagagggtttgctaaggcaatgaagcataagttaggggttgggagatacatcagggtaggagggctaagcatttgggaaggaaaagggtgtgcgaaagaaaggttcgtaaccaaaggtttcgcaacacgattaatcgggttaaagtattacggataaaaggggtattcggtaaatagatttcacgtacattgaagattgatagcgaaaatattatcgggaacaaaggtacataagagaggaagagcgagaatac

SEQ ID NO: 600735 - DNA, 133 bp, Homo sapiens
gagaggggaaccagagagggaccagaagggaggagacaaagcagcaagcagtggatttctccttgacgacgccagcattagctcctttctgcaccaccaccgtgagctttctccctttactagcagttcagct

SEQ ID NO: 600736 - DNA, 617 bp, Homo sapiens
ggaaggcagtgcatgctctgacttactgttggagggggctgggcctgctggaacccccccaaataaagacctaccccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaaaaaactaaaaacaaaaaaaagggggcggggctgctctttcatccagtctggagagcatgaccagtgccctccctcacctgagtttgtttggtggataagacgaccatctccagggcagtgtttatattacggagtgagtgctctggaggttaatgacgccacgaggattgcatgaaaacccaaccaagacatcctgttgttgcagacaaggacatcacactcaggcgtgggagagtcaagaaccagcggagaccccgctcaatccaaaaattgaataattcacggaacaagtgagacatgcaatgcaactctggaatggccagttgggggagcatgacaaaccagaagtatctagctggtggcatgaacatgtgctttgaagctgccacttattgtacaatgtaattcacaagcgggggtaaattgaatatga

SEQ ID NO: 600737 - DNA, 350 bp, Homo sapiens
aaggtagctgtactgggtgctccagtcacctcccttctatctagtaagtgtatccctgtgctggagccacactgcctcatgcactgatgtgagtaataagcctgcaccattgtatgtcgaattcttcctgcatcttcttatccatcaaaaatcactttgactttgctagtccctttactcttccatatcaatagtttatccaaccatcaggttccaggaaaaagcctgtaagtagttttcattgggacttacatggaattggtagatatagaaaaaacagatatttttatgagtcttcctattcataaaaatagtatgtctccatttacttatgtctttaagatgtattt

SEQ ID NO: 600738 - DNA, 165 bp, Homo sapiens
taggattaagtataaactgcagttttgcccttaaaactaaaaaattattgtttgaacactagttgctgaggcaggagaatcgcttgaacctgggaggcagaggttgcagcgagattgcgccaccggactccagcctgggctacagtgtgagattccgtctcaaac

SEQ ID NO: 600739 - DNA, 200 bp, Homo sapiens
ccccccccggttttttttttgggggggggggggggaaaattttttccccaggaaaacatttttccccttgggccttttttgggggccccttaaaaccggttttttcaaaaaaagcgggggggcggggggggttttccccggttttttttcccccccggggggcccccggggggcccccccgggggcccccccgggggcca

SEQ ID NO: 600740 - DNA, 174 bp, Homo sapiens
ggcgcaggaatgtaagatagagtacgtggaatacagtgtcacggacagagctcctggcctcaagtgatgcctcctgatctatcgctgggcctaggacgaccaacactggtgatgatgatgagcagaatggtcatgaagatgcccaaaaatcagggccccagatgtacaggcact

SEQ ID NO: 600741 - DNA, 1628 bp, Homo sapiens
  misc_feature (27)..(27): n is a, c, g, or t
caaagtccatgtcattactactctctngtcatcttattactggccagaactgaatgtcagatatacgttgacccatttcatggtgcgcaacatcaccaacagagaactgcgtggcatgatacttagtgttagcgatgggtacctggttcgcccttaacacaggaatcagagtcgtaactctaatcagtatattgacaatattattaatattaccctctgataactcaccatgtgacattgggactaacatgtgatcgtacccctataagacaaagtatcccccattatcagccttacatttaatgatctgagattaaacactctggtatgtgagaggtctagagtccagagattctatgtcacactctggcaattgacagagactgatagagtcgaatcttggaagcgatatgatccatgggactcatcttttgcttatggtaagaaaaagaattgacatagatacttgcataaatataaatcgataaaatttacgatatacatctcctatgtatacaaaaatctcgcgagctatgcttcacgatgtccaaactttttcgatgtattatgtttagttagagaatatatggtcctaaattattgaacctctgtgggtttctcatcgatagaagaaaataataatagatacatacattcccttagacaaaacttggggcatctattatcccttttccagggggtattggtacccagagttgtcaaggaacaaacacactcgggggttggtagaagcgtaggaagaaaaccctggttctgggacgaaactggtagggaccacgcgcaaaacgggggggtcatgcggaatttgtggttacccctaccgttttcgattacctttttactgctaggattagcctttcccctggaacacccccacttgagcataggagccagaaaattgccaccaaggcaaacaccaccttgaaggttgtgggcccatttgggcccccccctgttcagttgaggtaacgttatagaggggtatggccaaaagtcttggtgtctggttctctggttgacagggtttcccgcgtagggccctcaaaaggaaaaaggtctaggagaaaaaccccttggcgctgtgggtgccctatcggttggccctctcgatgcaaaactgggggatatccacacccacttctggaaattatgtgtgtccctccaaaatatctgcacaacaccggtacaaccacaccaccttcttttgaacaccccatactcggatgggcgggaaagcggcacatattccttttacaagtggaagaaaaccaatttcttttccattcggattatttggggcttaaccgtagagaggtctttatattccatgttgaggagccccccacttgggaacaatttgtgttaagtatgtgcccccgtgccgacagggaaagtatcacacggcgccatttgcgtgggggccccatggtatagaggcaaccctttgtcaacaaggaggcgcaaaaaacgccccacctccaaaaggcgcattggggccctgagatttcaacaattgctagcacaaccttaaaccccacgtgcttgtgtaacacgcgttccacaactactccacagaaagacactttgtcgtgaaaaaaattggcacc

SEQ ID NO: 600742 - DNA, 424 bp, Homo sapiens
actggtcctggtttcctatccatggccaatcaaggccagaataccaataattctcaatttgttatacccctgaaaaaaccagaccctttggcctttaagcatgtagtatttgggtttgttaaggatggcatggatcctgtgaaaaaaattgaatcctttggttctcccaaagggtctgtttgtcgaaaaataactatcccagaatgtggccagatataaaatcattgttgttcatagaaaatttcatctgtataaccagttggattgaagcttagctattcccatttgatagttatgttcagcttttgaaaatgggcgtttcccatttccaaatgtaaaattccagcttaaagctgttgtccctttttaatgtgttataattgcccctgcatggtgtgaaataaaagtttaacccctggtgtta

SEQ ID NO: 600743 - DNA, 754 bp, Homo sapiens
ggtttttcatgtagaaacagtagtcggtatcttagtttctaaaatattcagtaccatctaattaaatatgttcaacacaatttacatttcaacaacctggagaacttcgctttttacactacgtagtaattgcttttaaaaagttacttctgtgcataggcaggctattgatttgtgggagaaaatgctttgtcttgcttgtattcagagccagtactagttctacttcgatttcagttttttaatattcaaagttggctgggaacagtggctcatgcctgtagtcccggcattttggggggccaagacgggtggatcacctgaggtcagaagtttgagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaacctgccatttttcaaactataccggagagattatttccaggtgccattcttatagtatacgccagcaggcctttaactctgctgtttgcccagatgccgctgggccatgggtttggggtgcccggactttcccaatggcacattcatcaggatgccttatggattgatcgacagggcatagccctgggggatattac

SEQ ID NO: 600744 - DNA, 474 bp, Homo sapiens
tctagaggatcgtggctcagtgatctcccacctcagccttctgagtagctgggactacaggcatgagtcaccagttttaagaaataatacagaaggatcccatgtaacctttacccagtttcccctcgtggtcatatcttgcaatgtggtacattatcacattgtgtacacttgcaatgatggtacactatcacaacaggatattgacattggtacagtcaagatccagaacattttccatctccacaaggatccctcaacttgcacttagatagctgggactacaggcatgagtcaccagttttaagaaataatacagaaggatcccatgtaacctttacccagtttcccctcgtggtcatatcttgcaatgtggtacattatcacattgtgtacacttgcaatgatggtacactatcacaacaggatattgacattggtacagtcaagatccagaacattttccatctccac

SEQ ID NO: 600745 - DNA, 111 bp, Homo sapiens
ctccttctgtgaattctagtacagcagaggatagccatactgcacttctcaaaaacgttagtgtattcttcaataatgcatgcctccttagatgcagaacgtccaggtatg

SEQ ID NO: 600746 - DNA, 120 bp, Homo sapiens
caggactcgaagcactggggagcagtgggcctccagggggcagctccttcctccagctcccggagccagtcggcagcggtcaccccgtcatccaccacctcttccacccgtgccttccat

SEQ ID NO: 600747 - DNA, 687 bp, Homo sapiens
gcagtatggatgtggaggtaacagaggtcttgaggactccaaaatacgaagcgtcgggtaaataactattgaatatggcacatggaaatcagggaagaatgtaataagcatcatcgatggacgggatgagctgggagatcgtggcaagtttaaaggctaatgggaagttggcaagccaaaaaagtcctgtcttgcgaatggccaggaaatcgccaagaaaacctttagaaaacatggttaaagatggagaaacccggatgactccctggtttctgaagaggtgcttaggcatcgaagtgagactgacgagacttcacactgtacccttcagaagggcagacactcacgagatcatcaaccacggctccctcgctgggaggcagacacagagctggaggcggcggccacaaactaggtgggcagagaggcgtcagcatcgggacttgcgggaggccctgggaaggaacagggagcggtggggcctggacagccctggggaaaggaagttacttggaggagaccaggggcttgcatttgggccaaaaacaaggacaagagatcagctggtcccagggaactctggagcccaacaccacatcacgggtgcaggggcctgacaacccaagagagggctgtgggcacgggcaccagctgtggcggtctgaggctgtgccagcacaatgtctg

SEQ ID NO: 600748 - DNA, 270 bp, Homo sapiens
tcttcctctcaaatcagtgtggggggctaggcttaagggagggggataatcggcccagtggtctcagatttccagagccccaaagatgaggtggtttcccatctcttcccatcttcttcttccctctttccgcgggaatccatattccaaaccacatttcccagggcagcggggaaacctcccttccccggtatagcctcttcacttcctggatcgggcaaaaaatttcttggcacacacccattgcaatggagaagccaccactctttg

SEQ ID NO: 600749 - DNA, 413 bp, Homo sapiens
  misc_feature (2)..(2): n is a, c, g, or t
angatacacgtagcacatgattgctgtgggagggtaggaggaggtgcttagaacagctaagagatctatgtgaggataagaaaatctcggggatctcaaaaagaggaaacaggtgtgttttgcatcttccagggaagttctgattttaaacatttggtctcattgtcttcttaagcatacttaagcttctgttagattgttgttgtgatacctgggcaagagaaatacggtatcatgaggtaaaattaatctgttgatttgctaattgaaaagagagtcaggaaaaggaaggtacaaagagactgaatagaatgataagaatttatcctaatgggaactttcaacctagtagaatagtctgacagtacaagtcagagagaagccaatatatgaaaaatttaaatgaaacataa

SEQ ID NO: 600750 - DNA, 884 bp, Homo sapiens
tcatgcctcccacacatagtcgcagatttggagagatgggaggcaagtttatgaaaagccaggtgctaagccaggtctaccataaccagagtcagggactcttatcccgagctgtcaaggacagtcgaaggatatgccaactcggttgcctacgaaaggacagcttaagtgccagagtgagattggcctgaggcctgctcagattcgttcctacgtgaagtaaccattctggtgccaaagcttcatgccccagataacgtactgattcctcctagtgtgcacaaccaacaggcactcaaacaccaactctgggacagacaccgtcgagcttggtctcaagaactagatccaccacttatccaggcaacatagcctgccgaagaaccagtgaaaagccaccaccgtcgccaggcaagagactcctgttgaagtaactgataactgttgtgactgatgtatctaaaatgagtggtacatatgctaatgaggctgtcaatggtgtaggagaaggtgagggctcctatgcacgtttccttcctgagatgttaaggcgaagtattcatcctgtcactagatagaacgcgatgaagcatagcgaacaagcatagtgctttgatcagtttactcaaacaggaacgggataagccgcaagtgacaacttcatgcaggctttcctgcaatgtattggaccaggtgtccgaaactgggaggtttgaacatccctttgtggtgaaatccctagtttagcaccacttttgcagctcgtggccgtcatttcagaacctggtgagacatgtcagaaactagcttcaacactagatacgtggcaccaaattctctcttctactttgtttcagccagttgttcagttaaagatcgaaatg

SEQ ID NO: 600751 - DNA, 827 bp, Homo sapiens
  misc_feature (76)..(77): n is a, c, g, or t
  misc_feature (91)..(91): n is a, c, g, or t
  misc_feature (105)..(105): n is a, c, g, or t
  misc_feature (111)..(111): n is a, c, g, or t
  misc_feature (251)..(251): n is a, c, g, or t
  misc_feature (280)..(280): n is a, c, g, or t
  misc_feature (398)..(398): n is a, c, g, or t
  misc_feature (599)..(599): n is a, c, g, or t
  misc_feature (616)..(616): n is a, c, g, or t
  misc_feature (618)..(618): n is a, c, g, or t
  misc_feature (827)..(827): n is a, c, g, or t
ctgtaagcactatcctttgtactccctcaacgtggcctccatgtgggtgaagctagggagactctacatgggcctnnaacacgggcggggngggagaaaacactnaaaaangccattgcaatcatggaagtagctcacgggaaagatcatccatatatttctgagatcaaacaggagattgagagcgcctgagactatgcagcatttcagttttcatttaaacacttagttcagaaaccgggggggggttnaatatttcaaattgcgcacatcactccancatctctgtaaaataatgtggaatgagaatacttcttggacttaaccactggacatgccggactttgaggggaggctgaatcttgaactttaataccaaattaattttgaatgctttntggtcctaagagataatggcatgggttcatatggtatactttggacagacagagttttaaaaatggaattattttttctttcatgcctcttggaatggtctgaacaaacttgaatgatgaaagtgttaaagagatatcagtaaaaagaaaaagaggaggggggggggaggaggggagggagagagggagaggggagggggngggggaaagggagggangnaaaaaaagagggccggtggcggcaaggggggaggacttgggggccttccctgggggggggggtaataatggggttttgggagtggctgcgtgggcgtgggcgggggggggggcgaggggggcaaggtcagtgggggggggagtggcgtttcccaagggggagggaaagcgaggagaacgtggtgacagggggccggaaggggtcttccn

SEQ ID NO: 600752 - DNA, 157 bp, Homo sapiens
  misc_feature (44)..(44): n is a, c, g, or t
tccaaaaagcctcctttgcccagatttccaaccgggtttggggntgggtttcggaggggagggtttggggggccccccttttcccccaacttccctttcccctttttttttccccattgcagggtttggaataaaccatgtttttttgcccccccca

SEQ ID NO: 600753 - DNA, 386 bp, Homo sapiens
  misc_feature (1)..(1): n is a, c, g, or t
  misc_feature (57)..(57): n is a, c, g, or t
  misc_feature (181)..(181): n is a, c, g, or t
naaaaaaaaaaagcgggactgcactctcagactgagcaattcacatcatcaggtacngaatcaccctaagtgtccatcaacggtaatggataagaatgtgtcctggctgggcgcggtggctcacatctgtaatcccagcactttgggaggcagaggcaggtggattgcttgaggtcaggantttgaggccagcttggccaacatggtggaaccccgtctctactaaaaatacaaaaattagccaggagtggtggtgggtgcctgtaatcccagctacttggggggttgaggcaggagaatcacttcaacccaggaggctgaggttgcagtgagccaagattgagacactgcactccagcctgggtgacagagtgagattccatctc

SEQ ID NO: 600754 - DNA, 292 bp, Homo sapiens
  misc_feature (226)..(226): n is a, c, g, or t
catgcacactataggcctgccagcaccaagtaaggggaggcgggcctgcgcaggctcggtacggtacctcggggtgcggtcctgtctggagtgcctgaggccgccatggggttgtgacagcgtggtgaccctggctctgtgggcttgggaactgagtggcacatgcagagagaaggctcagtgcctatgccccagtgcctggctgtgcccatgcttgggtggtgcnctacagtgtcagagtggttccaccaatgcccccatggtagcctgtgagacagcagtgtgtcagccc

SEQ ID NO: 600755 - DNA, 216 bp, Homo sapiens
ggaacacccattcgagacccagattaaacagacctccagcactccaggatcctagaatactcatctctgactggcggtatgtacgatggtgatttggattcaaggaagacagacaagaatgtgcatcaattaaggaacaacattctggaatactcaggagtagtaatctggcacacttaaccctaagggccagcaggccccgagggcaaccaccca

SEQ ID NO: 600756 - DNA, 510 bp, Homo sapiens
  misc_feature (366)..(366): n is a, c, g, or t
gaaaatgtcaagcgccgtgtcgtcgtcacgaccaacgtgcgcggtcgggacttgggcactttcgtgacggaagcgcgggagcgcatcgcaacgcaggtcaagctgccgaccggttactggatcggttacggcggcacgttcgaacaactggcctccgctgcaaagcggctgcaggtggtcgttcccctgtcactgttaatgattttcgggttgttgttcatgacgttcaattcggcaaaggatgccctggtggtattcagcggagtacctcatgcactgaccggcggtatcgcggccctgtggctgcgggatattccgttgtcaatttccgccggcatcggcttcatcacgctgtccggtgtggcngcagtcacgagtgtggtcatggtggagagaaaccgtgacctgcgcgcccagggcatggcaatcgatgaagcgattgaaacaggggccttgatgcgcctgcggccgatcctgatggtggccctggacgccagcctgggattacct

SEQ ID NO: 600757 - DNA, 663 bp, Homo sapiens
gcctgggtgacagagcaagacttgtcaaaaaagaaagaaagaaagagagagagagagagagagagagggagcagcagagcagagcaaagcccagcaccagcaaagccaagcaaagcaccagaacagtaatagcaaagagcagaccagcaacagcaaagcacagcacacgcagatgcagcaacagagcacaatgaaagcaagaaagcaaagcaaagcacatgacaaagagacacagcaaaagcgaaaggccgagcaaaagcgcgaagagaggactaatttcgtgatagtggcgtagtcgcttaaacatatcgtgggagcacctcatttataaagagtcaagagaagatgaaacacgtaattggcttgagaggaaggggatgtaggaggaaaagtaagagaaaccggcaattataagtaacaatacgtgataaggggtggggggaatggattaattagaaggattgaaaagataatgcgaggaccaaaatatgggggggaacacagcaacaggggtgtggaagggaaaatttcctgcaagttagtcgtagaaagctagtaaaggaggaatgtggagcacaggaaagtctcatgagggggataatatactcaaaggattataaatcatgctatatattgagacacatgcgagagatatgtggtatg

SEQ ID NO: 600758 - DNA, 626 bp, Homo sapiens
cgcccttttatttatttattggtaaaaatacatctttaaataaactttaagaagtacagcgcactttaattgaggtttacattgtagttaacagcaaatatactatccatggtagtgtatatgtacaagtaaagtaactataggttgagtttctctcccaatggctggataaaccaaatctgatacatccacattaaaggttgtattatccaagtgggttctccataaagggccttataacaataataggctttataacaagcaaaaaggtatccctcccatcacaagtgagagctagatgagggctccaaaagttgctcttcaaaaacgtgtcaagataataatttgacctgggaacggctatcacacaacagctatcagatagcaaatcagaaacacataaagaaaaaagacaagtaaggaaacaggatgtgagagtcaaagtgacatccaataataaatcccaattggaggactataagattacaaagccaaaagtatactgtatagagaaagtacacggttaatatatacaacccccgtggacctaagagaacgacgggacaaatcctctaaacgactgagtcatacctgtaattaacacatggttaatacagaaagacccc

SEQ ID NO: 600759 - DNA, 1216 bp, Homo sapiens
tgggtttctctccagcagtttgacaatacagtttcacaaaaaaatccctttccctttaaaaacccccatctggttttctccttcctcgcgtgaatttcctccccggggttccccattgttggatctcccgtgggtgtggtctcccattgctttcatttccgtgcccgtgtatactttggcctcgtgctctcagtttgctgcacaatctcccccaccctttccgtgcgtgggtcccactaggggctctctaggcaaagttttgccccaagtctgtcttcactctccctgccaggtcctgttgctctagaggccctatgcggaatttcccccctgagggtcgtggtcctcgcctattctcggccacccgttgtgggatgccttctctgatgcagcgcgcccaattcacagggtctgtgcccacccagggtgttctctgttctctgtgtctccagctttcctggtgtcctctcgtgaaccccgtatgtgtgagggacgcttgtattattgggggcgagtataaaaacaacccccaacaaaccaacactgacaaccaccttccacagttctactgctcggggcaacagctagttacaaccaatttggattccctttgttgaatcccctaacaaatctattcacctctctctacacatgagtttcaaccagagggtcacttttccaaagtggcaaaactcacaactcctcttgacaactaatcatttgtcgcacaacaaacacagcaaccctttgtttccaccggggggggcactcttcttctccccacacccgagaatcttgtcggctctcacgaatgtgtgtttccactccccacaatttttgtgaggcgaacacacacttacaacccatttctagttgctgagacgctcctctcccgcgggcgcttttgttggaacacccttgggcgatccttccaacaccacttgtgtgcccactcaagtcggaggcgcccccccgtaacttttctaacaaaaattatagtctttctctcttacgggctaattctacaaccactttttaacaccacaccccctttccgcacaccaactttttcgttgccaaccgcgtttttcactcccacctaaataacacctgtcacaaccctctttgggtacactctccttgatacaccccatgtcccaccccattaacatttaccactccaattatcttcccctccttgagaaatatatacgcc

SEQ ID NO: 600760 - DNA, 303 bp, Homo sapiens
gtatcaccttcacgagcataaatcaactggatcaacaggagataggtagttggctgtattgctactatgttccgcgattctaacgtgcaagaagagatatctagagagaagaaaaagtgtcagtcaaaaataaagtcgcagagcacctatgccaccacagaacatggctcgtcctacatattcattcagccagtgtttatccagtcctcgcgctatatgtcacgctgtaaatctttagcgcctttactcccgttcctctatccctcttatcagaacttcacttatcaatccaggatctatctc

SEQ ID NO: 600761 - DNA, 333 bp, Homo sapiens
  misc_feature (5)..(5): n is a, c, g, or t
aacanaaatactacaaccaaattcagcagcacattaaaagtaaaatacaacatgacctagtagaatttatccttgggtataaattgggatggctcaatatacaaaaatcaattaaggctcaatatacaaaaatcaattaatgagatcaggtgcagtggtgcacacctgtaatcccagcactctgggcgtcttacgcaggcagactgcttgagtccaggagttcgagaccagtctaggcaatgtagcaaaaccccttctctacaaaacatacaaaaatgtgtgaggcatggtggcatatgcctgtagtcccgactactcaagaggctgaggcac

SEQ ID NO: 600762 - DNA, 180 bp, Homo sapiens
  misc_feature (134)..(134): n is a, c, g, or t
tgggcggatctatctcaaaaagaaaagaaaaaaaaatagtctttggctaggcaaggtggctcatgcctgtaatcccagcactttgggaggacgcaggaggatctcctgaggccaggtgttcaagatcaacctgngcaacatagtgagacccctgttcctactagaaaattaaaaaattag

SEQ ID NO: 600763 - DNA, 722 bp, Homo sapiens
  misc_feature (25)..(25): n is a, c, g, or t
  misc_feature (44)..(44): n is a, c, g, or t
  misc_feature (53)..(53): n is a, c, g, or t
  misc_feature (71)..(71): n is a, c, g, or t
  misc_feature (74)..(75): n is a, c, g, or t
  misc_feature (116)..(116): n is a, c, g, or t
  misc_feature (121)..(121): n is a, c, g, or t
  misc_feature (125)..(127): n is a, c, g, or t
  misc_feature (129)..(129): n is a, c, g, or t
  misc_feature (143)..(143): n is a, c, g, or t
  misc_feature (150)..(150): n is a, c, g, or t
  misc_feature (158)..(158): n is a, c, g, or t
  misc_feature (163)..(163): n is a, c, g, or t
  misc_feature (167)..(167): n is a, c, g, or t
  misc_feature (174)..(174): n is a, c, g, or t
  misc_feature (184)..(184): n is a, c, g, or t
  misc_feature (203)..(203): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (263)..(263): n is a, c, g, or t
  misc_feature (268)..(269): n is a, c, g, or t
  misc_feature (278)..(278): n is a, c, g, or t
  misc_feature (280)..(280): n is a, c, g, or t
  misc_feature (286)..(286): n is a, c, g, or t
  misc_feature (296)..(296): n is a, c, g, or t
  misc_feature (308)..(308): n is a, c, g, or t
  misc_feature (313)..(314): n is a, c, g, or t
  misc_feature (317)..(317): n is a, c, g, or t
  misc_feature (327)..(327): n is a, c, g, or t
  misc_feature (334)..(334): n is a, c, g, or t
  misc_feature (345)..(346): n is a, c, g, or t
  misc_feature (365)..(365): n is a, c, g, or t
  misc_feature (374)..(374): n is a, c, g, or t
  misc_feature (378)..(378): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (397)..(397): n is a, c, g, or t
  misc_feature (412)..(413): n is a, c, g, or t
  misc_feature (420)..(420): n is a, c, g, or t
  misc_feature (428)..(429): n is a, c, g, or t
  misc_feature (449)..(449): n is a, c, g, or t
  misc_feature (465)..(465): n is a, c, g, or t
  misc_feature (473)..(473): n is a, c, g, or t
  misc_feature (475)..(475): n is a, c, g, or t
  misc_feature (478)..(479): n is a, c, g, or t
  misc_feature (481)..(481): n is a, c, g, or t
  misc_feature (484)..(484): n is a, c, g, or t
  misc_feature (489)..(489): n is a, c, g, or t
  misc_feature (491)..(491): n is a, c, g, or t
  misc_feature (496)..(496): n is a, c, g, or t
  misc_feature (612)..(612): n is a, c, g, or t
  misc_feature (649)..(649): n is a, c, g, or t
  misc_feature (652)..(652): n is a, c, g, or t
  misc_feature (719)..(719): n is a, c, g, or t
ggagaaggcggacgtacagctcatnatgagacgacgactcctanagccaccanaacggcctcgaataagcnganncagaaaagatcgcggactaggaccaggaccgggatccccanaggancaannngnatctcaagcagagncttcgangatgtgancgcanaaanggtaganaaagaaaacnttatgaaaaaatgtggaanatgnancnatgcccatcatttgaaaataaaaaaaaaagtaaatgtaaaaaatnantnaangtgtnnatggccatnancctggncttcattganggaattctcttngacannctnaaatgtctgnacatctngattttaaagnnttttgtaaaaacacatgcntaatggttnagcntacanagnanaaaaaaaanaaaaatgtgaaaaannttaaaantgctccanngtgtaagagcgtaggaagangcttctcttctgtcancctgcaantnaannangantgaananaaagnccccaggtctggagattgggatactgtaatacttctttgttattataacataaaagcaccactgttctgttcatttcctagctgttctaattaagaaaactattaagatgagcaancacatttagaaatgtttattgacaggtcttttcaaanaangcttttctaattaatagccaaagatttcatatctaactttgtaaccagaattatacagtaagttganaca

SEQ ID NO: 600764 - DNA, 1040 bp, Homo sapiens
gctcaggtcgccgctgcgaagggagccgcggcatgtcgtgcgacatctgcagatggatggtcgtgcggaactgcatcacagttttccttgatcatacgaggaataagcagaccgtacagtgacgtagtaaggcccaataatcttgaatggtcgcccgcagaggttcgcttgccgctagctagacgcgactgtagttctccagcataggtactgtgtggacgtggagccggcaagccggactggcgatacggtgtccgtggagtggtctacttatagacggaaggatccgtgccagacggaaacgcactgtcgcgacgctgcgctcatggtggccgggaccaccaatgctgagcatagcaactgcttcgtcgcctagcgctcgagcgagcgatgcagaacacatggagtccgcaagagacaagtgaccgagcgccgaccgggcgcactcgggcagggccaatcgccggcaagggtcgcatggcggcccacttctcttcgctgcaacgacgcaggtacaggccctagtgaactcggggtgaaagggaaggaaaaaggcgggaagcacgggtcccccatcccacacgaagcttgccatgcacgtcgcacacgcatgctcccccaagaggtcgacactaaaaggttcaagcatggccttgtttcgttccgaggagcttcggagagaatgaagatctcttggacaaggacacatcatatcaaaaagacagacaccacaggcccaggacacaaaattgttccaaaaccaccaagatcaccccttccacatagggagcccgcacaaagtatatatggtggggaggagcgagaaaaccaaacatgacaggggcatgggacacgcagccaacctacaaagaccccgttatgggaaaggggttggcctcggcacagggcatgatagacaagcccgccaagacccttgagggtgggctaggcaagaaaggaaccaacaggaacccctgggggcctggagactgggcggtgaacaccttggggcctgaccaaccaccgtgggcaaaacccag

SEQ ID NO: 600765 - DNA, 929 bp, Homo sapiens
acatggcatctatgccactgcgatcagattaaagcattaacaatgcccagtagatccgagtcgtgtctgaaacactatctctctgctgctctgatgtggatgtaaagcggaaccttgccgaaggattactctggggcagacatgtatcgtaaaaaccataaggagtgctgctacattatcattctatgctgaaacattggtatgcgcataaagacattcgctggttaaacccttgaagggactcgtgtgaaccaatggtggcgtgccacttgtgtgcacgaagcctatggcatgagattagtcctacttgcagtacatcatccgggttgggtgggtggaccctacatattcatgtattttgagactgtaatggtgcacctttacaagcaatggcttaaggagaataaaatacctgtaacttgtcatcgtgcatgtcccgacatttttccgtcattttgaattatgttgctctaccagtatgctacatcagttggatactgtatctgtaagatggatcaggtgtattagggggcaatgatctatttgtaggattcggatgaaagatggatttagtgcatttttaaagggtgtgtgatttatgctagctaaggaacgcatttggaatattgggtttcttaggggattagacagattatcaagttattgaacaagcgcgcgtgttgtcatatacgtaagtgcaaactgcgttatcggatgtggttagcccaggtgggccaccgcttaggcagttcgtgtggcaagtacaggaccttgactctgtcttgataaactctggtacactaggggcaggccgctaaataagtggaaaagaaggcgcccctctcaagaaaaaaagcaggggccaaaaaaaggagcagaggggaaagaccaagggggggaccattttagcaaacaccccgcggggtacg

SEQ ID NO: 600766 - DNA, 732 bp, Homo sapiens
  misc_feature (121)..(122): n is a, c, g, or t
  misc_feature (208)..(208): n is a, c, g, or t
  misc_feature (215)..(215): n is a, c, g, or t
  misc_feature (219)..(219): n is a, c, g, or t
ggggcgaagggagcaatgctgtggttcagggcgccatccgcccgccatccgacgcaaaaaaggaacggcgcgggtcttcgtggtgttcgtggcaggtgatgatgacagtctaccagattgnntgcaagttgggaagatgataaagtacagaaggcatcttcaaccagttttgttgctattaaaatcgataccaaagttgaagcctgcntacagtnttcncaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaccaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaaga

SEQ ID NO: 600767 - DNA, 263 bp, Homo sapiens
ttatataaaataggtagccccaattaactgacactaaactagcttcttggcctggcgcagtggctcacgcctgtaatccaaacactttgggaggccgatgcgggtgtatcgcttgggctcaggaattcaaggccagcctgggcaacatgttaaaaccctctttctataaaatatacaaaaattagccaggcatggtgtgtgcctgtagtcccagatactcaggaggctgaggcacgagaatcatgttaaccttgccagagggt

SEQ ID NO: 600768 - DNA, 117 bp, Homo sapiens
tgcatgtccacagtgccagaggcagcgcaccgatgggcgcacagaatacaactttgtgtaggaacaatggctagcggctgggtgagtgggcgtctgctgtatcggacgcgtgggtca

SEQ ID NO: 600769 - DNA, 789 bp, Homo sapiens
  misc_feature (121)..(122): n is a, c, g, or t
  misc_feature (208)..(208): n is a, c, g, or t
  misc_feature (215)..(215): n is a, c, g, or t
  misc_feature (219)..(219): n is a, c, g, or t
ggggcgaagggagcaatgctgtggttcagggcgccatccgcccgccatccgacgcaaaaaaggaacggcgcgggtcttcgtggtgttcgtggcaggtgatgatgacagtctaccagattgnntgcaagttgggaagatgataaagtacagaaggcatcttcaaccagttttgttgctattaaaatcgataccaaagttgaagcctgcntacagtnttcncaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaccaggaggagaaagtgcaggccatgccacttcctctcaggagcctagtggatgctcagatcagagacctgcagaggacctcaacatccgagtggaaagactagtggatgctcgagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaaga

SEQ ID NO: 600770 - DNA, 395 bp, Homo sapiens
  misc_feature (3)..(3): n is a, c, g, or t
  misc_feature (6)..(6): n is a, c, g, or t
  misc_feature (368)..(368): n is a, c, g, or t
  misc_feature (381)..(381): n is a, c, g, or t
ttnganacatttcgcatcggtttttatttatttatttatttttgagacggagtttcactcttgttgcccaggctggatctcggctcaccacaacctccacctcccaggttcaagcagttctcctgcctcagccttcctgagtagctgggattacaggcatgtgccaccacacccggctaattttgtatttttagtagagatggggttttttccatgttggtcaggctggtctcgaactcctgacctcagatgatccacccacctgggcctcccaaaatgctgggattacaggcatgagccactgtgcctggccggtcacacttatttctatcagcaggattttgtgccatcctgttgtacagcttaancaaaatacatttntatgtgccacagtc

SEQ ID NO: 600771 - DNA, 388 bp, Homo sapiens
aggaaacaattcgtacatccagcctgttcctgccgggatgatttgatcgtacaccgcctcttctattttgcgcggactttctactgtatgaaacatcgtcatttcctccttgtattcaactttgctcagttgcagttgatcaattgataatactcccacgtattttcaaatgcacgccgattttccggacaaaagttgacgcaataatcgtcaagatttgttggcacagcattaaacacttccatcgtgacaggcacggaaggataaggtgttcttgggtctaaaggattcggtgtattggacaacacaagcaatacatccatttctgtacgcagcgtgacggtagctcctttctggcaatgccctacaacaaagtgcatgtcaccag

SEQ ID NO: 600772 - DNA, 662 bp, Homo sapiens
gtgtgtgttcacagaccagtactgtgtgtgcatatgtgtgtgttcacagatcagtactgtgtgtgcgcccgtgtgtgttcacagatcagtactggtgtgcatgcgtgttaacagaccagtgctgtgtgtgcacatgtgtgttcacagatcagtactggtgcacatgcatgtgtgttcacagaccagtgctgtgtgtgcccataagtatatgttcacagaccaggactctcaagaacatagatgcaaaaatacttcacaaaatattagccaactaagtattactgagactcctgttctccacaagttgacgcagagatgcagtgcagtcccactcagagctcccacggcttttctagaaatgggcacacaaagctccaaagcgtgtgtggaaatgcagatgacctgggagacccaaaacaactccttgacaaagagcaggatttcaagacttaccagaaagctacagtaaccaaggcaggtggtgtcagcatgaggatacaatagagcagtgggatggaatagaaagtacagaaacaaaaaattccatacccaaaggggcagggggccgggacacaggcacaggattcagtgaggaaaacgagcacggaagtccttttgggagacggggcctcctcggttgaccaggtgaatggcaaacggtg

SEQ ID NO: 600773 - DNA, 119 bp, Homo sapiens
gcggtgactctagaggtccctgagagacgtgtttgcaatgtaggaagcctgatggttttcagtgtgcgacagaatgtggaccacaacaagcccctcacacattgcaatacggtctctca

SEQ ID NO: 600774 - DNA, 168 bp, Homo sapiens
gccaaacccagcagctcagaaaaaagggtaccatcccagccagttggtccattccgaccaaccgaaagtccataacccgttaggaagaagcattggccgttgtttcctttaatttttggaaggattaattgccaggggagtccataagttgaaccaaataaaaagggc

SEQ ID NO: 600775 - DNA, 688 bp, Homo sapiens
  misc_feature (600)..(600): n is a, c, g, or t
  misc_feature (628)..(628): n is a, c, g, or t
cagcttcagtgttatgtaacagtgagttgcactcctcattcttgtatgctgtggtgagcaggagggaggattagctcctcatcctgtcctttttctgtcattcactcctcttcccttttttggactgacatttttattttggctgcagtgctggggaaatgtccacttgagactaggtcacaagaatgtttaataactacttgttgattgaataaccagaagattgtaacttcattaaccctcctactcaaatgcaggcctggagtctttgtccttgagatttggcagttttttctaggtgttccacttttcttcttcactctcagtcaactagatagtctgagacaatgaatgttgccaactgttataggttgacacagtgagcactggtgaggcagggatttggggtttaattccaggctgcagccccatggttagaaactatgcagacctacatggtactcttaactgctctaggatgaatgagtatccttgagcagtagggtaccaggttggagagtgtagaagtgttcagggcaggatgtgtaattagggaagattagggatataattttatattatcatatgttttaatttggnggttattcaaattgtcaaccttaaatantgcatttcagaggatatgattaagtatgggagttatttgagtgcaagcttgaggatgcca

SEQ ID NO: 600776 - DNA, 535 bp, Homo sapiens
  misc_feature (13)..(13): n is a, c, g, or t
gcagaggggttcnaggtatgataaagggtcaggttaggattgggcttcaagttcaagtggggggtagggttagatcactaatggaaggtcagggataggagcacaagtcaatattatgatcaagggattatattcgttataagggacaagggtcaaaggtcaggataaggatcaaaggtcggggggtaagagaattgggtagatgccttcagggttcaaatcaggggtcaagagtcaagggttacgggcaaaagtcaggggtgagtacaaaattttacatggaagttaaagtaggtgtggggtggggttgggtttggagtctaaatttagatccatttgcagggtggggtagaattaggttccatatccagtcataagtgagggtccagatcaaaatgggggtccaagttctcattctcggtccagggtcaggggtcagctcaaggatcaagaagcaagggtcaaaggccacaggttagttgcaaggtcccaagtccggtcagggccagtatcaggtcgagaggtacaacagggc

SEQ ID NO: 600777 - DNA, 439 bp, Homo sapiens
  misc_feature (23)..(23): n is a, c, g, or t
  misc_feature (202)..(203): n is a, c, g, or t
  misc_feature (209)..(209): n is a, c, g, or t
  misc_feature (215)..(216): n is a, c, g, or t
  misc_feature (249)..(249): n is a, c, g, or t
  misc_feature (254)..(254): n is a, c, g, or t
  misc_feature (353)..(353): n is a, c, g, or t
  misc_feature (394)..(394): n is a, c, g, or t
ggggtagtcctgtgtgctttccnctccctcctggtctctggtgtggtcccccagttgccgtttcctggttgcctggtgcccagggtccctgctttggggtgggctggggcttgttggggtgggggtccttcccttggcctgtgtaattacacaattctcagaagctgttgttgaggcaatcttctttcagtgctgtgttgtnntctttntttttnntcttttggggattgcaaactggtttaacctcanatganatttccttttttgtttgtttgtttttttcatttgattggtttaaaaattatcctggatccaggaaagtgatgccttttcttattctccttttatcatcnaaacaaacagccaatatgtctctagaaacattgcgttctanactgggagtgctgacaagccttcatcccagaccctgagtggcaga

SEQ ID NO: 600778 - DNA, 671 bp, Homo sapiens
  misc_feature (540)..(540): n is a, c, g, or t
aattaccctagtggatcccccgggcttcaggattcggctcgagacctgacttacacacaatacataataccagcaaaccaaattcaacagcacatcaaaaggttaatttaccatgatcaagtaggcttcattctggcatgcaaatttggtccaacatgagcaaatacaaatgtgattcaccacataaataggatttttaaaaagccttagaatcatctcactagatgtagaaaaagcttttgctataatccaacatcccttcatgataaaaaacttcaagaaagtaggcactgaagaacatacctctaaataataagagccatctatgataaaaccacagccaatatcatactgaatgggcaaaaactgaaagcattacccttgcgaactggaacaagacaaagatgcccactcttactactcctattcaacatagtactggaagtgctagccacagcaatcaggcaagagaaagaaataaaatgcatcttaataggaaaagaagaaatcaaactatctctctttgcagacaatatgatnctattcctaaaaaactcaaagacgccaccagcctctagaactcagaaacaacttcaagtaagtttcaggtcattaaatcaatgtatagtcagtagcatttcttgaccaccaataatgttccttgcgagcct

SEQ ID NO: 600779 - DNA, 128 bp, Homo sapiens
ggaagttctcttcacggagccgcgcggtgcgagggcgcaaatagggtcacgggccgttgggggtgtcgttgtcggtaccaggtccgcgtgaggggttcgggggtgctgggcatggcagcaatggctgt

SEQ ID NO: 600780 - DNA, 713 bp, Homo sapiens
tccccccccccctcccttttttgggggctcgggggggccccgcacaaaaaaaactaaaaaaaaaattttctcccctcttgggggggtttttctcttccagaaaaaaacaactccctttataaaggcaggggccgctaagtgtgggtggggggtctccccgcaagcaaaaccaggcgaaaatcatttgtgtagaaaggcagacggcggtggtgtgcgtcgtttcctctctccaccgcccatcttctatttatataaagaagacagagggagggagaagcacaaacagacgagcaatattaaaagggccaaaaaaagacacccacccccaccgggagggaggaggtggggttaatgagggaggaaaaaaaccgcgccgctctctccccacaagagcaagagagcagagatacaggtgcgcgcgcgcgcgtacacacacagagagagggggggagcaggagaaaaaaatgtgtgcgtgggggcgagtgcgaaagacagacaaaaacgaggaaacaccagagggggagcgtgctctctctctaacacacgcgagcggagaggggagggagcagaacacacaaaaaaaagtatagcagcgcgcgcgggtgctttcttatcgacacaccgagaaaggagaggaggggcggcgcacccagcaccacacgacaagaatatgaagaagaacgaggggacgtgcgtgggagagcgaaacacac

SEQ ID NO: 600781 - DNA, 1377 bp, Homo sapiens
  misc_feature (325)..(325): n is a, c, g, or t
  misc_feature (1098)..(1098): n is a, c, g, or t
  misc_feature (1362)..(1362): n is a, c, g, or t
  misc_feature (1377)..(1377): n is a, c, g, or t
ggtgcactctcagaacggctgcctaacgtgtccgaaatgtgccgcaccttagagatatataggagctctgactagtgtggtccttctcctctcccggcaccaggaagaagaatgaactataccaagcgcagcacccagcagacacggcgcaacgatgacgtgaccgaaagaatacgcgcaatggcagccgtgtggccggcaagcgtgggaccgtctagggctcgtccgaatgatacatgggtgcactccgagaagattccttggacgagatacggagtcatcttcgtagacgcgtgtgtgtcgttcgcattcgattgtacttccnacgtgtctctcaacgagagcatgacgagttggtaatacacagtcctacccatatggtcaacatgggtacgtctttctctagcgaacaagccaaaaagcttgatgcacgaagaactagccttgtcgtggcgtatggagacgctggggagagcgagcgcttgacgtgggtttgagctagacaagggcatgtgtaaactcgttgtggccgtgcatcgttggagtgtagggaatggctagcgaattggcaggggtcactacgtacacccgtatagtcgattcacgattgagaatgtcaccccttggttgaaccgggatcccgatgtgctagttggtcgccttagcgtcctcttcgagttggttgtgcccttgagctaggtttcgtgtgccgtcctcgtggtgaataggcatgtgttgtctctgggtacttttctgtcctgcttcctcggtgataaggtctttagcactcacttcgtgtgagtgtcaactttgaataaccattcggtcgtagaagattgaacatgcacgtctttcccaacgggcgacttggggcatagggtctgctgacgagctggcattgagccaagatcccgactaaggattcactctttgcttttgaagagagatcggcggtcccgtatactttgcggtaagcgtggacattgcttccacgtatagagcacagcgatttaagtaagcccactccggatagggtgtgcgttgatccagcgaaggaaacccaattgtagtcacttagaactccccccaccggagttncattctcctggagcgggaaaacaacggcttggcggcgccgacacagggtacggccacccgggaccctagaagggtccttggagctggcggaccacaaaattgttggcgtcccttacgaaggcttgggcgcggcactgggaccacttccccctatgttgttggccaacgcggaaagcctgtattgctcccaagggggccggatatttttggcacgtctctaaccgccttacacttgggaactctggatatacagggaacttgaangccagggagtccccn

SEQ ID NO: 600782 - DNA, 240 bp, Homo sapiens
ggtggtccccccccgcaagtccttgttggggcatttcaatcggcgggctctggggaagattgacctttagttcattgccgccgcctccaagtttggccatggccggtttccgaccgtggaggaaaaaaaagcatttatgggacccctgaataaaggcctaattgcaaaggaagaaggaggttaatgccaggaacagattttgcagttggtggggtctccaaaaaagttatttttccctga

SEQ ID NO: 600783 - DNA, 924 bp, Homo sapiens
aggaattttctttccccgcccgcgggggggctgtctcgctctttgtggggtgctttcgtgttcttggggttggttgtttctgctgtttatagcacccccgagtggttcttcacacctctctgttgttcgccccgcaacggtttttcggaggctggtttatatttgggggcgcccgagttttcttcgcggccttcttcccctcgggtataatcgctcgctcgcgcctttctctcgggattgtttccagcggtagtttttgtctctcgcgcttcacggcccctcccgcttattagtgtgagccttgcgggagtttatatataggcgcgccgccctcactccacccgccgcccacagtgaaactctctgtggttagattgttgtaagtatagaaagaataggggtgtttttcgccctcgtttggggccacaggcgtggttgttttgaaaacttcccacgcctcgagaatggagtgccaccccacacgtgtcgcaccctgagccacacaatggctcgggaatttcacggcgactgaggccacccacacttcccggcctcgctgttttgtgttttgaaagaacacggagactttaaggtgtttccttccctctcccgagagacttgtataaacctcggcgctgtgtgggctgtgcacccgcgctcgtgttgtagcgtgccaacacctctcacggggttctggggagaattctgtggctgggcactactccgtcacttgtggccccttcatcacgaagctggggcctcttcgggccacgaaagaacttccttcgtttctttttagaaggggggattcagggcctctttctggggttcccctgggggaattttgtgttttgtaaattgtttattttgaaaaaggattatttttaaaaccgttaaaaaaggtaaaagcatattttaagggga

SEQ ID NO: 600784 - DNA, 363 bp, Homo sapiens
tcagcgcttgtaagtgctcagaatggttgccctggcactgtgtgcaggttgtctgggaagatgatgaatgataatgaggaagaagctggcagtgtgcagatgcaaggatcaagacccggacccctgtgattctgtgtcattactatcagcacctacggtgccacacatcccatctccctgccagaactctcctgtcccctcctagaagtctttcatcctgaaagtggctttttgagcttgatttcctggtggaccgtcctagggtcacctggccagaaggtagtacccagtggttacataaggagtaagtcggaaggtataaactgcccttgccagtcagcaagactgggcctcctgtgcaat

SEQ ID NO: 600785 - DNA, 1477 bp, Homo sapiens
gccgcggcgcggagagcgaacgcgcagccagccttgcggaagcccaggcccggcagccatggcggctggaaggaggaactgaaactgctgctgaacgttcttgcctctacccgcctcctcctgctgcgcctctattgcgccatgctgcagctgcggacgtgacttgccagctgcgcgctgctcgcgcgcgccacacgccttgctccctgcacgctcaccgcacccactacactccacgcggcgtgcttacctcctcctggttctcctctgcatctgcccagctggctcacctctactcgccacggtgcgcgctgctccttccccctccatctccctggcctgcgcctctcttcgctgcgcgctcgccctacgccgtcgcgcgctcctgcaactgcgcagcacaccttacattactggtccctccactgccactcgaacggcgattatggccccagtacccattctctgtgcatacattcgtagtactccacctgtcttttgggtcttggcccgcgctgcgcccccgcccacagctccgtcatttgccttggcgcccttactgcctcgcttcctaccgcagccgacacttacataccccggctgctcacgcttgcatacctacggcatgttcgttctcctacaccttaaccagcccagagctccccatcgatatccccgggggcatcctgtccacgccaactttgctcgatagcgataacactttaaacatcctggcgacgaacaatacctcttactaccctagcatccttctgtgcgtctacgcgcacctcccccccagcgaccccgcagccgcagttgccgagcggggctcgcacgaagcatcccgtacagcgcccaggccactgcactgcacccgcagccactaggccctcaaggcagaacacccagcaatggcaccttcgcggcctaacggagacaggcacgtcccagcggatctacaccgcacatgcacgtcgggcacaacacgcagcacccccggagaaggaactcccgcccccggcagccgtagtcggagagagccccgatcgcagccaatgaaaaaacagccttcaacaccccataggaccccacgccgccacaatagacgaggaaggccagccaacacatcagcagcacagccagcacacaacagcggcaacgcacaacaaagcgcgcacggcgcataccagcgacatacacatagagcggcacccaggcaggcccatggctcatacgttgtcgcaagacagaacacagcgaccacacaaagggaggagacggatggcaagaatgagcgacgccaaaatggaagcagcagacaacacaacagcgacacacaggcaactggaacacagggggagacagctgcggaacacagaacgcgcccctgaccgaccgcagcacaacatcgacacgcagtatgcataggaccagaaatctcggagctgcacagatgagggagcagtcgccgagccgc

SEQ ID NO: 600786 - DNA, 298 bp, Homo sapiens
ctaccctgtagtgctgagagaacagggatggattggtcagactgaacatgcacacaaatagccccaaggaagcccaaatcttctcagtgatgagatttttaaggccaaattttactctatattctggaaaaacagatgaaatatgtactatattagaatgctatttcaggaaattaattatgtacacggactgcaaattaaatatattgtcccatttggtaactacagaggtcagatagtcttccgggattaaaccaagagaacagctgctgcatttgggtactacgctttggcagga

SEQ ID NO: 600787 - DNA, 294 bp, Homo sapiens
ggaaggggttgcctcaaaagtcacagcttagctgggcacagtggctcatgccgataatcccagccattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaa

SEQ ID NO: 600788 - DNA, 373 bp, Homo sapiens
  misc_feature (81)..(81): n is a, c, g, or t
  misc_feature (158)..(158): n is a, c, g, or t
  misc_feature (178)..(178): n is a, c, g, or t
ctggggtaccgtctgtggttagtggaagctttcagaaatgatgaatgggtgtggagatttatgataagcaaaaatggatgnatttattttaaaaacatcagtcacagaactcttctgaaatcagatcataatggtttggtcactctctcttttgtgtnaatttatctctctctgattngggaatttcagtccaccttctattaaattaacctgtgaggacatctagcataaccagaatggatccccctgtatgatttagaaccttttggaaagtaaccttgggatttcccgtcatggtgcagcagaaacgaatccaactaggaaccatgaggttgtgggtttgatccctggcctcactcagtgggttaaggat

SEQ ID NO: 600789 - DNA, 280 bp, Homo sapiens
agggaggagtcaagatatgtgacctctccgcctattcaccttcgcccttctggagattcctctcacagtcattcaccctgttgtccgctatgccctgttttgcctgtgagtcagtctggtaacgtacagcacaagaaggggaccatggctgccatgtatatcccatagcactgctgtcctatgcttttgcccttgcaggttaccaggacaagaggaacgaagtactcaagtcacttaatgaggaagctgtgaagaaagacaactctgccctttctggtgg

SEQ ID NO: 600790 - DNA, 404 bp, Homo sapiens
cggaataattttcatagctatttcctgagcaaaaaacacaccccacaaaaccctaattattgccaaaagactttgcggggggagaaattccccaatgctattgcctccttttattctagccatgctgccaggtgaaaaaacgccacccacacagattgaggttgggtcaacctcttccagtccactgactcaaacattaatctctcttggcaacaccctcacagacacacccagaaacaatactttgatccttcaatccaatcaagttgacactcaatactgaccatcacagcatctatgtatataatgatatctgtgtctgtatgtgtgtcttacattggagaaagatacagcagataacaaatattgtttgttctcacttataagtgggaactaagctacca

SEQ ID NO: 600791 - DNA, 491 bp, Homo sapiens
  misc_feature (250)..(250): n is a, c, g, or t
  misc_feature (306)..(306): n is a, c, g, or t
ctttgtgcaccctacgggcgggccgtcatcatgtttggcgtcccctacgtctacacacaaaaccgcattttcaaggggcggctggaaaaccttcggggccagttccaaatttgttaaaaagactttttttcctttgattccatgcgccccccggcccaatgtgtgggtcgggccatcaagggcaaaacggaatacggcctcatggttttttcccacaaacggtttgcccgtggggacaaacgggggaaanttcccccctggattcaagagcacctcacaaattccaacctccacctttccgtggangagggtgttcaggtggccaaatacttccttcggcaaatggcacaacccttcccccgggaggatcaactgggcctgtccctgctcaacctggagcagctaaaatcaaaggaaacccttaaaaggataaaacaaatttctcaacaacttttaatggggcgggtggggccataaacggtttcccctta

SEQ ID NO: 600792 - DNA, 191 bp, Homo sapiens
ggagtttgagaccagcctgggcaacatagcaaaatcctcatctctacaaaaaaaaaaccaaaattttaaaaaccagggaggaaccaaatggaatttttagaaccaaaaatacaaaattgaaataatgacttcaggggctggcttcaatagcataatggaaaacacagggggaggattcagtgaactgtcta

SEQ ID NO: 600793 - DNA, 244 bp, Homo sapiens
  misc_feature (155)..(156): n is a, c, g, or t
  misc_feature (158)..(159): n is a, c, g, or t
agagataaccttgccctagttgtgggcaacacatgcagaataatcctgttttacagctgcctttcgtgatcttattgcttgcttttttccagattcagggagaatgttgttgtctatttgtctcttacatctccttgatcatgtttttaatatgnnannaaacacgaacctgtcaatatttttgaatgtaccccccatgctattgtttgaacttgagtataagataaaataaaattttatttta

SEQ ID NO: 600794 - DNA, 348 bp, Homo sapiens
ccagaagctgctccaaagccagatctgtggattcccagaattcattgtgttcctgttagaggaacacctccttaagagccaccacccacctggcttgggtgctcagagatgctgctcctgggaagataaatctgtcaggtgcagggcgccgctcttgaacacagactctgccccacagtctgaagaaaggtgcacgtatgaatgtatggaagtgcctgccctctgtggacagctaggcacccttacccgcccaggaggcacgtgcgacagcagatctgaatgaagagcttccgttcgcacagccggttggacttccccatctcgcagtatgtctcgtcagcgttgctg

SEQ ID NO: 600795 - DNA, 401 bp, Homo sapiens
  misc_feature (362)..(362): n is a, c, g, or t
  misc_feature (367)..(368): n is a, c, g, or t
aaataacttaaggaaagtctgcagaattcttttttttacaacttttctgagtttccagtgggtatatttagtgtgagtttgacagtaacaggctagggagggcagagattggagaaattgggggtcgggggagtgattatgggaagaaggttagtaaggaacaaaacaatgcaccgttttgtaaagataataaatggaacgtggctggtagatactattcagtacattttcttagggtgagtaagggtagaccaggggaggagggggcggagagagtgttacagaagaaagaaaataagtaaccctgatggtttaagccctttataaaaaagaaatggcatcaggtttttttttctttattnccccnnaccccaccctttgtagtcaagagacttttaaag

SEQ ID NO: 600796 - DNA, 255 bp, Homo sapiens
gctcgtgcctgtaattccagcactttgggaggcataggcaagaggatcccttgagctcaggagtttgagatggcatgaccttatctctgtacaactatagtcccagctacttgggaggctgaggaaggaagattgcttcacccagaggattaaggctgcagtgagccatgatggcaccactgcactccagcctgggtgacagagggagaccctgtctcagaaaaaaaagaaaggaaaaggaatggctgaaagaca

SEQ ID NO: 600797 - DNA, 443 bp, Homo sapiens
  misc_feature (312)..(312): n is a, c, g, or t
  misc_feature (340)..(340): n is a, c, g, or t
  misc_feature (370)..(370): n is a, c, g, or t
  misc_feature (405)..(405): n is a, c, g, or t
aactgaagatgtctccatgagcaggcccaagggtggcatatattctttccatcctccttacacatggtatgagatactttagaaatgtgttctagctgtgaacccaaggaaagaaacatttttttctgactttcagatcctctatacttaagatcagctaacacagtgccatattcaagttagtttcttttaataatatttaataaatgtatgttgcagcctcatagaaattataatatgtgatgtttcttttgaatcatattagtggattttgatatatcgcaaggatataattattgacttgggggttantatgaatttggtggcatggttggttggncaatataataaataatggttccaatttccncccatttgacaagtggaagttctcccagacctcantttcccggcctggcctcacagagtctcatgggttgggg

SEQ ID NO: 600798 - DNA, 269 bp, Homo sapiens
atatgttatttcatgtataagaaaattcgagtataaaatactttctgaaaagtgctttaaaatctgttatccatggacaagatctttagaaccggcatcagagtgagcgtgcttatgcatgttataagagatgcagttgaatgtgtagatataagcacaccttattattctggaggttttgaaagactttaaaaaaaatcacagtagagctcattaattccttacattagtcgccccattacagggtacctacaggtcatggtcgacgc

SEQ ID NO: 600799 - DNA, 271 bp, Homo sapiens
gtgatctagaggatcccttttttttttcccagtttttttttattggtaaagctcggccataaacttctagtcgggttgcaatgggtcaccggccacactcgcaccaggtggtccggggtagccagcaaacagagtcgggccatcagcagaccaggccagggaggtgcacgggggtggttctgcctggctgcgggtacggataacttctggcttcagttcatctacaaggatctttccctctaaatcccagatctggatgcggggtaccgag

SEQ ID NO: 600800 - DNA, 108 bp, Homo sapiens
gacatgctgtgctgcgcactccggcagtcgcctgttgacagtttcccatatagctcttcgctgagctcttgggtcgggactcgtgaagcagacgtcttggggcaggct

SEQ ID NO: 600801 - DNA, 650 bp, Homo sapiens
atcgcagagtcctaaagaagattgtagttactcttgagggaagcggtttacgccacgtgccgtgcatttctataatgcaggataatggtatcatcaccgccttagaaacatcctggatactactgtatgagtgtacgcaacgcatgaagcatcgtgagcgcttgcccaaggtggactctcgtggaaaccggtttcctgcaatatcggactcgacagttgctttcccggaacgtcacgactgcaattgtaccgcgcactcttgccgtaaacgccacgcttcccttcaaagaagtctgctaccaattctgccccattcacacaactaataatttcgaaattaccacgcatcctcaggaagaatacctcgaaacagcccagacggactcccaacatcatgcgacatgtagcactcacacacacgtcgcatcttgcgtatccatttcggaaagacagcactcgtcacctaactcatacgccaaccatgaaacctccattaattacacttcactcgtataggcaaacccacaaagcgcccaactcaattaattatcatctatggcacccacaacaacacacccatatttcgggccatggactcacaccaccaccttcaccatacatcacacccgcgatgtcgctagctcccctat

SEQ ID NO: 600802 - DNA, 518 bp, Homo sapiens
gggaagatgggagaaaaagcagtatgggaggccttcaagtcttggtatcttcagaaatgtgctaggctttgtgggcagcagatacttcacaacattacgtaaagaacactggagtcaaaggcatggagcttcagaaagttattagcactgatagccaaccacggtggtgggtgcctgtagactcagttacttgggaggctggggtgggaggctagctggagccaggagttcgaggctgccgtgagctatgatcatatccctgcactccagcctgcgtgacggagaccccatctttaaaacagaacaaaacaaagataagaagaaaagaaagttactggcactgagagccagacagatgcccaaagtacgagcccatcacgaatttccaacatgagatcactggccccgtaatcttcatattacaaatagcttccttcctcgcactacaagggatgattcgagcaagcagcttctaaaggagaggtgcaaccgaagacatgctctgaatgtttggagat

SEQ ID NO: 600803 - DNA, 187 bp, Homo sapiens
ttcccccctagggatgtgcgggtgtgatgctagggatacaatccgagctatgttggagaaataaaatgtgcatcgtggcggatttattttaagtttgttggtcaggtaccttcaggtctagggctgttagaattcctaggaaagtgacagctagggctgtgagttttaggtagagggggattgttgt

SEQ ID NO: 600804 - DNA, 171 bp, Homo sapiens
gaccaggggcccttcccttgattgaggcccttcccgagctcagtgaaaagggccctgttttcccctcccctgcccccaggggctgtggacaaaccggctgggggactgcccaccctcccccctgtttttttaacttatttcagggctttataataaaggaacccctaccca

SEQ ID NO: 600805 - DNA, 445 bp, Homo sapiens
  misc_feature (5)..(5): n is a, c, g, or t
tgtantgaatggatagaaggtggacttagaacgagtagcaaacatacatcgtagataagaaatcagcccacgtgcgagcgacggatcttgagttgaatcagcctattggtgtagttgtaggtctacatacatctgattgaatcgaacctactggtgtagatcagtggactatgagtaagtcgtgttgtcagttctccagccaagcaactttctaattcacagtgggggaccctaaatgtccttaaaggtagagaggaataggcccacaggatacattgggttacactatctcatactggttatatgtgatggcacgagagaggcagtaggctagaaagattccaatcagttggaagcaagcaaactcctaaggatcatcctgcaacgagtcccatttctgactctatgaaggtcatcacctttataaaacaaccttcattgtcaa

SEQ ID NO: 600806 - DNA, 670 bp, Homo sapiens
ttgggaagctggctggaaagggccagagctgacctgcaattttatttatttatttttttttagagggagtctcgctctgttgcccaggctggagtgcagtggcgcgatctcggctcactgcaacctccacctcccgagttcacgccattctcctgcctcagcctcccgagtagctgggactataggtgcctgccaccacgcccggctaatttttcatatttttagtagagacggagtttcaccgcgttagccaggatggtctcatctcctgacctcgtgatcgtcccacctcggccttccaaagtgctgcaattacagatgtgagccaccatgcctggcctgacctgcagttttgagtgtcttgctgcagcccgcgccattcagaccaagccctagtcaatattccagaccatgcctctagccagagtgtgccctgtgctggacaaatgagagcctttggctgtaaccagcgcatcagttgaacgaagagagtgccttcctaaccggattatgcccttacctctgctacggccttcagaggtactctgcccggtctgatcagcagccgtggcatacgcctgaagacccacatgttggcaggcccaatgggcattacacctgaggcccgtgtttacgactggtctactactggcatacgcccttgctactc

SEQ ID NO: 600807 - DNA, 90 bp, Homo sapiens
cttgggagataacagtttcccctctccctccccctgcagatttccagcgcccggaccaaggccaagtaagcctctacaaacctagcattt

SEQ ID NO: 600808 - DNA, 713 bp, Homo sapiens
attctctattccaataaagcagagtttgacaccgaaaaaaaaaaaaaaaaaaaaaaaaaaaaagggaaaaaaaaaaaaaaaaaaaaaaaaaaaaaaaaaaaaaggaaaaaaaaaaaaaaaaaaaaaaaaaaaaaaccttgtggcccctttggcccaattcatttttaacttgggcaagttttttccttgggcccgaatttgggcttaattggccaatttccccttatggggggccttttacaattcaatggcccgcgttttaaaaacgttggactgggaaaaccctgggggtccccaatttaaatccctttgaagaaaatccctttttcccaagtggggtaaataccaaaaggccccaacccattggcctttccaaaaatttgccaaccctaatggccaatggaaatttggagccttaaatttttggtaaaattccggttaaaattttggtaaaaccagttattttttaaccaaatggcccaaattgggaaaaaccctttataattaaaagaattgccccgaaaaaggtttaagggtttcccatttggaaacagggtcccctttttaaaaacggtggcttaaaccgtaaaggggcaaaaaccccgtttataggggcatggccccattcgggaacccttccctttaaaaaatttttgtgggtcggggtccctaaaagccttttggacccttagggcccccttttgttttccggg

SEQ ID NO: 600809 - DNA, 120 bp, Homo sapiens
gggcggcaagatggcagttcaaatattcaagaagaggaagtttttcgcttattggcatcttcaaagctgatcttaatgagtttcttactctgggagcttgcttaagatggctacctttga

SEQ ID NO: 600810 - DNA, 262 bp, Homo sapiens
ttgacacgaatgtactccagatcatcatcgtgcgttggcggtactgcgcgacacagctgctggaacgcggggaaaaacgtccccggcgtactctctacccgtggcaaagcaactggctccggcaagtcggcgccgccagggaatcgcgcaccttctgctcgatgccaagcaagaccttgtccgccgcctcatggcgcccagcctgttccagccaacgcggcgactccgggataaagaaacggatggccagcacgaacaccgc

SEQ ID NO: 600811 - DNA, 755 bp, Homo sapiens
gcttgatacaagtgggacaaggatggggtcaggtgagtacagtctatttggtggagctccagatttggagctggaggggttgtggcggtcttagaggcttggcttggggcaagggtccctgagtctgggctgggagactcagtcagaaataggtattgcttatcctctgtgactatgacaggccctccctggggttgggggtgtgacagggacagaagccgacccagggggtcccttgagagcccaggggctggaggatgcctgggactggcatctgctcctgcggggccttggacagggagggggccagaccacagcggcccctcctccggtcattgtgcgggcctctgagggtgtggcaggtgcgcggtgctcacagttcatcgtggtgccgggtcaggtcctcgccatagttggtggcctgactgcccacaaacatgttccaattacccaggatttccgctttgttcaggcggccatccttgtccagtgaatcgaattcctgcagcccgggggtcccctagtctagagcggcgccacgggggggcttccatttttgtccctttgtgagggtattgcgccttggggtatctggccagtgccgtagtcccgcgcaaaaacaaaaggcccgcgtaccacgaccgcggcaaaacgaagggaaggagcggggggcacccccaagaacggcccaagacgaaaagcagcgcggaacaaagcacggaacccgcccggccagagaagacgccacacaaacg

SEQ ID NO: 600812 - DNA, 364 bp, Homo sapiens
  misc_feature (229)..(229): n is a, c, g, or t
gcacgagggcgagcagaagcagaccctacagggatactgggatctggaaagcccacttcctgccccacacgggaatacggggcagccccacactcctagcccgcctggcctactgtggataagaaaacgggctcgactgcctggccctagaccgggactcgaaaccgggggtacttcgtcacccagaaaacgaacctgtgtaggcgcagtgtcagcggcagccgccggngcgcatgcgcggcccgccctatccgggggggggggtggttaggccgcgtcacgtgacgggctcagcgctccgcagtcacgtgacgctcgtccgcaacctctgctgtcctccgcggcgcccccttccgcctgacgc

SEQ ID NO: 600813 - DNA, 358 bp, Homo sapiens
  misc_feature (29)..(29): n is a, c, g, or t
  misc_feature (106)..(106): n is a, c, g, or t
accttaaggcccccttagggaaaaaacanccccccaaatgggtgattcctattggtgttatgaagttgtgtcccccaaagagatatatcagtgtccctgaccccanagtaccctcagaatgtgactgccatttggagatagggttccttcccggggtaacccaaggtagaatgaggtcgttagtgtgggccctaatcccaatatgacggctatccttataaaaagaggaacatttaggctggatacagtggctcatgcctgtaatcccagcaccttgggaggctgaggcaggaggactgcttgagctcaggagttcaagaccagcttggggcagcatgtcgaaacgctgtgtctacca

SEQ ID NO: 600814 - DNA, 305 bp, Homo sapiens
gttttccctccaaatagaatactgttttatccatacaaatcataacagcatctatcccatgctagggttggaaactgatattggtattacttgtgtgtgtcttagtgtgttttatttcccagtgtcatcttcttctaaaatgaaaatatggtgcctccctccctccaggagactggcaaatatgtcctcttattactgctgctgtggagtgatgagatatgcactctactcttaagatcagcaaaagcgtgtcactcctcagtatatcagagtacatcatatctgggactaggaagtcgccagca

SEQ ID NO: 600815 - DNA, 245 bp, Homo sapiens
ttaaataaaaagctatgtgtaatagcataaacatgggatgacaatagttatatatctttgcagcactatatcaagataaactaattgagatatatactctgaaatatggggaattacaatagacataaaatattagacttgtcagaataatactttacatgccaagtttaatctactagcccagtactcctacgggtaacctgagcctcagaattgcgtaacatcataggtacataagactagta

SEQ ID NO: 600816 - DNA, 716 bp, Homo sapiens
  misc_feature (319)..(319): n is a, c, g, or t
gccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatatttntgtttggtttttctgcatgttccatgaaaacagccctttttcaagcccatagtttctgtcatggtttccatctgtcctgagcaagtcattccttctgtatttaacatttcgaacatcttggccatttaaagccccatgttctcttcactgtttgcccacctaacctttaccatcgatttcaaactataatttaaccctaccgcattgaatgttcaaatgaggctcgtcccttctgcaaatactcttactacctacactcactttcctataaaactaccccttatcctttaaaccttacaattctacaatgttactgtcttcgggcctcccgaagcctctccccttcataacccaccctcctgaacccagtttgcctattaaaccttctatctttgtt

SEQ ID NO: 600817 - DNA, 1433 bp, Homo sapiens
  misc_feature (563)..(563): n is a, c, g, or t
  misc_feature (1433)..(1433): n is a, c, g, or t
tctgattatgtcactgactgacatgagtcccgtagtctacaatcaaccatcaaatcattattacccttacgtcacccaacgaatggcgactgctcgataaggaaagggttgcccaaaagtaatagacatggaactcggcaaagatcgtgtaccctcgatctgtgaaccaagacaacatcactcatctagcattcactcatgatattagatggccccgcctgcccaatgtgactcgagtgttgtgatcgggccgcaggtacctcgtaacctgtcgtatgatggctcatcgataatccacttgttgctttaatgtacgagtgcaccatgtcatgagattggtctacctaggagtggattccacgctggtgcttcctatacattgtttgattcgcaagtgtatcattcgaccctttgcgccggatgatcgtatgagctgggcaaatgatctaatcgatgccaaggatcgaagaaagagcctcttagatgtgaaggccatttcattatgagttaaggtgcgaaagaccagttatcacttttaaccaatagagcgcgcgatcaacggnttcacttacatagcataagctccaagatcacctagtcgaatttcataaaattacttttccagaggtctagtgggggccgaatcccgtccgagaaagtccaagataacacgcaaaagccgtacactgtaggctaggttgaacaattgccttaaacgggactttttgaactctagattccagaaaatgctgcatatcgtgaatctaaattaactttccgaaatattggattctcgaatatagagcttggggattcccaaacgtggccaatcgaaagctattcatcccctaacggggtcattggaaacaaggcgggccatatccccttaagtatcggttaagaaaggttacccatttacttctaatcgagacctcaccgggggctattaaactggagacctctccgatactgagtcggaggattccagggaatcgaaattccccagaaattggggttggccacccccgtctttatggtacaagacgcggtccgggaaaaggtgtcaaagcagaaatataagaggagtcccctaacgcgcatgaaaaacccgggagaggcgtttcaggaaaaccggcgagggagtatggttccccgaggggccgcggcgctcacccactacgtcaaactttccaaaattttccatctccccgtggtatgcgaccacggtggcacacgagggtacacctgaggggggacaaacttttacaccaaagacggaccttattccccgcgggaaagagaggaatgtcattcctacacacttactgatattataagccacacaaccccatccacggaaacaccggggtgtggctgtaatcaaacaaagtgggacacacacaaaaaggcggggcgcgcaaacaaatacgccn

SEQ ID NO: 600818 - DNA, 135 bp, Homo sapiens
  misc_feature (35)..(35): n is a, c, g, or t
gaggaggaagaggaagaggaagaggaaagcgaggncggcgaagaagaggatgacatcaccagcgccgagtcggagagcagcgaggagggggagcagggcgacccccagaacgcaacccggcagcagcagctggag

SEQ ID NO: 600819 - DNA, 343 bp, Homo sapiens
acttgtccatattcctgtcggaggatgaacaactatagtttctgacattaagcaagcagagcccgtcattgggtggagatcaagacagtaggtggctagaagttctcgaagttcaattgatgtgattcctactgaccagatatcacagagttggttgtagccaccagttcttctctactgctgcaactgtactggggccatccagtaagggggtgccaatgaaagattttcgttttgcaatggtagctgttatttttgcagccacaccaaagtcagctaattttacatcgccatggtctgtcaataaaatattagcacctttgatatctctatgcattttgcc

SEQ ID NO: 600820 - DNA, 323 bp, Homo sapiens
tctctaaaagcacattatatctcagtacacaatacacgtgtggcgcgtgggggctgcccgtgtccccctgtgtgtgcgcctccccactctctttctgcgtctcgaaaaaccctgtgtgtaaaacaaaactcacgtggtccccccatgtgtgcgcattctcacagctgcgcagtgtatgaccccatgtgaagtccaccagatgcccccctcacaaaataggggccccccctcactcttctgggtccctttcactcacagaaaaagggtgctctcccccttggtcacatataaaagagacctgcgcacttctccccgtgcgtttt

SEQ ID NO: 600821 - DNA, 171 bp, Homo sapiens
cagaggttcccctgtcgttcctggcgtatgtccttttcttaagactcacataataactagactaagtatctatcatatcagacgctactaggatatagagaccgtctgatctatcttgctcgccatcatcctaattctcatacgcccgggttggccgggtatcgagctcga

SEQ ID NO: 600822 - DNA, 402 bp, Homo sapiens
aaaataccccaaaggaaggagggagccctgtttgccttgagataaactgccttggcattttctggctttaatgtagaaataatggtcctatgatgacatattttcaaagaacactttctatttactgtggtgaaaaagttgctaaatgtgttgttccatatgtaactgctgaagtaattgcaccttaataagggaatttctacaaaacaaaaaaaaaaaagtgacccggccgggaattaatataagagttgacccggaatcccgacgggacccgaggcgtacacctttcctataggagtggattaaaccttggggaaccgggccatagtgtacctgtggaaaagggtgccggacaaatcccacaaattacaacccgaaaaataaaggttaagctggggtgcg

SEQ ID NO: 600823 - DNA, 312 bp, Homo sapiens
ggcacgaggagtttcgctctgtcacccagcctggattactggattacagtggtgcgatcctggctcactgcagtttcctcctcctaggttcaagcaattctgccacctcagccttctgagtagctgggattacaggggtgcaccaccacggccagctaatttttgtattttttagtagaaatgggatttcaccatgttgggccaagcttgtcttgaactcctgacctcaagtgatccacccaactgggctcccaaagttctggggttataaacgtgaggcaacctgcctggcccctttgtttctttttttag

SEQ ID NO: 600824 - DNA, 349 bp, Homo sapiens
  misc_feature (274)..(274): n is a, c, g, or t
  misc_feature (318)..(318): n is a, c, g, or t
  misc_feature (326)..(326): n is a, c, g, or t
  misc_feature (344)..(344): n is a, c, g, or t
tttttgttgttgttgtgactgacagagtgagattccgtctcccaggctggagtgcggtggcgccttctcggctcactgcaacctgcggcctcctagattcaagcggttctcctgcttcagccttccgagtagctgggatgacaggcactcaccaatatgcctgggtaatttttgtatttttaagtacatacaggatttcaccgtgttggccaggctggtttcaaactcccggcctcaggtggtctgcctgcctcagcctcccaaggtgttgggnttacaggtgtgagccactgggccctgcctgtactttttatcagncacaaatncagcaacaagctgagggnttcaa

SEQ ID NO: 600825 - DNA, 108 bp, Homo sapiens
  misc_feature (104)..(104): n is a, c, g, or t
gaagctccaggctttggttttcgctgctgctggcggcagcgttcgcaggacgggcgacggccctctggaccagaactcccgtgcccaaacctccttccagcgcnacgg

SEQ ID NO: 600826 - DNA, 115 bp, Homo sapiens
gtggtttcgacagcaagcatatccaacatcatgcattcagttcgtcgtggttgtgcaatgttcatacattcaaggcagcatttgtcagggcagcattcagtcatcagcagcaggt

SEQ ID NO: 600827 - DNA, 141 bp, Homo sapiens
atatagctgctatcttaatcaggatacaaagaattatcatgccatggcagacatcgacgaatgggttattcagagaatttaaacttatgagatcatgagctgcagtatgtggaccaccttctgaaagaggatgtgcgacat

SEQ ID NO: 600828 - DNA, 591 bp, Homo sapiens
tggttggtataaacggtaaaagtgcgtgtgtgtgccctctttacccattcttgtggtgagtatgtgtggtgtgagcatggcatttgtctcagaagaaaaaaaaaacatagttcaggcacaaagtaagcccaccccactaagaaatatgttaaagaatttcaagaaagaatttaaaggagattatggtgtaactgtgaccccaggaaaacttagaacttgtgtgaaatagactggccagcatttgaggtaggttagccatcagaaggaagcctggatgggtccctagtttcaaagatatggcacaaggtaacctgtaagccaaggcacccagaccagtttcagtacacagacagttacacctggttttagacctcctccccccgccccccacagtagttaaaagaacagcagcataagtggctggcagaggcaagaaaagaccagcagagagaaaaagaggccatctataccaattctaagttaatttagactaaacaaggtcttatgaatagcaaaggataattgaagtcccaaacttacaaggttttcaacaaaaagtgaagttgctaaaagtcaacagcgtagcatgtt

SEQ ID NO: 600829 - DNA, 458 bp, Homo sapiens
aacgagtgatgcggatgtagttcttaagggaatagtccatgtttctgctgctatctgacagatcaatcatcgctggggggaaaatacatcattccaggcacagaacatccgaaggcccgagatgatgaagagcaaatatcccccctggggcctcataggtgtccagcttgctgaagggagggcagagaggagagcagactgccatgagtcccgagtctttcaactcaagacttggggttggggagctgagcacatgtctcctttttacatttcgctaccgacagacgtgagcgttcactgcagactggactgattatgaagcttgctgaagcactagagcaagcggaatgtgcctaccttgtggaacccattgctgtgaatggccagggctcagcaccagcgctcagcagatgctcaatgcgttttgctgagtttgctgagggaagactggtttttgt

SEQ ID NO: 600830 - DNA, 380 bp, Homo sapiens
  misc_feature (280)..(280): n is a, c, g, or t
ttttttcactaaggataataactctccagagattaatccaggttgttgcccttatccctagttttttttttattaccaattagtattccatggtgtgatggaccacagtttaacctttcaccctttgaaggacatctgtgtagcttccagttttttattactataaataaagttgctgtaaacattcatgcactggttttatgggaacatggtttttcatgtctttgggataaatgctcaggaatgcaaattgctcggttgtatgctagttgcatatttngcaggtttagcttgcaacttgcagcgatccctaaagcattcattattatcattcttattatatacttttgaggggaaaagaccctagggtaccgagctcg

SEQ ID NO: 600831 - DNA, 205 bp, Homo sapiens
  misc_feature (37)..(37): n is a, c, g, or t
  misc_feature (39)..(39): n is a, c, g, or t
  misc_feature (44)..(44): n is a, c, g, or t
  misc_feature (115)..(115): n is a, c, g, or t
  misc_feature (120)..(120): n is a, c, g, or t
  misc_feature (123)..(123): n is a, c, g, or t
  misc_feature (126)..(128): n is a, c, g, or t
  misc_feature (133)..(134): n is a, c, g, or t
  misc_feature (144)..(144): n is a, c, g, or t
  misc_feature (146)..(146): n is a, c, g, or t
  misc_feature (158)..(161): n is a, c, g, or t
  misc_feature (165)..(165): n is a, c, g, or t
  misc_feature (171)..(173): n is a, c, g, or t
  misc_feature (175)..(176): n is a, c, g, or t
  misc_feature (178)..(178): n is a, c, g, or t
  misc_feature (191)..(194): n is a, c, g, or t
  misc_feature (200)..(201): n is a, c, g, or t
  misc_feature (203)..(203): n is a, c, g, or t
cctagaggatctccgtactgtggtgtaccgtgggagncngtgangctcagcagtaatgaaacctgactagtaaacataaagattcaggttcaatctctggcctcgctcagcgggntaagnatntgnnnttgcnntgagctgtgntntaggtcacagannnngctnggatcnnncnntnctgtggctgtggnnnngcagcnncnac

SEQ ID NO: 600832 - DNA, 324 bp, Homo sapiens
  misc_feature (20)..(20): n is a, c, g, or t
ctcacttctacttctcttgnttctatgagtctattaacagatgaatggatatagaaaatacggtgtgcgtatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgagcgtggtgctcaccttccatgctcagatgaaggaccacttcacataagctttgcctgattcggcggttctgggctacgacacatatttgcctgaagctttactg

SEQ ID NO: 600833 - DNA, 297 bp, Homo sapiens
ggtgttcctttgtctggttaggtagcattaccatcaccctcaactcaaaaccttctatggagggaacatatcttattttattcatgagcctctgtgtgctgtgttactgtatacttcccttgaccagtagcaatgctgattatgccggctggctactttttgagctgatccacgacctgtaaacttcatggttcgtcttttctgtggtgatatgatgatgtctgacctggatctactaggttgtcctctatagacattatccttggctggatagcctaggccttctcaataccccga

SEQ ID NO: 600834 - DNA, 504 bp, Homo sapiens
gcttactccttagttttctgccttaatttctaagtcataggctactttcaggctaagagttttcctccagccatggttttagtctcattctgtaagtctggttttagttttattcatttaaaattaatctttaataacttttttgactcattggtgacagagtaattccctctcttcccaccacaccaccctctgtccccaagattctggaagtttgttcttccccttttgtgatcattgttacttaaaactttgagtttttcaaattagaagtttcttctataaatgtatatagagcttggctgggcgtggtggctcacgcctgtaatccacagcgtcaggcgaggctgacgcgcggagtggactcgccgagggcaaggagcaccgagacgcatacctggcgtaacatgcgtgaaaacgcggtctctaaccaaaaaatacacaaacactacgagccgggcgagagtggcaggcgccggaggaccccggctgccgggaggctga

SEQ ID NO: 600835 - DNA, 246 bp, Homo sapiens
tctctcaccagcaaaaagataacaactcactgaatgtctacagtaatcgtatatctatttagcaatagggtatatttaaattaaggtatgtacatttaaaaaaaaaacgtaatgctggtcaggcacagtggctcatgcctgtaatcccagcactgtgggaggctgaggtgggcgatcacttgagctcaggagtttgagaccagcctggcaacatggcaaaatcccatctctactaaaaatacgaaa

SEQ ID NO: 600836 - DNA, 1077 bp, Homo sapiens
gcgctgacgggcacgctgactggacggctggcgtgacagtgcgacagcgaactgcggcagtgaccagagtgagctgagagcagcaatgaaccacacccatgacagcaatgtcatgcgtgacagtggaaacctcagagtggggtagactgatgtcagacaaaacatgaactctggtgtgccctagcaaaatgtgcatgcaaccaaatgagcatggctgacctctcgtgagctccttgcacagtgcaagggcacccaatggacagcaccactgcacctgggccagcacaaaccaccccagtttttgtcacagtgccgttctcttgcacactgtgccacaccattaacagcacagtgcaccttgttatcacagcttgtgccaccccactgggccactcttacctttcagcagttacctacacggcacacatccgcatgtgactggtgaaaaattgggaacgcggccaacacattggatccaatccccaagacctttttgcaccgctttatgtacactttaccacccaattgtggaagcttgcaaaccctgtgaaactggtgaatgtgctgcgttgacaccaacagggggagccatttgtggacacgggttatcaacaccatataatgaggattgcaacgtagaactttggagtggcctgtgcatgccaaggggtttgcgaagtttgcaccccacaaaaagggcttttgggacccaaagcaacaagttcaccaggttgagcaaggcaggagcattcccaaataaacaattaagtggagcacaggaaaacagcaggccccgcggctgcatcatcttggtatgtggcccaccaattggcctattaaccgaccctctgtcgtaaaccacttgggtgcggaatcatactacagtgatgagggagcccccataagattgcattgcaacgcaaacaggagttgggccccaagctggacaggacacctttgtacccgttccccccaagacgaacagtggtgggaacaagggtgacccacaagagttccatcatcctatactcattcacgccacttggttggaacacagttggcgacaaagacgagata

SEQ ID NO: 600837 - DNA, 500 bp, Homo sapiens
gaaaaggctgtggctgcagctgctgcagctgttgtgacccctgcagccattgcagtgccacaaccactggctcttcctgtgctaatgtggttgtggcagctgaatgtggggtcacctttacgcagggaagagaccagttgggagggggccaagaagaccgaaaaaaggggagactggaagcgtgaagggctgaaggattaaccttgtgatgatttagagacagaaggccatctggggttggaaaaaagggcctttgaggattcacaattggacggaagggcccacaaggtttgtccacaaagaaggtcatatagggggggaaaattgttgtggtacgtgactttgtacaatcttcaaatgtggggtttgtgtacaggcaggtaccaattttccaacaattgtggctacaaactggttgtcgaggcttttagaacatataaacattgtggttgtactaacatgtgctaaggtcgaaagtttcacattttaaaaaacggggc

SEQ ID NO: 600838 - DNA, 604 bp, Homo sapiens
  misc_feature (37)..(37): n is a, c, g, or t
  misc_feature (74)..(74): n is a, c, g, or t
  misc_feature (84)..(84): n is a, c, g, or t
  misc_feature (87)..(87): n is a, c, g, or t
  misc_feature (144)..(144): n is a, c, g, or t
  misc_feature (154)..(154): n is a, c, g, or t
  misc_feature (440)..(440): n is a, c, g, or t
  misc_feature (447)..(447): n is a, c, g, or t
  misc_feature (462)..(462): n is a, c, g, or t
  misc_feature (464)..(464): n is a, c, g, or t
  misc_feature (534)..(534): n is a, c, g, or t
  misc_feature (565)..(565): n is a, c, g, or t
gctcaggcgatcctccgacctcagcctcccgagtagntgggactacccgtgcatgacaccctatctggccttgntttttgttgntgntgttgttctttcttttttcacgtggtttcgcacttgtcacccaggctggagtgcggnggtgtgttgncggctcactgcaacctgtctctcgggttggagtgattctcgtgtctcagtcttccgggtggctgggattgcgggcgtgtgccaccacgcctggctgatttttgtatttttagtagggacggggcttcgctatgttggtcaggctggtctcgatttcctgacctcgggtgatctgccacctcggcctcccaaggtgctgatattgcaggcgtgagccaccacgcccggcccgcatccggctttaagatttgttttcacttgcccgtgggaggatgtacttatctcanatgctanagccgggagaccctncnccccaccacccccatctcctgcaggagctctgatcgcagattggagtgtctgaactctgcatctatgganggtgcttctgtaagcccggccgcaactctgnagtggcatagtagtggcagctttgcctttctgggtgccc

SEQ ID NO: 600839 - DNA, 650 bp, Homo sapiens
tctaccacgcatggcctttgttcactgaactacagaattgccaagaatatttttaaaacaaacacattcaacattacaaagggcaagagaacaggaaaaaagaaaatccctactcagctttgaagtcatgagatggccataaaaatggaagagtacaagaaaagggcctttgaaaattaaatatatatgattgaagtgaaaaaataaaacacttaactgtacttttagaaaattaaacaatgaggcaaaaacctgagaacaaaggaatgtaagaaattcagaggactggtaaaatggccaaaatattagaagtattattattctaaaataattccagaaatgcaagaaataaaactgtcaaataattgaaataaaacatctaaaaatgaagggctcaagcttgcataaagaaagccaataccccataccaagtgatcaggaaaattggtaaaaataaacttacccaaaggcacatggacatgatatttcagaacaataatgaaaaagagaagacgctattagtttccagaaagagagagacaaacataacaaaataaagaaagaaatgtggaaagagtcagaatcagtaacactttacagcaagactggaaaatagaccacaatggagcaatgtcttcaaaatgcagaaa

SEQ ID NO: 600840 - DNA, 547 bp, Homo sapiens
  misc_feature (424)..(424): n is a, c, g, or t
ggatccaattttgcgttccttgattgcatacactctttatctctagcttcttagcagagtaagcctggcatgttgaaaaagtaaaataacacacagcctatgatcaggctccacttgtatatatttagtggaagttacttgtcacatccagatcttacaaaagatcattagaagaacagtctcgtaatagagcaaatggacaggcgggttcatcagaaccaggaaaaagaacggcaattatccaatacagccctctagctgatatataaatttgtcctacgatatttcaaaacgctcatttggtctctccttgaatacctccagagatggagagctccctacttactgtttgagtatatttaactgctggtgagctctgcttattggagactttttccatacattaaactaagctgaaatctgnctccctataactccttataacccttgtcatcccaaagctgcgagaggcgccacagaataagttctctctctattccacttgggcacattttaagtgtctcaagacagctaccaggtctcatct

SEQ ID NO: 600841 - DNA, 267 bp, Homo sapiens
tcgaccattttagtctctccccagagcactatacagaggatatattggcccagagctgctgggggcaaagacagggtgcagatcctatcatacccactctaagacctttccacttctccttgtgccaggagactccctggggccactgcttgggaggcttctgccccttagccaaagagcagccctggatgtgactgcttgggaaccttctcccagctaccgccctgatgaactgcctggcagcctcccgagactgcctcgccaaat

SEQ ID NO: 600842 - DNA, 901 bp, Homo sapiens
  misc_feature (271)..(271): n is a, c, g, or t
acatgcacttgcgacgcacccgcgaggttgcggactgagtctgagacagtgctagcagagtgaacgctctggtgcctattcatgcactaccactagcgtgcaacgcacttggacagacgtgtcacgctcgtgcgccggaagaacccactcgggtctgcgggaccccacgtgctaacaggcgcgcatgaaatgaggctagcgaagcacacgcgaactcgcacctcggctccatataaagggcaagtgtgctatagactatacggcgttctanaagaccgcacgcgatggtaaatactcaggttagatatggagtaactaacatcagacaggatttaccaaaagccacaaccctacagtcgacgccagaaataacaaaaccacaagtactacacaactactcgactaccctgacaggacaccagaacgaatcacagacaagcaaaacaaacaccataaaaaagaaacaacatagggcagagacacgcaccacaaaacaaaaacacacacagaaacacaaacaaaagcagaaaggcgagaaacacaaaacataaaaaagaaacagaaagaggagacacacaagacatggaccaaaggcatcacagacagacactatcaacatcgaaccgcggcaggccgccatagaacagaagaagacggacacacaaaaaacaaggagaaagcagatcgccgccaccgcaaagcaacaatcgagatgagaagagaaacaaccaataaagagccggcacacacaacatataactgaagagacaacagacacgcacaagccagagatgaggagcaagacagagcgagcaaaagacacaccaacaagaatatgaatcaattctatcaaggagaacacacaaacaaagaagacaggaagaagaatataaaacgaaaa

SEQ ID NO: 600843 - DNA, 498 bp, Homo sapiens
  misc_feature (254)..(254): n is a, c, g, or t
  misc_feature (286)..(286): n is a, c, g, or t
ccgaaggccacgccctcgaggggtacaatgcaagggagaaaccgccctctagtggcgtaaagaaagagaaggacagacgaggcgtctagacagaccgtgagagaagaagtgtttgcctccctcagagagccgcgttcagaaacgaaagcacaaccgtgacaaaagccaaagcacagagacccagagaaagccaaatgggacaaaagcaagcaaggtctggacagcttggacacaggaaaagggagcaggagacnctgtggcccaaggtaaaagagaagggttctanacaacctaaagactccagaagggaaagtcaaaactaattcggatagaacagctcaaccttgggggggctttcccgcttccctttaagaaggttggacggagacagatatggaggatgaattcgagcagccaaccatgtctttgaatcctacctcagctatgaccagccccggaagaaaccgacaaacgattgtgaaaacttcagccacggca

SEQ ID NO: 600844 - DNA, 138 bp, Homo sapiens
cagtaactattaatgtagttaaggttttgtgattaaagatagaaaataaactgaggacatcaatggacaaagttctgggtggagtcaagattcttattttttccctccaactttgttttttctaatttaaaaaaataa

SEQ ID NO: 600845 - DNA, 497 bp, Homo sapiens
atggccagacagaccagacatatgagtggtacggtacctcatctctgatagcataacagagatgtaagagcgtttcccatgcctgtatggaatggcaatccgcaggaaatgtctactacagtatactacccatatgtatgttgctcaggccactgtgtggccccagcaactgttggtttgcatcgggactaggggatagtacgtcgttgttagccaagaaaaatagtaacactgctgttcctacagtgagctagtgggagtggggtataggggacatatgcttatgcccaacagtaccatcagaaatcccactgccttaagacagtctcacgggaacccagtcccagacttgcagaaatgagtagacctgtggcatcttgactttggatgtatctgcatttgttgacagtcactcagcaatgtagacatgcatttactccacttaggtcaaatgttacagggaagttcatcagctatgatttatacaaaaactgatg

SEQ ID NO: 600846 - DNA, 122 bp, Homo sapiens
ttattcgtgttgcacccccaacgtcttgattatagtagcttccataacaacttttgaaatcaggtaagtgtgagctcttccaactttcttctctttgggcgattagttaccggcgtgttgcc

SEQ ID NO: 600847 - DNA, 130 bp, Homo sapiens
ttatgtctgaccaccatctgcaagcagaaatgaagcctcaccagaaaacaacatgagggcaccttgatcttagacttctaagcctccagaactgtgagaaaatacatttcttggccgggcactggtgact

SEQ ID NO: 600848 - DNA, 537 bp, Homo sapiens
gggtgcagtgcagtggcatgagctcagctcacttttttttttttattaaattactgagctttatttcacatgcatatttttggtctccctaccatttccatatctaaccaccgctactactatgttcctattataacattccatacatacctaaaaccaaacgaagggcagagttccatctttaaaaactaaacaggcatttgggacaacacgttctgggcaatggaacctagacaacagttatcaaacagggtagggaaatttctcactctgctttataaaaaagacagccagatttcaccgtgttacagaattgagatgaaaattttttaataaatggtttaaactatttccttaaagagacttcctctactgccagagatcttgattagcctccgggtcagtcatctggaaccaattcttcacttaactgatgaccttggctcccgctgtgggaatagaaccaccttttcctatacttgcttgcatttcggctttcctgtcttctacagaactaggtcctcctggtgtccccgg

SEQ ID NO: 600849 - DNA, 2036 bp, Homo sapiens
tttttttttggcattaaaatcagtttattgggaaaccagtcacttagagacattacattgtaaagagaatgtagagagaggtctgaacattttataagatactgtacaaaaatactatgtttctctgaatcctataactttttagcagtgcttctttttaaacagttctgaccttaaatattgttttcagaaacagaacaaaaatgtgtttgtcctccatttttattttcctttctaacagtttgaatgcgttcagtgaattccagattggggcgttaagttaaattctgtactggtgccaaatggctttcagaatagtatttgaagaataagattttgaaaagaataaatttttccttgtattataattttagtatgtgcagctacatggtgatacgaaagcatcagtcagtggacaggaaataaacagaataccttcttccttgcgatttatgtggacagacataatcctaatttctcaggcaagtaaattgatattagatttgtctcagtgataccaagatgataatttctgggaggaaattcaaataaaagggagaaaaataagttttccaaaataaggtttgcagagccttaaagaaggacaagagggccctaaaactccttgaaccaccttcctcacatagtatcagttggacaaagttttcagttgccaaaacaaaagcacaatttctcatcttccaaaactaccttgaaagttgatgttattaagcttgttctgcaggagagcaaaatatctcttagggaaaaaaaatggaaaacttagtcaagccagtgaccaactctggcatcatacaggtcaataatccaatgaacactagtttgaacagagtcagtgttttttgggaaatttaaactgaattcagttaaaacatttgtgcacagagactggcaaaaaagcagctatctattgaaccaggggcactttggaagctgcaagtgtcattacattttgagactaagaagtcccaggggtgtgtgtgtatgtgcccatattcagggttggagaggatggaagaacatgtctaacccatcaaaattatttgttaaaaagtgggtttttggtcaagaacccatttggaaaaccttccaactcagagcatattctatgaccttcatgatgagtactgggaaaatcagacttaaaattccaacaactttgaataatttacaaaaacagtcacaaaaacaccagaatatcaagtttgaagggaaaattagtctcctgtccttcaaaacaaggacaagagctatttcctatctttctttcagcatcaacaggctttgtaggaatggaaaagtacatttaaagggttgtcctgagaaggccaagttcccttaacctttctatttcttgttagaggaggtacagtgtggctgaggcggagagcaaccacactttgcaactctccaggcctggcactctgaagggcaaagaaatgccagagaatatgggggaagcccagacctccacattcccttaaggaattctggtggtggcagcaccagaaacaaggtagtcgagagaaggataaattccaaatatactagaaacagaaggtaaccattaaatcttgttggcagataaaagtctttttttgagtatgtgaatgtgttcttacagggaaaatgtgttttcagggtgaacagttcctttatatgaaggtagcattgtgtcaacaagaaaaacgtgtttgaagcagtctctttactagcattgaaggatttatactaacctaaccacatgccttgacccagttcctttggtaaccaatggcacgtcatagcagataccctgtggccatagagctcagtaaacactgcctgttgtacctcaggggctaaagcccagggcctggcttcatagtctgcacagggtcttacttatcatagagcctaacgtagggttttgttataattccctcaaactggatcatgcctctttttattttggtttcacacataaaattaagcaagaagtcaaaacatacttctttcctggtgccgagcttgga

SEQ ID NO: 600850 - DNA, 389 bp, Homo sapiens
  misc_feature (6)..(6): n is a, c, g, or t
  misc_feature (49)..(49): n is a, c, g, or t
  misc_feature (83)..(83): n is a, c, g, or t
  misc_feature (106)..(106): n is a, c, g, or t
  misc_feature (186)..(186): n is a, c, g, or t
  misc_feature (238)..(238): n is a, c, g, or t
  misc_feature (273)..(273): n is a, c, g, or t
  misc_feature (284)..(284): n is a, c, g, or t
  misc_feature (298)..(298): n is a, c, g, or t
  misc_feature (344)..(344): n is a, c, g, or t
ctgccnaaggataaaaatctcaacaacttagaaggcatgtgtagcttgnatgctcaatagctgcctcatctcttcctgtcccnacaacagtacactaaatcacagnttgcctctctgaagctacacctcctggtgaccacctgctaccctcctgaatactcttccctctctctgctcttaagtctncttgggacttggcaagcatcagctcacccctagatggtgtccctgagcctgnccaaagtgagagctaggggtgccttgctctggctncatgttgtcgngcttcctagtatanggtaacactgttacctctcacgggttaatcctgttcctagacctgnccatagaaacactccataagttctgttccaaaactgaatgaagtt

SEQ ID NO: 600851 - DNA, 1117 bp, Homo sapiens
atgactaatgatgctattctttgaggacaatctcccagtgtgaggatacaacagtcctcatacaataaaatcctacgatatccatgcgtggactgtgcctccccatgggatgatctcatgcggagggcagctagtgaccaagatgtcatcatgggagaggatgcacaacagcttcttgacagcaaggcctccgtgctccgtggatcacaactactgcctggacgcctgaaagacaggcagggcacgacacgcctaggtacttcagccaattggagtggggaggccctcaatgggcctaccaggacaggtacctataaggcatagacacatactcctgactgacgtgacaattcaagcggtcagccagccttgaggtcatgtagcctctgaacagtggatcttgggcagcacacaccacccatagatcgtgagagtgatctgaagaggccaagcccaaagctgtaaagtaaacttaaatcgacttcgatgtgcgggctagcgtcatgatgtgaaggtgcctgggaactgcctatatacaagtagatgtcctccactgtctcatggtagcacatgcctgtgaatgtgtcctctcagtacatgagtgccgagttggccttgtgctaggtacaccagtaatcacactgcagcctccgtctaactcccttccttacgggcctgatctatgagtgagtgctttaatccaggacccagaaaatccttagtttgatggtaagaggacgccgctgagtcaagacacctgttttcttgacaatgttcgctctgccaaaaccactaggggaccaacgtaagctgtctatcctagaacctcccaagagtcgattcacatttgtaggtggacggcgccggagaaggggcccaggcgggacggggcgggaataaccaggccagcggggcgcaacgctaaggggcggggaacacatgggaaacgcctccagagtaaaagagacagcagctgggaggaggctggggaccttcacacaaggagcaagcccgggaaaatggagtgcgcgacacgaagtacccagcaacaacccgtaccgacgaaacccgcacacacataataacggccgcacggacactacacaacacaccgccg

SEQ ID NO: 600852 - DNA, 321 bp, Homo sapiens
aacagcaattctgcctctacattctaggttgtgtgggatgttctctgtttgatcagaccaatgtcagatgcactgtgctgctacagagaatctgcaaggtctatggcccattgtctctgccacctccgagagacataccaggaagtcgcagagcaggggtccagcacctcaggagcagcagcagtcgcccgagttgccgcttcatggtctcctggctctcttcaaagttcccttgcacgagctccatgaagccacagaaacaccagaaagcatccacctcgttctgaatgacgtggaggatcgcggagagaccactttcta

SEQ ID NO: 600853 - DNA, 530 bp, Homo sapiens
tggacgacagagtcttgctctgtgcccaggctggagtgcagtggcgcgactggagctcactgcaacctccacttcccgggttcaagtgattgtcccacctcagcctcctgaatagctgggattataggtgcatgctaccatgcctggctactttttgtatttttagcagagacagggtttcaccatgtgggccaggtggtctcgaactcctgacctcaagtgatccgtctggctcagcctcccaaagatgctgggattacaggtgtgagccactgcacctggcctatataggctttttttcttaaacctatttagtacatgttttcccaagtttatcttctgacttttaaaaatttgttaccccaagtttatcatttctatattatattttcagtggaacacactggggctaacttacgcagtttcaactatggaagactgaagtttacaacacaattaacctgtcataggtacttttaaacatacacgttataacacgtaggctcaaacacatattagagacacgagtc

SEQ ID NO: 600854 - DNA, 358 bp, Homo sapiens
  misc_feature (23)..(23): n is a, c, g, or t
  misc_feature (139)..(139): n is a, c, g, or t
  misc_feature (147)..(147): n is a, c, g, or t
  misc_feature (162)..(162): n is a, c, g, or t
  misc_feature (168)..(168): n is a, c, g, or t
  misc_feature (192)..(192): n is a, c, g, or t
  misc_feature (211)..(211): n is a, c, g, or t
  misc_feature (232)..(232): n is a, c, g, or t
  misc_feature (236)..(236): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (254)..(254): n is a, c, g, or t
  misc_feature (256)..(256): n is a, c, g, or t
  misc_feature (270)..(270): n is a, c, g, or t
  misc_feature (284)..(284): n is a, c, g, or t
  misc_feature (288)..(289): n is a, c, g, or t
  misc_feature (296)..(296): n is a, c, g, or t
  misc_feature (358)..(358): n is a, c, g, or t
ccaaactataaacctttaaggcngtttgagaaagctgtagagctgtggcacgaagtaatccttgtaatgcccgtcaatgaatccttttccactgttgtgcacaaaccagcaggtaacgtccgttccaaacactagatcngttctgtngtctttctgtaagcncctggngatgatcagcttctgccccttcanttccatgctggcctctggnttctcagggtcctttcctggnctcncaatgaagangngnancntnggttcctgcatganctggcctattagtncgtnngctttangtgagaacttgtttgtagggggtatgtagattcccagaaagtcaacattgacgggatgtttn

SEQ ID NO: 600855 - DNA, 344 bp, Homo sapiens
  misc_feature (32)..(32): n is a, c, g, or t
  misc_feature (50)..(50): n is a, c, g, or t
  misc_feature (232)..(232): n is a, c, g, or t
  misc_feature (297)..(297): n is a, c, g, or t
  misc_feature (332)..(332): n is a, c, g, or t
agctacaagtaagggggagtcacccagtggancaggaacaaccattttangttttacttaagtgagaaataaatccctagtgtgttaactttctggcatgtatttgttacaggagccaatttgaccttaattaattcacttaagaggttaagtagtttatctaaagacacacagcttataactggggacagcatataccagatctccaaagtcagtcctgtcaatcattaangcttattggcagagaaaaccaaagtggttcaggtgtagccacctgccaagttatgcagaatgggnaacactagaaagggaggaggctgaaaatacctganctgtattgtttt

SEQ ID NO: 600856 - DNA, 1481 bp, Homo sapiens
  misc_feature (1172)..(1172): n is a, c, g, or t
ctccgggggttttgttgtactgcctccaccgccccccccttgtgggtggccctcttgtgtggaactgttggtgaagtggggtaggatgtagtgggtctgccccccgcatgatggggcgaattcgcccgctgttggtgggcgcgtttggggggcgccccccgccccgttcgcgcctgtgtggttttgcgccccctgtcttgtccgtcggcttagtgtgtaactcggtgctctactctctccctcgttgctccctttggttgtaggcctcccacctcttttttatgctccgcctaatggggcggtacctacctgttacgtcctacaaccgcgtgggttgcttcccccagcgaaggccagactggttgctgcgccccccctcttggggacttctcctaccctgttggttgtggcctctccctccttcctctctctcatcggtccctctttctttctggggtgagccacgcggacaccactttatttttattggggcgatgttaagtatgttgtccccccccgcacaggcctcggagggccccgttgtgtgcgctcacttgccgccgcgcccgccgtcgttgttgttgctcccccacagccaccttggaagagaggtccacaccttttcttctcacggggatgattctcgtgaagaggcggccctcttggcggccccccactgcccgcgcccacaacaggtattaaaccaccaggggttaatacccttccacagaggcccccccccgatcttgtgcgcctcgcacccacgccttataacagagaggggcgcccccagaagactcgtgttcgaaaaaaccttttgacgacttcgtgggttgtaaggagaccccccaccatgtccgcgggttccccgcggttcccccctctctatgggtgccccctgttctctgtttaggagacgcccttccgggggcccacacgttctgcgctctacagtgccccgctggcacgctgtgtcccacagaaccgcccgcttgcctttcttcctggcgcacacttgtgacacacagagatgtctctttgtgtttgttgtcttgaagggttttttagagagatatataatatatgttgtgttatacctgttgtgtggagagagagagaatgtggttgtgtgttttgtggccacgggggcgctccgcccacagcggctctgngggacacacagagagggtgtgtgcacaaccactcttctgtggagagcttgggggagactctcacagggacgcccggtgtgctctgcacaggagagtgttgtcctctgcccactagccccacagttccggcccccatcttcttccatcccttttgtgataagatttcttattcttgttccagatgtttataagaattttgtttttgtttggcaccatttttttctgaatcttttatttattattttttttatatttattgttagaaaatgacttatttttgctttggaataaagttgccagatgattcca

SEQ ID NO: 600857 - DNA, 384 bp, Homo sapiens
atatcgtcggacccgtcagacgctgaactatgtgtattgaacagaccaaagacatgctactattttctagtgttgagaaaagtttcaaagtgctacctagaagcaatcattaaaaccaacgtacctccataaaatgcattttttatcaaatgctttataaataaatagtgagttaaaattgagaaggagtgactatttttattgcatgtcacctggtcaggtatttcctgcaagaacagggactagatccgtccttccaatccttgtaaagctaggcatgaaaagaaggtggtcctatttttaaagtctttatggatttttacttgaatctcttttaaaggactagtgtgtgtgtgtgtgtgtgtgtgtgtgtgtgtgtgtgtg

SEQ ID NO: 600858 - DNA, 146 bp, Homo sapiens
ccacgaggacgccaacagaaccatcagtccatcaacaagcaacaatatcccgcgagggcaaggttagggtcagccgggagctgcctggccacactgggtacctgtcgtgttgccgcttcctggatgacaaccaaatcatcaccagc

SEQ ID NO: 600859 - DNA, 922 bp, Homo sapiens
ttcagttgcgttgtgatgtggtatctcttttaccgccgttgtgcgggttttcccctgaagactttgtcaagacccctgttatccgttgttcagctcaaaccccgggggtgccccccctatggagatggaccggtgtgttcccaccccggtgtttgtcaccctggggtgttgagggttcttatggcccccttccccgggaacctacccttgggtttatcccattcgcgctctcaagggcccctaatcaaggtcggagagtggcacgccgacatctcttcccgtgctatagcccctcccggcgtgtggtaccttgtcttttcttaccgcgcgtaataaaagggtattacctgcggcaccgagttaaaaaggcagtcacaaagagtttcttggtagaacaagggttactccctcctatcgtccttgtcatcccgccccggggaggtgtcccccccgtttccgggcgccctcaagaaatcgggtgaggattacccctctctgtctcccagggggtgactatctccctcgcgggcccccacaggtgggtaataaatagtccacgggcacccttctgttgtccctgcgccaggtccccccttgacccccctgagatagactcccttttagacaccgcttgggggccagcaaaaaagcgtgctcctcttgctgttccttcgagagtgagcagtgcatcatggtgcagtgattttcaaaggaaagaactgaaaccctggatattctccttccaatgggcgcagcctccagaaatgtctagcacaccccacgtaggatcagggtaaaaatctactcacttcctatgggcgcaccagtttatagccaaaaagtttatgtggcgcgcccccggtgtgtgcaaattttttggccgcgtccgggggtaaacattttcccgggcgtcaacataaca

SEQ ID NO: 600860 - DNA, 390 bp, Homo sapiens
agtaaacaaaagaaattctgtgttcttagagaatttgtatctgagtttgggaagcagtcaatatataaaatgttaaatatgtctggtggtgggaagtgctttgaagaaaaataaagtaagacaatagataagagtaataagggcacatggccattttgtacaaagtgataagaaaagctctagtcaggtctgtctgataagggacatttgagcatatgtgtccatgaagggagcaatgatccaagaggtttttgggaaaaaaatgtaccaggcagagggagcagcaagtgcaaataccctgaggccgccggttatttatttatatttatttattttgtaagacagagtctcactccagcctgggcaacaagagcaaaactccatctcaaa

SEQ ID NO: 600861 - DNA, 424 bp, Homo sapiens
tgcttcaacgcggacgaaccgtggaaacaggcttagtcaatacgtgcttcaacgcggacgaaccatggaaacaggcttagtcaatacctgcttcaacgcggacgaaccgtggaaacaggcacggtcaatacgtgcttcaacgaggacgaaccatggaaacaggagtggtcaatacgtgcttcaatgcggatgaaccatggaaacaggcgtggtcaatacgtgcttcagtgcggacgaaccatggaaacaggcgtgttcaatacgtgcttcagtgcggacgaaccatggaaacaggcgtggtcaatacgtgcttcagtgcggacgaaccatggaaacaggcacggtcttcaacacagatgaaccgtggaaacaggcttagtcaatacctgcttcaacgcggacggtcgacgcggccgcgaattta

SEQ ID NO: 600862 - DNA, 871 bp, Homo sapiens
  misc_feature (310)..(310): n is a, c, g, or t
  misc_feature (531)..(531): n is a, c, g, or t
taccccggccaatttaggaaggtactgggacgcaagcaggcatctgcccgaataaatccactaaaagtctgatttccttaacatgtccgtatgactcgcatcaggagatattcaatcacctgacactcacgcatacgtctaagtgagagacacatcgagaactcgagcacgcaaagatgatatatcatgtcatctcgccgtttagttgaacaattctgtactaggagggtgcttctgacttctttacaccatactcgtcatcacaaggcgctgcatggaggtaacattttctgaaagctgcattccactnttcagctctataattccagaacagaggagtccatattgggccttcacacaactttagtatgatagacgctgctagagggtgtcgcaaggaaacgttcatctgatattatttaggactcaaactctatgcagtacaactaatacatggctctacagtccagcaagatgcttatactatatttcatgtatagaccaaatcactaataggattcattattgggnctcttcgtaagaccggagagagcatgaagaagtgggccatcaatatgttagaatgttggttttctgcacatatattacctaataatgctctgcaagtcctgatggcatgaaggggtatgtatctcttatagggatctgagaatgagataccagttaatcttggcatatataatgtaaggtattgggaataaaccattacaaggaaagagtgaatcaaagttacgtggcttgaattttgaataatacaacgatgccatcgcttacgctttacttactagtaaatgtatgtaacattgttgggactagaaaataaacttgaaacggattacattagcaaaaa

SEQ ID NO: 600863 - DNA, 433 bp, Homo sapiens
  misc_feature (35)..(35): n is a, c, g, or t
ttcctctttcggggcggggaagaaacatggggggntgggggccttggcctcctacccccctcctttgggtgtgacccgtggcacccccagcccaaactggcggaaaaggaaaggaacgggcagcctgggcctgggtggaaatcctgccctggaggaagttgtggggagatcccttgggacccccaactttttgccctcccctttgggcccagcctggaaacctacagacaagggggggttcccccatgggctcccccgtgtttatgacgcaaagatccccacccatgggccttagggtcctttttaacagactcaaaccccatgggccccgaatattttttttgtccagaaggggtcctttccccatatagggctccaggggctgttttttttgttttcgctgttcaataaacattgggtgggcccctcccca

SEQ ID NO: 600864 - DNA, 480 bp, Homo sapiens
aaaacattggttcatgacgcacagcagcacacagattttgtccgtgccatacagcgtaaaaatgaagtggttaattttttacgtaataagaattttcataatcttgcggatatgcccaatatcgacgtgatcgacggccaggcggagtttatcaataatcatagcctgcgtgttcatcggcctgagggaaatctggaaattcatggcgagaaaatttttattaataccggtgcacaaaccgtggttccgccaattcctggaattaccaccacgccaggagtatatgacagcaccggattacttaatctaaaagaattgcctgggcatttaggtattttgggcggcggatatattggcgttgagttcgcctctatgttcgctaattttggcagcaaggtaaccattttagaagcagcttcgctgtttttgcctcgggaagatcgggatattgctgataatatcgcgacgattttacgcgat

SEQ ID NO: 600865 - DNA, 619 bp, Homo sapiens
ttggcacagtgacagactcataagaggaaccgagacataaacctgcctaggcccttgcgatatgacgatcatatgatcacgctcaccacggtctcaaggaagcctacatgtggaccagccatacaaaggggaaggaaaggaactgaattgatacctatccctgcttaagccctgaagtgaaggaaatgtgactaatgatctgggaagaactggatcaccgtgcgattttgacccttattgtcttgtcatctaacgaggatcgttatcaagtggaccacgcataaaggctgatggtaattgcacacgctgcttatagatgctcctttatagtctggttgtgactgtcctcatacgcatcacaagacgctctgctttggcatatacttgactacagggagatagatccgtgatattgctataccgcctcgttaacgaatataaaacccatagcgatacacattctcactgccgccgtttcttctcctacacgtatattctctgcactctcgttatttggtataccccgcggttcgctgtgttgacttaattgtctactgatgtaatactctagcccagattcatatatcgctatcgaagcccgttggcttcccgttcctta

SEQ ID NO: 600866 - DNA, 149 bp, Homo sapiens
gaagaaaaaaataataaaataatatcatgtatgcatatatgtatatataatgtaatatacaaagtacacaagggacaacagagaaaatggtccttctcactcccatccccagcaccccgttctcctctggaaggaaccagagtccccag

SEQ ID NO: 600867 - DNA, 429 bp, Homo sapiens
ttttttttttaaatccatctctatgtaagcctcccatcttcagatgcctgccctgactacccaccgaaaaattaaccttctctggggtcccacgcccacggagcttcgctcactgctagcacagcagtctgagatcaaactgcaaggccacagcgaggttgggggacgggcgtcgcactgctgagggttgagtaggtaaacaaagtggctgggaagctcaaactgggtggagccaccgcagttcaaggagacctgcctgcctctgtagactccaccgctgggggcagggcatagctgaacaaaaggcagcagacaacttctgcagacttaaaagtccctgtctgacagctatgaagagagcagtggttctcccaccatgcagtttgagctctgagaatggatagactgcctcctcaagtgggtccctga

SEQ ID NO: 600868 - DNA, 776 bp, Homo sapiens
  misc_feature (450)..(450): n is a, c, g, or t
  misc_feature (527)..(528): n is a, c, g, or t
  misc_feature (581)..(581): n is a, c, g, or t
  misc_feature (682)..(682): n is a, c, g, or t
ggggctttctcattcaaaacagcggagggggctcaacttttatagcccagccaatcgtggtctaaattaacggatcttggttcttcaagctctacaggcagtgattctagccgtgacgcagccaaaatgtttatgagggaataccgagttagctccagaaaaacccgtaaggaattatacaacaggtgagacttacagtgccatggcatattgtaaacagagcagaaacagcggagattatctcatgttgaagatcagaaaaaagaagtctcaaaggggatcgccattttaagaggccctacctaactgttattaaaaactcttgaatggctccttgaggtgaaaggactccagcatgaaatgcgttttctttaaatacagcacaatggactcagttgttggaacagatttctgacgattgtgatgcagataacaacacttgaaaattgngcgccttatatataaaacctggcccgattttaaatgcttaattcaacttttacatagactttggcgcgttaacagannccaactattgatgtttgaatcgcggaggatttgaggccagtacttttttttangggcaattttataattctggcgaagttaacgtaattttactatgggctatttggctggccacacatatggtgaacaaatttgtcatcccaagatagagacnaggataaccattttgtgccttgggcacatccccttttaccgaggaggtatatgtaggggcccatcggactccttgcttgccaattgaggggatt

SEQ ID NO: 600869 - DNA, 125 bp, Homo sapiens
gggtttttttttggggggggggggttttaggtttttggtttttaaaaccgggcttttttaaggggaccccttggcccaaaatttggtccagaatttttgggcccctttaaaaaggtttattggga

SEQ ID NO: 600870 - DNA, 931 bp, Homo sapiens
  misc_feature (47)..(47): n is a, c, g, or t
  misc_feature (69)..(69): n is a, c, g, or t
  misc_feature (102)..(102): n is a, c, g, or t
  misc_feature (203)..(203): n is a, c, g, or t
  misc_feature (207)..(207): n is a, c, g, or t
  misc_feature (227)..(227): n is a, c, g, or t
  misc_feature (244)..(244): n is a, c, g, or t
  misc_feature (255)..(256): n is a, c, g, or t
  misc_feature (271)..(271): n is a, c, g, or t
  misc_feature (299)..(299): n is a, c, g, or t
  misc_feature (303)..(303): n is a, c, g, or t
  misc_feature (320)..(321): n is a, c, g, or t
  misc_feature (323)..(323): n is a, c, g, or t
  misc_feature (326)..(326): n is a, c, g, or t
  misc_feature (335)..(335): n is a, c, g, or t
  misc_feature (393)..(393): n is a, c, g, or t
  misc_feature (419)..(419): n is a, c, g, or t
  misc_feature (512)..(512): n is a, c, g, or t
  misc_feature (563)..(563): n is a, c, g, or t
  misc_feature (591)..(591): n is a, c, g, or t
  misc_feature (626)..(626): n is a, c, g, or t
  misc_feature (784)..(784): n is a, c, g, or t
  misc_feature (801)..(801): n is a, c, g, or t
  misc_feature (818)..(818): n is a, c, g, or t
  misc_feature (828)..(828): n is a, c, g, or t
  misc_feature (891)..(891): n is a, c, g, or t
gatgccacaccctttctctcagaagccgggtctctgggagacggganggagagaagggggtagcctagnaagacgcagctccccctcagccacaccaccccnccgcagagaggggacagaaaaggaaaaaggaaggtgacacaggactggggttcaaatactcagaaagccacacaataaaagaaaagaagtagccagccccnaagnaagcggggacaaggaggaancagtgtccgttcccgcnctcttcccagnnggggcactgcgtccncaggactccgtggggtaaggggtttgtntgtnatgtgaggtattttttnngngtngaggggctnaaggctggacccaccctgcccttggactcctgggctcagggcacgtcaggcccgacgngcccctgcagtcggcagtgatggggncagtggaggcctacagcttggtcaggtccagtttcagcttgtagggtggtaggctgtcctcacaggcgtgggacggcggcgggtacaggggcnattcgggctccatcatgaagcccttgtgctgctccagggtcagaggctggnacttgaggtgctggtcaggcgcggtcancagggtggagcagctcagccacagcatcaccagcncggagaggaagaggcagcaggccaggatccagcgaggcagacccgagcgcctgccccgcccggcaggcaccactcagctgcccaggccgggaccagggagacccgtacctccagtcccacccccctcccacccccaaggtcctgccacccaccggganatgcaactgaggaagtnattgtcctgtggctctncagactccancttggccttgctgctggtcttgactcagatcttggccttcctcaccttgtccagggggcctanagggtccacgtgcacctccagggcttcagggtgggagctc

SEQ ID NO: 600871 - DNA, 185 bp, Homo sapiens
gagatcaggggggagaatccagatgacatctgaaatcacattacagaaaatacaacagacatgagccaaaaatctgatcttactagataccttcaggatcaaatccaggatattaaatatgtacaaaaatttcaaatgatatgcagagtgctgcatatgtgtacagacaaaccatgaatggcaca

SEQ ID NO: 600872 - DNA, 1020 bp, Homo sapiens
  misc_feature (239)..(239): n is a, c, g, or t
  misc_feature (823)..(823): n is a, c, g, or t
gacaatatactgcataaactatgaagaataggttcaaatgtgatacataaatacacatattttatagataatgtatatacagtgatcatggttaaactacccttggactgttttagagtgaacatgacctttgaataatagcagttatgttagatgtagtgcatggccaaacgttttcctcatgtgaggagagatagatgtcacaaatgtctttactgatgagaatggaccaccaggcnttgcgttgaattatatctattattaaagccaatcaatatgtaacatattataagtgtagacgtcttgatagaagggtgaatgggacagcgtgagattaccatggtgctaatccgatttattgggttctactcttgataatctcttgatacaaatagcaatacctctgtagacaccacactcatacacacccgaagtacaaataaggtaccaactaaggcttgcacattatattctatgttcacacatgtgatccagggtatgctcctagacttattgggcttccctcgagtctcgagctaggaagacgataacgcccttcgaatacggtcagttgggcagggagacacggtaatttatccacagcaatgctgaggtgctcacagttctattaacttctaagaatgagaaaaaggatcatatctagagatgctccagcagatagaagtgaataggtgaagctttctcatcaaaaatacatgtgcggtctactgtgagactagatagtcgattgaatgaagatacctgttggtattgcgagcgagtagttggtgtgtccgctcgtgctaagaaaggggaaactaantctggcgtaaagaattaaggataatagtgtataacctccgaaaagagttgccaaaaggatttggacctttagatggtgagcaatgaaatttcccttttccccgagattggtcaaccgcgtaaacaagggtctaagtggaagggcatttgaaacaataatatttaacgaagtaaggggttcatttcataacgactgta

SEQ ID NO: 600873 - DNA, 311 bp, Homo sapiens
gtcgcgcggccgggtggctcgggtcggtaccctgggcgcggacgagctgcctcattagtattcgtacccacgaggcggccacgggccctcggggacagcgagcgtcgcggccatggcttatcactcgggctacggagcccacggctcagagcacagggcccgggcagccccggatccccctcccctcttcgatgacaccaacggttggtaatccgagcaagccgggggaatacccagccacaggagcagacgtggccttcagtgtcaaccacttgcttggggacccaatggccaatgtggctatggcctat

SEQ ID NO: 600874 - DNA, 1788 bp, Homo sapiens
ggaacaaagctcgtcgtgacaggattcaaccggaaggagcattctacaaacttctagagttagagcagctcaacactcgctggcatctggacgaacctggacgcaggctcacacgactgctcacttgacacaatgcacaccgacacgactcgccttctcaccctgaccctctcagccctccactgccacgtgctccagagcactagcacactcgtctgtccactgccctggacggggctgactccgacactcactctgcctactgtgctctgcgaacagccctcctcccaaccgctcacctgcgaacactgacactgaacagataccttacctcacagaagccacctattgacgaccacagccacttagctcattccatggtcatcaacgaactgccagaggagcccatcaaggcgtctattctcttcttgccacaaactgacgccggcgcaacgaaagcaagaccaacttcatcgtcgactgtattacgcgtaaactactttcaatttgtctgtgccactctgctacaccaacattcttactctcatattcaccaccaactgctaatgcctgtatgctgctgtacaccaccttcccgccccctctgaacacatcacccctcactccccgcttggaccctcctccgcactttttcacacactgtcctcccttcccgctcgcaccccactccgcctcccggacctggcgggcggcacgtctccccgctctctcttcttgggcccaccgtgcctccagccgcccgctcctcggctcgcggaccacgcgtgcgttggttctcacccacggtcgcaaggcccgcccagtctctgccggccccgaaaaggtcgttttagccccccgcgcacctgtccgctcaccacccctccgtcgcgcgccctcgcctcctgtcgtcttgaccacccctgcttcttgtatatttgtttttgttttctcctctccccatctcctcctccgcctccccccccccgcccccctcccacacctgagcacacgcctacgcacacaccaacacgccacaacccagaccacgcacctcccaccactctacaacctccttctgtccttctctctcctctacgtaaccgctcctccctactccgcccctcacacgacacccgacgcctcacccgacctccacctgcccctgcttctaccctcccagccgggactcccgcgccgccctcctctcctccctccctaccaccacaaccctcgctcctcctctgccctctcacccaccctccgtccgcccctccgccgcggcctgccgccgcgcgggccgcgccgcgcggtgcccggggccgcccgcgtagtcgtcactctcccgctggtcccctcccgcctcccgcgtccccctcctcttctctccgccttctcccgtcccgtccccctctctcccggccgcctcctcactctcccgccccccccgcggcctccccccccgcccgcgcccgcggcgcgcgtcggctgctgcggtgcatgggagtccgctggagagcgcggccgcgttgctgcgcgctctgctctgttcgccttgctctcccgctctctcctgtctgtgactcgctctctcgctgtcgcgcctgcccgtgccctctcttcccgcccccctgtcctcttcgcgtccccgccattcgttcctgcctctcccgtctctcgcgcgccgtcggcggtcggctgcgttgcgcggtggccgcgctggctgtctgctcctcctcagtccccgcggccatgcccgtctgtacggccgcgcgcttgttcctcccg

SEQ ID NO: 600875 - DNA, 133 bp, Homo sapiens
tgtttttcgtttaaaaaaaaaaaaaagaaataggacagggcgagagagaattcgagaggacgcgaggtctgggagaaaccagcagcaccaaaaaagaggacgctagagatggcagtaagatcggggtcttaat

SEQ ID NO: 600876 - DNA, 342 bp, Homo sapiens
tgaaaaaacccccgggcccttttttttttagttgggcctttaaaaaaccccagaggggaaaatccttgtggagggggaaacgggggtggggaataaggggggggggggggggaaaaggggggaaaggaaaaccccccaacaagagaatgcccctctccacaacgcctaatgcgcggaggacaccacgcgaaaatcttgatcacctccgagtctaaccccagcaggggtctcccgggtgtccgcggggtggcacagagagcctggccgcacaacacaacctccgggggggaggggcacggcgccctcataaaaaagcggcgcccctattggggggaaaccgcc

SEQ ID NO: 600877 - DNA, 100 bp, Homo sapiens
gttcttgacttcaggtctgtctgtgctgtgggcaagctaactgccgtacggttctgatcccgtgtgctattagattgctttgtgaaacgacgggagttat

SEQ ID NO: 600878 - DNA, 423 bp, Homo sapiens
ccgttccctccactgccactgcctgcctcagccctgcctcacagcctcaaaggcaggcctgccctcctggcacctctacccaaggttgctgctgtgcagtgccttccagctagggcccacctccctagagctgaggccacatattagggtcacctgatggaaaggaggaaggctcacggtccggggtcccctgccactgcccagctcttccaactgacggctccacatcttgggagtgggctctgatgcatgatgggtcaggggcttctcagttttctacagcccaaatactccccagctccggagccttctatcccaccaggagcaggtataacacaaatccttcccaaagatcttgcggtacctgctgagtgaacaacaccctcaactctttcccacaggccctgggtcccatgctgcagg

SEQ ID NO: 600879 - DNA, 418 bp, Homo sapiens
  misc_feature (246)..(248): n is a, c, g, or t
  misc_feature (286)..(286): n is a, c, g, or t
  misc_feature (297)..(297): n is a, c, g, or t
cctttaaaaccgtccatagccactcaaatcaccggtccaacaacaggaatggctggagcggggctcctggaccgtgcagtgtgtttacgaggatcaggctgggagacctactgaagggggtgtcgaggagctattggcgtgactgcaagatccttgttaaagaccagttgggtcagagcaggaggtgaagagggaccgggtgtccatgcaaggacaatccacgaagaaacccgcacgtttcactgnnntgacctatggcggcatctcactgaacaacgtgactgcntggaacatgcntttttaaccctgggggcttgctgcgacactctgacgcacaacacgtggcaacatgacgcttggaggtcacagattcaacgttgaccagtgtgacgcactaggtccaacgcaaagggttgcc

SEQ ID NO: 600880 - DNA, 257 bp, Homo sapiens
aacgcgctgacagtctccaggaaaggagcattcattcgacatcacggagatgatccgggagaagaaccccgatggctccctgtcagcagcggagatgccccttttcaagctctacatggacatgaccgcctgcttcctggccgctggcatcttctgtgtgtccatcctctgcaggaacacgtacagcgtcttcacgatccactggctcatggagcccttggccttcaccaagagcatctctctcctctcacacagca

SEQ ID NO: 600881 - DNA, 346 bp, Homo sapiens
  misc_feature (40)..(41): n is a, c, g, or t
  misc_feature (58)..(58): n is a, c, g, or t
  misc_feature (82)..(83): n is a, c, g, or t
  misc_feature (212)..(212): n is a, c, g, or t
taccctctctgccccaataccgcccccacttcctcaccgnnctatcctccccagcagnccatttcatctacccaggtgagannccattctctttaggaagataatgcttcaactcctcctttgaattgcccctaacttggaccacatatggtcgtgaaagaaaaaaaaaagaaaaaaaatttaaaaagattttcctttaacaacagagggancatgcattcccgggggtttcagggcgcattcccacatggctcgccaaagggccaaaacttctttaaaggctcattttccctttttattttgtgggagacaggttctcctcctggcacccagggtgggtttgaac

SEQ ID NO: 600882 - DNA, 911 bp, Homo sapiens
taaaaggaatgtaagcctttattcccttgtttttggcaattaaaatcgggtctaagtgggtgtgcttttggtgtggattagtccaaagagaccaaatcccattatcctccgtcggattcctccgactcttccttggtttcaaccattagctgggggctgcacgcagcacgaggacgcatgctgtgtgtgctgcatgcacgccacagggggcatgcagccacaaaaggcaagattggatcagccaagaaggccttgacctttatcagcaatgtggggaatggtgtaacccggtctccacagacagggccacggactgcgtttggtacccctgtgtggatgtatagaatggggtgtccctgggatgcacccacgttggtgtgtgacgccaattctgggcgacgacaagacctctggggccaacttttggcgggccctcggtcggccgggaatctcggagacacagagggctgggttttagaattcccgcgggcccgatgtccccggggaaacgctcgcgggatgacccgggccgtcatgcgtgcaagaagaccccttttttttgctcgacggggggcaaacaggtttgatggtgcaagcaccccaggtgtgactgttgtgaaataaacccctggttatctgcggcgcccccattatgtgttggtggtccccgggttgtttccccaaggaattggccctcatgaaacaagctccccccttgggcacagtttggtttcccgcgaccatatttgtcttccccacgaggggaatgtacccgcactggtatagaatgtttttgcgtacgccacacaagagagggatggtggacaccaagggggggggctggctacggcgtgctaacgcggcctcacctacacgtgggcgcccaaattgtttgtcggaaaacgcccggg

SEQ ID NO: 600883 - DNA, 112 bp, Homo sapiens
cctgtggcgcatcgggtggagcatgggtggagcatcgggtggagcatcgggtggagcatcgggctggagcatcgggctggagcctcgggctggagcatcgggctggagcatc

SEQ ID NO: 600884 - DNA, 857 bp, Homo sapiens
gtgctggggcgtgcagtggccggatgcatgtgactgagaccctgggtgtggcgtccgtgccctcgcagtggagtggtctgtccagtggcatccgcggtgagacgacaaagttgccagacgtgcagcattgccactgccagtgcatcctgccagtgccaggaatcattgtggactgcccgatgtgtgcacgactggatgtgcccccctgtgcctgtccagctgtggcagtccacccgcagttccagtagcggacataacccagtgctctgcgagccatttctatcggtgagatgtggagcgccatggtcgatcctgagagctttgaacgaagaatttggcagagccggcgcgtattgattggcttgcgagtgtgaacttggaccgagccagcagcggatggtgtcttgtcgttgtataccctgtggctaccctgccaggcccatggctgcattgggtcttgcttgttgatgcgagcatctccttggaacctccgacttggctcgtgtggttgtggcttggtgcccgtacgtggtcggggctgggcgcccactggggacttggatgcacgcttgaaggtccttccggtgtgtgcctggaacttgggacgcgggcggagacccttgcggtcaacagggatgacgtacgagactgtggtggaatgtcccgaggagcttgccttgtgtctgagcgtatcaaaccaatgcaaacctccaatgtggatgatggagtggatgcaaagactgggacagcaagggtacgtagtgctagtagtgaccggaaggaacgtgtctaggaagggaaaagataagcaaatgaggtaagaggacagcctaaaagacgaatgcataagacagccg

SEQ ID NO: 600885 - DNA, 244 bp, Homo sapiens
gaacggtgagatgctcctcgtccatccaccggtccccacaagtagagagagtgtatccacctcatcataaacctgaggaacagacttaagtacgccctgacaggagacgaagtaaagaagatttgcatgcagcggttcattaaaatcgatgacaaggtccgaactgatataacctaccctgctagatacatggatgtcatcagcattgacaaaacgggagaaaaattccgtctgatctatgaca

SEQ ID NO: 600886 - DNA, 166 bp, Homo sapiens
tcgctgccggtactttacgactatacactggacgtttacccaccccgactttgggcacgcacttcccacagcaaccccgacctccgggacagacccggagcccggcgcgccgggggccgataccggacctcacaccgtccaccggagcggtgggtcagcacataag

SEQ ID NO: 600887 - DNA, 202 bp, Homo sapiens
tataaataaccttagcctaatgagcatgcctgtgattgggttgacagtgagggtcatcatgacttgtcggttgattgtacatttgggccgttaattgtcagtccagtgttgaatctgacgcaagcttatgcggagcagaatgttttcatgttacttctactaacattagttcttctatcgggtgatcgattggtccgagcgg

SEQ ID NO: 600888 - DNA, 428 bp, Homo sapiens
gtcagacatcttcctcggcttcttctgtgagggtgtaaacagtgaggtactcgaaggatgagagttaaaccaatctttctatgaattggttttttactgttatgggaaatggaagatacgtaccttcatgctataatgaaggacatttggaccacttggaatatcaacacttaataagtttctcaaaaatgtatgtttatcattttaacagggccagttaaaaattcaaagctcaaagagactcacacattacagatcctataaataacatggtgaaagttgatcatacaaatggggtcaatcttggcacacccagctaaaacagagtcaagaggctagggggataaagcactggtcacatgacatcgctctgagactgtaattctctgcaagcctgctgctggaactggctggtgtaacctgaaagc

SEQ ID NO: 600889 - DNA, 964 bp, Homo sapiens
gcctggatcgagggtacacttccgactcagaggtctacacttgaccatgtgaggccgggcaatgatacaccgatcagtcacagatgccgatgtggtcaagcgagttggtaggttagtggttgggaaggatgaccgtaagtataacgtccaaggaccagaggacccagtctggccaggaccttcacacctctgggatcaaatcacatcatccagccgtacaccagtgggacgtggtattcggggccatccacgacaggcgtaatgtcgttctggcttgatagctgtgtggaatcggtggtccttcatcgtgcgtgatgctgaccacatccacaacctggacaactttgaggctctgcgtcaatgcacgtgctccggatctttgtcgagagtgccagtctgaatggcgagatgcaatgtcccaggagaaacgtgggagagtcacaacaatattgacgagcgaaaaggggatacgcgtgttccacacgataggaaattcgcactgagggatcaatgcttcgccaggacctcagaagctccatgcaacatgcctctcggggcgttcgagagtgatgatgatgaggaccaagggcgtgctgacatctacattaaggagtcgctgaccagggcagtcagggacttgctaaactgatgacaccctgtaccacgaggggcaagactctatctaaaggctcatgggcgtgggagctatgccacactggagactggtggccacgaacaatcgaagtgattctcgagcctcttggggccacaagctggtgccctttactggagggtatttgcttgctgtgtgaaatgccccggagcaggcacggggtgcgcaggcatgactatcttgcggggagcacaactggacatgattctgaacagtatatgcctggaatggagtccggtttaacaaggggggtccttaatacaagtcttgagaacatcgcctccaatttga

SEQ ID NO: 600890 - DNA, 1743 bp, Homo sapiens
aaatataatttattgaggcctttgggtggcaccggggccttcattcgattgcatttcccactcccctcttccacaagtgtgattaaaagtgaccagaaacacagaaggtgagatcacagctctgctggcagagattactagcccttggctctctcgtttggcttgggtattttatattatttctgtcataacttttatctttagaattgttctttctcctgtttgtttgcttgttagtttgtttaaaatggaaaaaggggttctctgtgttctgcccctgtaattctaggtctggaacctttatttgttctagggcagctctgggaacatgcgggattgtggaattgggtcaggaaccctctctggtattctggatgttgtaggttctctagcagtctagaaatggatacagacatttctctgttcttcaagggtgataggaaccattatgttgagcccaaaatggaagtaataataaatgcctcctggaggctgtgggtgtgggggattctgtatctggattccgtatcactccaactggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagtactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgcgc

SEQ ID NO: 600891 - DNA, 191 bp, Homo sapiens
  misc_feature (67)..(67): n is a, c, g, or t
  misc_feature (88)..(88): n is a, c, g, or t
  misc_feature (113)..(113): n is a, c, g, or t
  misc_feature (121)..(121): n is a, c, g, or t
  misc_feature (142)..(142): n is a, c, g, or t
  misc_feature (152)..(152): n is a, c, g, or t
cctgtacaaccagaagcgacacaggttcctttggtatcatccacaagtaaggggtacacagcatctnaacccttgtaccagccttctnatgctacagagcaacgaccacaganggaaccanttgatcagattcaggcaacantctctttaantacagaccagactacagcatcatcatcccttcctgctgc

SEQ ID NO: 600892 - DNA, 417 bp, Homo sapiens
gttggaacttttttttttttgagacagagtctcactctgttgcccaggctacagtccagtggtgcaatctcagctcactgcaacctccgcctcccgagttcaaatgattctcctgcctcagcctcccaagtagctggggttacaagtacgcaccaccatgcccggctaattctttgtatttttagtagagacaggtttcaccatgttggccaggctggtctcgaactcctgacctcaggtgatccacccgcctcagcctcccaaagtgctgggattacaggcaggagccaccacgcccagcctaaacattttcatcttaccaagaattcctcaaagaccctgggtgctgccacaatgcaaatgtggtcacatttataagaagggagtttatatttacaaggactggcatcacattct

SEQ ID NO: 600893 - DNA, 487 bp, Homo sapiens
  misc_feature (142)..(142): n is a, c, g, or t
  misc_feature (216)..(216): n is a, c, g, or t
  misc_feature (218)..(218): n is a, c, g, or t
  misc_feature (301)..(301): n is a, c, g, or t
tccaaccatgctgtactgctttctggatccatgtaaaatttctaagaataaatttacagttgaacttaacattctacagtgaaatgaattatagacaaagaatatatataatactggctgggtgcaccggctcacgcctgtnattccagcacttcgggaggctgaggtgggaggattgcttgaggcctggagttcaagaccagcctgagcaacatngngagacactttcctctacaaaaaaaaacaaaaaaactggcccatggtggcgcacacctgtggtcctagcctatagacccagttnctggggaggctgagacaggagggttgcttgagcacagaagttcaagcctgcagtgagctgtgattccaccattgtactccagcctgggtgatagactctgtctcaaaaaataaagtcagatggaatcatgctttaatactagatatatggatcattgagactgtctcaaaagaataaatgttatca

SEQ ID NO: 600894 - DNA, 409 bp, Homo sapiens
  misc_feature (64)..(64): n is a, c, g, or t
  misc_feature (138)..(138): n is a, c, g, or t
  misc_feature (140)..(140): n is a, c, g, or t
  misc_feature (223)..(223): n is a, c, g, or t
tattgtaaaatcatgatgatctctcatttacaaaagtgggccaggtatgcgtgtcacgcctgtnattccagcacttcgggaggctgaggtgggaggattgcttgaggcctggagttcaagaccagcctgagcaacatngngagacactttcctctacaaaaaaaaacaaaaaaactggcccatggtggcgcacacctgtggtcctagcctatagacccagttnctggggaggctgagacaggagggttgcttgagcacagaagttcaagcctgcagtgagctgtgattccaccattgtactccagcctgggtgatagactctgtctcaaaaaataaagtcagatggaatcatgctttaatactagatatatggatcattgagactgtctcaaaagaataaatgttatca

SEQ ID NO: 600895 - DNA, 924 bp, Homo sapiens
cgtttttttgtgtgtgtttgtttgtgaaggacggaccaacaggcagcgacagcaacagacgagaaacgcccggtagtagactctcttctgcgtttttgtacctgcctcttgcgatttccctctgaatgtgagcgttttcctatgagccgattggccactattgatgctgtgtttttaaaattagaggccctacctgtatggccgagaattgttttattctccggccacctgaatttaatgcatacatggagtattatttgcctacgcccgagggaccacttgagtacccgatctcacaactggggaactgtcaaagacgaattaactgacttggatccatcaaaagtgactgaggaacacctgaaggtggaggacagcagcccgtggccagacactggaaataaggagaatgaagttgaagaggtaaaagaggagggtcccaaagagatgactttggatgagtggaaggctattccaaataaggaccgcggccaaagtaggatttaatatccggaaacccaatgaaggtgctgaatgggcacactggaagaagggatttgtttcttcataaatccaagagtgaagaggctcacttctgaagattcggcttatggaccactcactttccggaagccacgccaatgatattaacgtctcacgctggagatccattttggagagccttggccgccccggagcgtggcggccaggggaggacgaggtggaacgtgggcgtggtgggcgccccaaaccgtggcagcacggagccgaaccaaattcaaagtgcttttgctctctgatgtggatgaccccgaggcattccccgctctggcttaactggatgccctaagaccaccctggttccctttgtgaacccttctggtccaagcttttgcatgcttaaggattccccaacgactaaga

SEQ ID NO: 600896 - DNA, 1377 bp, Homo sapiens
gcgccatgatgcaatgatcagcgaggcctgtgaatgctgctgcccgcgcctgcttcagctcgtggcaggaccctgtccgctgcagttcctggatccagcatgctgtgatgtgctgctgcatgctgccttgcatccatgtgatgcatgtgatgcatgtgatgctgtgtgtgtgctgctgctttggcctgcaggactctgccacaaggacatgaattgtgaatctgcctaactaatagatgtgaggtggttgtgttgtacgtgtcctagatgtgatgatctgatgttacagtgataccatgaatgctacccttgagttggtgcctgctggacatgatgccctgttggacgcaatggactgccccgagacttcatggcatgtgactgcagctctaactatacgcactacgtgagaccactagggacgtaggtacctacggtacatttggacacctgtgtgtaactaacccctatacaacctacacgcataccatgcccatggcttggtgctctgctcattacgcctagcaggggcaactgccagattgtgtctctcaagtgtcgcctacgtgaggctagcattttgatgaccgattgcgctgatgcctggactgcgcctaactcatcatacccaccatgttaccttagggcacgacacgggctctttgtatctcgcaggtaacatcaaagtgtgggcgcgatagtccccgtggaggaaccaactgtgaagactaggcattcgcaatgggcacgaaggggtctccgacaccaagttagtcccgtggtacccatctggcgacatggccaccctgcggcgcgagcttggcggggcaacatcgcatccagtacagtggcaccgcggggcccttggcttggcccacaacggccaccacattgagcccccccgtggtcaacctaggctgtgcactccattcgcggcacgggggccatgcacgctccccgtagccctaaccgtgggcaccacgaggagaacgctatgcgttggaaccgttgtgggcaaccagtgtttggacaccgttgggccatggaccgtggccagtacatggccctatggggtgccggagccacaccacgctagccagttgcgaaaccgcacggatgggggccccagcagccaccccatggcgctgataggtgcgcagcacgcaggtggaagccgtaaccggaactcccgccatactcaggtgctggtagaacgcacccccgcctatcgagacacacacaccaggaaaagacccgcaagacaccgacttggcggagcggaccgacaaccggcaccccacacgggaacaggggctaccacgctgggggaacacgtgacaggagacccactaccaggccgacggacaagagacgaac

SEQ ID NO: 600897 - DNA, 842 bp, Homo sapiens
  misc_feature (842)..(842): n is a, c, g, or t
gggggccttcgccgccgcgcccccagcacggccctgccagcatcgccacctccgccgctgccgccttggggccctcctcggcttcaccgcccccttcaccaccatctacactgttctaggccttctgtcctggagaagaagctatatgtcgttctcccttgtgggccccggggactgcagccataggcggacggcaggacgagcgtgcgggggaactggcgctggtgggctgtgctgtgcgtgaactacgtccatggcctctgcccggtgtggcaggctgacttgtggcgctacctggaggccatgctggttgtgcgtgtggccccgatcagagcccgtgccctcgccttgccgtccactgagacatgaacccacgacagggcttcagttcagcctcattcacttcgatggggaggcaagggcttccaaaagaagaccctgggagtgccccttttatttgagcaaaggctttcacgggtcctgagggaaccttagcccattggggcccgaaccgggttggggaaccaaccccagaaaggccccaggccatatataacccaacaacgaccccattggaagcgcaccagggaagcacacgcttggggaaataaagctgtatggagggtagcttcaaacccacccaaatttcgttgggggaagcgaaaaggccaaagggcaagacttgggacacagttcccctttaacgggaagttagcaaaagtcaagaagagaaagcccgaggattttggacacgaaacaattggggtacctttggaatggtgagcaatgaaatgagattggataggggattttcaatgagtttcaagggtgaatgaattggn

SEQ ID NO: 600898 - DNA, 202 bp, Homo sapiens
tcgcggttaccgactgcaatctgtgcctctactaaaaaagcaaaatggcggatggagtggctcacacctgtaatctcagcacttcagtgaggctgacatgggtggatcaccgtgaggtcgggagttcgggaccagccatgaccaaccatcgtcagtaagagaaaccccgtctctactaaagaatacaacaattagcctgggc

SEQ ID NO: 600899 - DNA, 411 bp, Homo sapiens
cagccaacaggatcagagaccagaacttagattatgacaaaggcagcagcggccccttgccaaaatccgacagaggtctatatatgacatgcagtatgagaggaaggcgccaccatctgcccagtggtgcggtccacatagatgaagtgcaccaagcctgggaagtcttctaggtcggacaccatggtgatgttcctcctgctcttcaccagcaagaagtccttccagtccgtcagcttctcccgcatgagcctctgcacttggtcctgcaggtgctggggcaggtgtgggcctcccctgctgggggctgtggtcagaaagttcagccggtcgatggcgcagagctgccgcttcagcttcccacatgcctggagcagatcccaggaggatccgggctcacttttggagaaa

SEQ ID NO: 600900 - DNA, 261 bp, Homo sapiens
gggggtaaaattttttcccccctgggtggccttaaagccgccccccatttaaaagggggtttggggttccccccccctcccttaaaatttcccaacaattttttgggttccttcccccccattgggcccttttttcccccctttggaggaattttgtttggtttgggtacctggaaacttttttccccgggtagggcggggggggtttttaaccctggattggccatttacgggcccattttttcctttccccccccggga

SEQ ID NO: 600901 - DNA, 113 bp, Homo sapiens
  misc_feature (4)..(4): n is a, c, g, or t
acgncgacatacgctctagacggcaggctgacatctgcacttaacaggaccaattctgatcgtcttcacacgagtgctctgagtaccaagccccaggacccctatggaggagg

SEQ ID NO: 600902 - DNA, 382 bp, Homo sapiens
gttctctggagcagcgttcttttatctccgtccgccttctctcctacctaagtgcgtaccgccacccgatggagggttcgatggacatggacatgagccccctgagggcccagaactatcttttcgggtgtgaactaaagggcgcacaaagatatattcactttaagggggggtaatgatgaaaaatgagcacccagtttatctttaagagcgggtgagatttagggggctcggtgcaaagggtgaggttgcacaaatgtttaaggagagggcactgtatttacgcggggaggtgcacttaaagtgagcactcgcgcatcttggaaatatctggtgcagcacacagggttccctttggggggttttaataaccaaccacccc

SEQ ID NO: 600903 - DNA, 302 bp, Homo sapiens
tccatgccactgccctccagcctgggtgacagagggagactcttatttcatcaaaacctaacacttacacacgctcacacacattcacacacacactcacacactcacacacagacactctcactctcattctcacacatacacccacacacacacttattcactcgctctcacacatcctcactctcacatccacactatatcccctcctccttaattacactccctcccaccccgcacagaaattgtttcacttacttgacacctcatctccacattctcacactcaagggaagatccaa

SEQ ID NO: 600904 - DNA, 275 bp, Homo sapiens
tgggcccctgcaaaggcacacaggggccggccacacccaggggccccccgcacaaccccccgtggggtgttgcccttatgcccggggccgggccccaaccccatgtttggggtttgtttgggtttgtttttcaaaaaaaaattcaaaatgcggcttggattttgaaatttccgggaacggtcaggggacacgtttggaccccgtttcatttttaccccaatttggtaaaaaaggtgttttcaccctcccccaattaaaccgcatgtgttttccca

SEQ ID NO: 600905 - DNA, 405 bp, Homo sapiens
aataatttggacagtatttgagggtttaaaaaagagcagcaggccgggcgcagtggctcacacctgtaatcccatcactttgggaggccaaggcaggtgaatcagttgaacccaagagtttgagatcagcctgggcaaccaaaacttgtgtctacaaaacatacaaaaattagccagcctggacaacaaggcaagatcctgtctcaggaaacaacaacaataacaacaaaaacaagcagcagagctttccacttttgcttgggttattattcaaatcatatactcttcccgaattgttgaaaagaagtgtcatatggatcagatattatctaaggacacgttcattaagatgtctgccttcagtcctggttcaggacttaagaaggtgagactcttcatcttctg

SEQ ID NO: 600906 - DNA, 132 bp, Homo sapiens
ttcgcatgtttccccagcgcagtagtcctggagctgtgaggagttcgggccgtcaccctgcctcccctgtcgtaccgccaccgggcgcttctgtcctcggacccgattccaacaatctcgtaaaacatggcg

SEQ ID NO: 600907 - DNA, 674 bp, Homo sapiens
  misc_feature (554)..(554): n is a, c, g, or t
ggcggtggctcacacatgtaatcgtagcactttaggaggccaaggcggggatctcttgaggtcaggagttcaaaaccagcctggccaacaaggtgaaccccatctttactaaaaatacaaaaaaattagccaggcatggtggcagacacctgtaatcccagctactcaggaggctgagggaggagaatcacttgaacacgggaggtggaggctgcagtgagccgagatcacgcaccattacactccagcctgggcgacagagcaagactctgtctcaaaaaaaaaataaataaattaaaaataaaaagttgatctcatagaagtagagagtaagccagtgcttaccagagactgggaaggggaaggtaggaagagatgtggttaacagacacaaaattacagctagataggaagaattaagttctagtggtctaaggccctgtagggtgaaaacaaatactaatgtatggtgtattttcaaatggctggaagagaaaatttttaatgttcccaatacaaagaaatgaaaaatgttggaagtgactgatatactnattaccctaattggaccattacacatcattaaatatcacaccgtatgccataaatatgtataattttggtcaaaatcataaaataatgtttaaagtccattttcaatttgtctatagata

SEQ ID NO: 600908 - DNA, 517 bp, Homo sapiens
tagattaaccccttcctctcctcccacctcttcagcttctgctccacttcctcctcccttttacgcacccctccttgaagtggttgtccctgctggctacttctccgaatcttcacctccattccctcttagcctacaccagccaagtttttgtttctgtcactccattgaaactgcccttgtccaagtcaccagtgacctcctactggcgcatccaaaaggtctgtctcctggtctcacctcctcaatttctcagcagcgtttgcacagtagggcactcgctcctccttgcaacgctgtctttctttggagtccaggactccacactggtctggcttcctcctacccggatggcagctctttctctggctccttcgctggctcctcctcttcttgatctctaaatgtgagcatggtgtggggacttttttcttatttacagtctctcccggttagatggttagattccatctaggcctgtgcctttaaatgtcctctagaggtgggaggagaggaa

SEQ ID NO: 600909 - DNA, 581 bp, Homo sapiens
  misc_feature (31)..(31): n is a, c, g, or t
  misc_feature (66)..(66): n is a, c, g, or t
  misc_feature (105)..(105): n is a, c, g, or t
  misc_feature (115)..(115): n is a, c, g, or t
  misc_feature (124)..(124): n is a, c, g, or t
  misc_feature (129)..(129): n is a, c, g, or t
  misc_feature (141)..(141): n is a, c, g, or t
  misc_feature (173)..(173): n is a, c, g, or t
  misc_feature (195)..(195): n is a, c, g, or t
  misc_feature (200)..(200): n is a, c, g, or t
  misc_feature (209)..(209): n is a, c, g, or t
  misc_feature (251)..(251): n is a, c, g, or t
  misc_feature (299)..(299): n is a, c, g, or t
  misc_feature (318)..(318): n is a, c, g, or t
  misc_feature (555)..(555): n is a, c, g, or t
atcaaaccataaaacggtcagacccagcatnctagccaccccaggacaggacagacagatatgaanagaaacggacgcagacccacagacacatacaccgagacncacgatgatnctccaagcncaagngcctccactggnctgcacaagcagggatcagtcagagccaagantggaaatactcaagcaaatgcngaggntacaacccntccctcgactctaagccccaaacccacaatgtccccactgtncgtccagaggctccctccccagggcctggagatccgggcccagcaaangccgtggaaagcagaagtnagttagaagaaaaaaccgccagagcactcaggatcacccctgggagaaggaaggggcaggaggcagaaagggagggaggcaggcagtccttctgtccatcctttgtcacacaattgcccggaacaggaaggagaaaacagcccccagtgccagaaccagatacaggaagaaggccatgatggctcctgcggtctctgcctcagctggcttcactttcttgggcccgaagcacatgcngaggctggcgaggtagccgttggaga

SEQ ID NO: 600910 - DNA, 104 bp, Homo sapiens
cggacgacggaggttgcagtgacgccgagactcatgccactgcactccagcctaggcgcacagcagtgcagcactctgtactttaaacacacatcattttttaa

SEQ ID NO: 600911 - DNA, 190 bp, Homo sapiens
aatgactgttgcttttaaagatataaaactatggagaaaactgctaaagggtatccctgacctgtatgatgatgcagctattttcgggggcaaaaaaatcaattttacttgggcaggaaaaacacctcattccctttgtcgggaaaatccttgcctcaggctctttatgaattattttctcccccagatg

SEQ ID NO: 600912 - DNA, 240 bp, Homo sapiens
aactggagcagcacaacagtgaggttacatcttttacaccttttctactgtacagcccatcccagacgaagacatgtccctggatcacctgacagcacatgacatgaatccctgctaccatccatgtgcaactccttcgtagtacaactggaagaaacatgctacccagacaggaacagctggttagtgcaacatgatgtgcatgatgggataatcgccataacacccaattgaatgact

SEQ ID NO: 600913 - DNA, 368 bp, Homo sapiens
gctgtaaagacatacccgagactgattaatttataaagaaaagaggtttaattgacttatagttatgcatggctggggaggcctcaggaaacttacagtcatggcggaaggggaagaggcacgtcttacatggtggcaggcgagagagagaagagggaacaagggaggagcttccaaacagttataaaaccatcagatctcttgagaactcactcactatcatgagaacagcatgagggaaaccacctgcatgatccgatcacctcccacctggtccctccctcaataactggggattacaactcaagatgagatttgggtgggaatacaaagcctagccatatcaaatagtaaatatattttcttat

SEQ ID NO: 600914 - DNA, 385 bp, Homo sapiens
  misc_feature (30)..(30): n is a, c, g, or t
  misc_feature (360)..(360): n is a, c, g, or t
  misc_feature (377)..(377): n is a, c, g, or t
ccccccatgggagcggcgggccccttcccncccttgttttttctctgggcggccggggggggttatattttcccccgggaacacccttgtccctgttggctttctcaaaaatcctttttggtcacccttaagaaggggcccctgcaggaacgctttctggttccgcggggcgcccccccccctcgggattttttttctttttttccggccggggggggcccgccgggttttttccccccccgttttttttttctattttcccaggggggaggggctcttttttttcggggaaaaaaaaactttttttgcaaaattcttgtccccccacaaatttttttttttttcaaaaaaaacatgccnaaaataaaatttgtttnttctttta

SEQ ID NO: 600915 - DNA, 530 bp, Homo sapiens
agagcatacctctctgaagacatcctctctgaagacgctgcactatgctcagtgactgcccagtacattcaccttgcaagtctatgacatctcactggggtaggttgagttgtctattggatactatcatttctttcacaaatcttagagaatccagtgcgccgaaaatatttctgtgtactaccctcaataccagcatataattgattgaccagcaatatgtctcgcggaaatggacactgggttggtttgaagacaatcttaacttctcaaagggtttgcttttcaaaggaagagtacaccaggagattcctctcagccccagggcattcacctgctcccttgagaggctacactccaacctcaggttgtcctctgtctcccattcccagataaccagagttcattccaggccaggagctgaaatttaccagagattctagcatacacagccacagtggatattttgatttatcctcagaaagtactgaaacccaggaccaaggaaaaaactgaagagtgactaagga

SEQ ID NO: 600916 - DNA, 207 bp, Homo sapiens
gtatgaggcgaggtcttctaatgatagggctcttccttaggtgtacttggccatctctccatcccagttccatagttagctagggtccagcatctagctttgcagattccttaaacgcttaagatgctactttccatctcactgctgtctctactgtgtagtctgtgtgagtcttcccatgacgtctgtgctgaacttgccagactg

SEQ ID NO: 600917 - DNA, 223 bp, Homo sapiens
agtgatctaattaccttttatataaggaaccggcaataccctcggtgtctttgacaggcctcccataggctacaccccgtgatggactgactgcgtacagtcagaggctgacgtgcagacttggcccaccgtccgtcagaggctggagtggaggcttggcccaccatccatcagaggctggagtggagacttggcccaccgtccatcagaggctggagtggag

SEQ ID NO: 600918 - DNA, 424 bp, Homo sapiens
  misc_feature (411)..(411): n is a, c, g, or t
taataattataatggttaaaaacaaaaccatgggtaaacaagcccctttccccaaaaaagaaaccccccttcttgcctggggactaagactgccaccgtaggactaacaaaataagccacaagatttaggaattatggtttaggagtcatgcagctggaggctacaagattctgacccgccctaaactgctaagatcagtgcttgggatattttgcagaccctgcacttgatggatcagctggcaccacccagatggataaactggctcatctgatcttgtccccacccaggaactgactcaggacaagaggacagcttcagcttcccattatttcttcttctgacccaaccaatcaggactctcgactttactggccttccccaacccaccaaattatccttaaaaactntgatccccgaatg

SEQ ID NO: 600919 - DNA, 987 bp, Homo sapiens
  misc_feature (805)..(805): n is a, c, g, or t
  misc_feature (859)..(859): n is a, c, g, or t
  misc_feature (878)..(878): n is a, c, g, or t
ggctaggtcgaggctgggtgttaatcggccgaggtgcccgtgcacctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattgggaccaagaggctacctatggtgacgtgttgtagccttgctgccgtggaggctttctttccggncttgcgcgcagtctgcccagaacgggactgtgctggcccccatttatgactttngccgcacaggtcccgggtntgcgccgcgtcccccggtccaacccggggagaggaaacaccgggggaaaagcccccgggcccgggggcctacacacttggccacggcgccccggtagattgggcgcctt

SEQ ID NO: 600920 - DNA, 1000 bp, Homo sapiens
  misc_feature (774)..(774): n is a, c, g, or t
  misc_feature (782)..(782): n is a, c, g, or t
  misc_feature (789)..(789): n is a, c, g, or t
agcagagagacacatggctaggtctgaggctggggtgaatcggccgaggcgtctgtctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattgggaccaagaggctacctatggtgacgtgttgtagccttgtnagtgaagnttctttncggagcttggggaaatctgccaagaacgaggatgatcctggctaattctatgactctagcgagatgggtaccgggattgtggttaggtacactgtaatactggggagaaaagaaataagggcgagaaggcagaggaggacaggagtgctaagattggggaattcgggccaaagcttctcagaaaaagagcaacacccctcaaatcactgaa

SEQ ID NO: 600921 - DNA, 151 bp, Homo sapiens
ctggtttggggaaaactggagcacttactcaggtggctggtgaaatgccccctcaaaaggaatgagtgctataaaaaggaaaaaggagtgtcctgcccaggtttttgacaaatgtaattttcattcaattaaagtttcagtgttttggtta

SEQ ID NO: 600922 - DNA, 420 bp, Homo sapiens
  misc_feature (282)..(282): n is a, c, g, or t
attgggacaaagaggctacctatggtaaggagacccttgcccctacttaaacctgagcttcattttccaagtaatgttactggatttttggcccttgaataccaactcactagaatcatgttggtgacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgaggtgngtctaagtcaaataatagggtgacctaaaccccaaacacaactcgggcatgctcttgtgttcactgacggggacctgagatgctagatggcatatatccacatttaatgtgtgagttcaccatacacataatggggta

SEQ ID NO: 600923 - DNA, 333 bp, Homo sapiens
aggagtcctcgtttttttaacttattataggtcactctatgatccagagctgtaagatctgcttcttaaaagaacgtccttaatgaaggcaggacctaaagttattttcagttcctagtcctgctttctgtagctgtaggtatgagtatagttggcttgtataacatagaacagtgagattggctccactctggtaatccaaatttacatgtttttcactatagttagtcaaattcatttttatatattaggttatctataaagacttcagttatggtatagaaatttcataactcgctatttgagggttattggaggaagtattagtaatct

SEQ ID NO: 600924 - DNA, 167 bp, Homo sapiens
aatctgcggtgagaaaacatgagactggacggagctggagtgccttcaggaccatctggatacttggtggtgagtgtcgagatatagttggcaacctcactgagttcgaatcagaggatattcaaactagaagccttgctgatagagagcctgttagcccgattatt

SEQ ID NO: 600925 - DNA, 1072 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600926 - DNA, 411 bp, Homo sapiens
ctgccattttataaatgtcagcagttggaaaaatcgtcacgcctcagacataaatgcacttggaggttcccgttggcaaggggggctaactgtggggcatagtaagtggtccagcatacttaaagtttgagtgctcagtgtgagtcctgtaggctttactctcttccttttatgctaaaattgtgacttccgaacctcaggtggacctctccaaggacattcagcactgggaatccctgaaacccgaggagagatattttatatcccatgttctggctttctttgcagcaagcgatggcatagtaaatgaaaacttggtgagtttccagaccttcgttcaatcgttatgacgttgccgttctgagctcgatataggtcgcatgcctagtgttgatatgtctggggggctct

SEQ ID NO: 600927 - DNA, 574 bp, Homo sapiens
  misc_feature (6)..(6): n is a, c, g, or t
ggcggngcaggtcgccgcggtccgtggctgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600928 - DNA, 3607 bp, Homo sapiens
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 600929 - DNA, 207 bp, Homo sapiens
gagtcggccccggtttgatgaagctgtagtttcgtagatctgggtgatttcatgttattaaactcgaactttggctagttacactcatactgatatttcatctagtctcttaattatttaacacttaattcaagtcatttgtttgaagtctctacaaaagaagattgcagtcatccattcatatgcacggggagtgatgctttgaga

SEQ ID NO: 600930 - DNA, 1461 bp, Homo sapiens
gttatctgactttttgaaccatctcttgtttgttcactaacaattctctgttttcttgggtttccacatccctcttttttttattttccctttttttaattacaagtttcatatcatcttttgtaactttattattgctcacatcttttttttgttatgtcctccctaattaaatattgctgttttgtaattctcctgtttctatgttattatttgtattcattcatggatctcttatccccctctttgtgcttctctttgtatgacacaccctgtactgcaggctgttgtcttaaggatactttctctgtctttctgtggttatactgaagccttgtgtgggatgtctgtccgtgaccccacacagcttagggaattcttcctccgtctgttcccgtggaccaaactcggtaccactattgggggggtgttttaatcaacgccatgctaatttatatgccaagcgatgtgacaaacttgagtagtgtgttttcaacgatggcgcacgttggattgtcggttttgcgggccttcatcggcaatgcctatgtgttggaactccttctgctatatgacgccatgcccctagtgattagtattactgacctcacgggtttgagttttagactagttcctcttgttctaggtgtctctgagagaggacgtgctagcttagtatgagtatccctgctgccagcgagtaggagtgaagatagcggccacgtgcctcttgaagaattgtgagtacgcacatactgttgctacatagcaacgactagctctactcttgtggtgaagactacaccgggtttgtattagagtagccctactaagtgttcatcctaccactaatgctgacgcattgacgattgatcacgaccatttccacactgtgacgatccatcatgagttatcgagctacagcgatctatcacagttgtgtcactatcctggagtggtcatagcgcacacgcttacacgtctcaaggaagcaacaacgtctagtacttgcctaccatttgtagtccgtccttcacagggatgcagatattggaggttgctactcctggtagttctgtattggtctagcacgtcacgctcccttatcatgtagtgctacagagtccaaggctgtccctcggtgttttgcccatgctcgtgcgtcgcgttttgcgacacagatcaggttcttatagggacgacatagttggtgcgacgatagtctgttggcccatctatgatggtaccaccacacgatgattgtaatttcggagaacgtcagatctgctcgagcagcgggagcacgcgatgttcgatccccccctgccatatcaagcttcttctcgtggagcctgttcctcactctaagataggcctactgtgtgtgtgatgtgtgtgtcgatgtgtgtgtgtatgttcactgtacacttggctgatacggccattcgggtgcagtgtacg

SEQ ID NO: 600931 - DNA, 1633 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttggtagcgtgtcagtccgtgatcctgggtagatagagcagggcagcgacggaagactgcctataggacattcacgctgggatgagaggggcctgagaggcctgggctttgtgacagggaaacttggataaagggtggtgcgattcttccggttggtccctcagaggtggtggggcttggttatactggtagaggtgctgggctggccaggagcttacagggttacacctctcgcatactggtgtccacagagcagccatcttagctggaggtgtcgagtgcctcccccaccccccaccatgtgcttgagtgcacacccggcgccaggccctgatcctggcacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600932 - DNA, 3990 bp, Homo sapiens
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgaaaaaaaaaaaaaaaaaaaaaaaaaaaaaaattttgtgggggcggcttggggcccttagagaaaggtttttaaaacaatttgggtgtggggaggcgggggccaagagggtgaaagggagacaatgtgtgcgcaaaagcggtgtgtccccaaagagagaaacccggggcacaaagaacaaggcgcgggggagattccaccccaaaatacaaaaaagccgccgcgggggggaaaaccgagaagtgtctgttagagacacaattccccagaaatggaggtgtatcggggaggggcataaacggggggaatatatcaaacaagagggaagtccacaagagaggaggccgcaaatattccaaaatataaaccgccccggcacgagagg

SEQ ID NO: 600933 - DNA, 102 bp, Homo sapiens
agaggatcccgcatttctccatcagacaatgcatgctacgagttcataccaaatattgaaaggatggtatgaatctaaaaccaaatattagtttttattaaa

SEQ ID NO: 600934 - DNA, 956 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggggtgacatcctggtggatcccaccgcggcgggtccggcgcccgggctcctc

SEQ ID NO: 600935 - DNA, 1993 bp, Homo sapiens
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcac

SEQ ID NO: 600936 - DNA, 1597 bp, Homo sapiens
ctggtactggcccggaattatctgggagtggatcccgtcctgcggtgcgatgcttgctccgtagtggtggtctgagtgtgatggcctggggcggtatgcctgaccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttggtagcgtgtcagtccgtgatcctgggtagatagagcagggcagcgacggaagactgcctataggacattcacgctgggatgagaggggcctgagaggcctgggctttgtgacagggaaacttggataaagggtggtgcgattcttccggttggtccctcagaggtggtggggcttggttatactggtagaggtgctgggctggccaggagcttacagggttacacctctcgcatactggtgtccacagagcagccatcttagctggaggtgtcgagtgcctcccccaccccccaccatgtgcttgagtgcacacccggcgccaggccctgatcctggcacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600937 - DNA, 3294 bp, Homo sapiens
ggctaggtcgaggctgggtgttaatcggccgaggtgcccgtgcacctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 600938 - DNA, 196 bp, Homo sapiens
tcactcttctatatctacttctcagtactccatgtcctttaagactgttttgagtagtgtagatacgagataatgaaagcctggaatatcaatgaaagtggcagaaccaggatgaagagtagagatgttaaaagtgtagaatctttgagattggtcattggattgtgtagaaggaggctgaacgatagagaggaag

SEQ ID NO: 600939 - DNA, 175 bp, Homo sapiens
agagatctgctgaccttggatacataggtatggtctgagcgatgatatcaataggcttcctagggttgatcgtgtgagcacgaccatatattatatcagtagggagtagagatgtagacacgagacgtatattacaccctccgttaccataatcatggttatccccaccggcgtc

SEQ ID NO: 600940 - DNA, 836 bp, Homo sapiens
  misc_feature (2)..(2): n is a, c, g, or t
  misc_feature (84)..(84): n is a, c, g, or t
  misc_feature (160)..(160): n is a, c, g, or t
  misc_feature (163)..(163): n is a, c, g, or t
  misc_feature (177)..(177): n is a, c, g, or t
  misc_feature (186)..(186): n is a, c, g, or t
  misc_feature (193)..(193): n is a, c, g, or t
  misc_feature (197)..(197): n is a, c, g, or t
  misc_feature (215)..(215): n is a, c, g, or t
  misc_feature (242)..(242): n is a, c, g, or t
  misc_feature (262)..(262): n is a, c, g, or t
  misc_feature (271)..(271): n is a, c, g, or t
  misc_feature (276)..(276): n is a, c, g, or t
  misc_feature (296)..(296): n is a, c, g, or t
  misc_feature (305)..(305): n is a, c, g, or t
  misc_feature (308)..(308): n is a, c, g, or t
  misc_feature (324)..(325): n is a, c, g, or t
  misc_feature (329)..(329): n is a, c, g, or t
  misc_feature (331)..(332): n is a, c, g, or t
  misc_feature (337)..(337): n is a, c, g, or t
  misc_feature (348)..(348): n is a, c, g, or t
  misc_feature (354)..(354): n is a, c, g, or t
  misc_feature (360)..(360): n is a, c, g, or t
  misc_feature (363)..(366): n is a, c, g, or t
  misc_feature (391)..(391): n is a, c, g, or t
  misc_feature (393)..(393): n is a, c, g, or t
  misc_feature (430)..(430): n is a, c, g, or t
  misc_feature (485)..(485): n is a, c, g, or t
  misc_feature (544)..(544): n is a, c, g, or t
  misc_feature (552)..(552): n is a, c, g, or t
  misc_feature (566)..(566): n is a, c, g, or t
  misc_feature (587)..(587): n is a, c, g, or t
  misc_feature (598)..(598): n is a, c, g, or t
  misc_feature (714)..(714): n is a, c, g, or t
  misc_feature (732)..(732): n is a, c, g, or t
  misc_feature (756)..(756): n is a, c, g, or t
  misc_feature (834)..(834): n is a, c, g, or t
gnggcacttttctattcttgataaatttatataataaattcttatgacatttgattccaaattgtatgtccgaattggcttganataataaatataaacataagggcaatttaaacattggcagtagtttatgtaagtcaattcaaggtcagtgactggnganctatattaagaganacctgaggnaaaaaanatcnttaggaagcagccctgtnacaatgtacatttgtagatcaggggcnaaaaatccactctgaatgantaccaagangcaangggtgtacaacatccatcanacatctgtntcngaaacagcatgtgtcnnaaangnnaatcnctttacaagtnaacgtnacagtnttnnnncctatagccacaccattcgcctgcncnccagacgccctgccgacttccaccaagcacccctggnccatcgcttaaggcatccatctcaatcctggggctttaagaacatcttctttgcnttaattggtgttatgtctccattttcatcttcttcataattggcatggtctctctttcnggcaaacnttttcccaattgtncccaccaaggtctcatatctnctagccatctnttcatctgatatatcaagctctactgtttcatcttcaacttcttctgctttgtgcttagcatttatctgaagcatcaatttctcaacctcaggattaaatcctctgaatgacattnttccatagagaagatctncacatagtaagaaactctgctctnctattatgaaactctctttctctttaagctctggcaaatccaagttccagtgctcttcactaatgattttcttttctnct

SEQ ID NO: 600941 - DNA, 1700 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttggtagcgtgtcagtccgtgatcctgggtagatagagcagggcagcgacggaagactgcctataggacattcacgctgggatgagaggggcctgagaggcctgggctttgtgacagggaaacttggataaagggtggtgcgattcttccggttggtccctcagaggtggtggggcttggttatactggtagaggtgctgggctggccaggagcttacagggttacacctctcgcatactggtgtccacagagcagccatcttagctggaggtgtcgagtgcctcccccaccccccaccatgtgcttgagtgcacacccggcgccaggccctgatcctggcacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttcacaggaaaaaaaaaaaacacaaaccacacaagcgacacaacacacaccaccacaaacaacaaaaaggc

SEQ ID NO: 600942 - DNA, 1261 bp, Homo sapiens
  misc_feature (1207)..(1207): n is a, c, g, or t
  misc_feature (1210)..(1210): n is a, c, g, or t
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaactttagcaataggttnccngggattggtgctgtgttcacccggtccaccctccgggagggtggaaaccca

SEQ ID NO: 600943 - DNA, 1351 bp, Homo sapiens
  misc_feature (1213)..(1213): n is a, c, g, or t
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgaggtgngtctaagtcaaataatagggtgacctaaaccccaaacacaactcgggcatgctcttgtgttcactgacggggacctgagatgctagatggcatatatccacatttaatgtgtgagttcaccatacacataatggggta

SEQ ID NO: 600944 - DNA, 278 bp, Homo sapiens
aaagcgcagtattcgggtgggagtgacccgattttccaggttatccaagcccagaagtgttaccagaaaggggaccggatccagaccccaagagagggttcttggatctcatgcaaaaaaagaattcagggattggctgtcaacatttaaatatcaagatttcggagcggggcgcgatggctcacgcctgtgatcccagcactttggcaggccgaggtgggcagatcacgaggtcaggagatcgaaacacagtgaaaccccgtctctactaaacatgc

SEQ ID NO: 600945 - DNA, 1418 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttggtagcgtgtcagtccgtgatcctgggtagatagagcagggcagcgacggaagactgcctataggacattcacgctgggctggccaggagcttacagggttacacctctcgcatactggtgtccacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600946 - DNA, 941 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600947 - DNA, 1356 bp, Homo sapiens
tagggagcaagggtgcttctattctcgtgggactcgtgcgtaccaggcgtggcgtgggggtgcgtggaggtggcgaaggggaactccagagggagcaacaccaagaaggctccatagggcccagccataggccctccagcggccgcggcccggtcgcactgaacggcggaagtgtgtgcgcggcactgaacgctccgtggaagtgcggctctcagaagtgctgaggtgccccgtgagccccccgaaatggtctcgcggaagcgtgggcgcccaatattctcacccactggggaccatccaagcgggacagtgccaccaaggagaaaacaaggacaccttactcagcgcgaccgctgcggccagggcgtggggaccaaatacgagacgagggctgtccaccactctctgacgagccgggtggcggactccacaacgagcgcatttcccacgggacacaccaccctgagaggaggccccaacgcacacaggacggggccctcgcgccccccacgtagacggcgagccatatcgggcgccgcacaacgaggactcaccctctcaaacatagcggccgcacgaaacacacacccccccctagtgcaccgcagcgagttgacacacccccctagggaccaacgcccggtggctccacacacaacacaacaacgccgacgaggaattaaccaccccacgttgggcgccctacatcacagtcgagggaccccccccagagaacccccaccacacacgggccccccgtggagaggaccccccccgccgacaaacccaaagcgctcccccggccccgcacaacgcacacccctcgaggcgtgcaccaccacaaacaaggaagtggcccccaacacaagagcacagcactttgggcgggcccactaccacccgccacctcggccccaccctccaccacacaccatagacacagagagcagcccccgggcgaaaccaaacccaaacaccgcagccacactgagccatgagagcacgacacaacatccgcccaccacacaccccaacagagaccccctcccgacacagggacgaaacccacctgacacgcgcgcacaaccgggagacatctgacaacacccccccccccagtgaagaccaccaacccggcgccaccgcggcaacacaaccgccccaccaacacaggccaccaaagcggacacaacaacacgaaaaagtatcaggcgccccctttgaaaacgccccacgcaggcacagcggcaacccaacaatccaccatgctgacgagcccccgccagccctccccaccagtagccacgcaccaagccaccaaccaacgccggccgcacacactcgaggccacctccg

SEQ ID NO: 600948 - DNA, 182 bp, Homo sapiens
cactatccgtactatgcacaagacagcccatccctcacagacgaataatcatccacccaaagtagagaaaccctatactagaccaatacaatgggcactatgatgacagacgatacaatggacagagtgagaaactgctggtagactccacaccagacatcacaatcacacatctcttccat

SEQ ID NO: 600949 - DNA, 719 bp, Homo sapiens
  misc_feature (17)..(18): n is a, c, g, or t
  misc_feature (20)..(20): n is a, c, g, or t
  misc_feature (51)..(51): n is a, c, g, or t
  misc_feature (56)..(56): n is a, c, g, or t
  misc_feature (82)..(83): n is a, c, g, or t
  misc_feature (92)..(93): n is a, c, g, or t
  misc_feature (113)..(113): n is a, c, g, or t
  misc_feature (125)..(126): n is a, c, g, or t
  misc_feature (161)..(161): n is a, c, g, or t
ggaattcggtacgagcnncntgcttgggggccacgggcgtcggccagacgntcccngcgtgaaacgtgctgcaggatatccnnccgcgcggnnacggcaccggggcgcggggnccacccggcgtnnggcggcgactcaccctttagctgctcgggtccttnaccgcttcgcacagggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 600950 - DNA, 402 bp, Homo sapiens
gctcatcaatcctactatgcgattaacactgtttatgtatatggacaagagaaataattgtagtagcatgatatctcagaatcggaattacataactgaagctgcaaatcatttgtgcatgtggtatgcctggtctatgcattgtcagccaatcccaaatcctttgcacatcactgtgcccagtatttttcaagcaaccactttatggacagccagcacatacttgcttcatcgtagctgccaagtcagcacagcatgcaagttcacacacacatacagtcatttcacctcactgcatactagcaggcaaacacaactgcctccaaccccacagccttcccttgcactactgctgcatgcccccagtcaaaggactctcttctgtacattgacaagcctggc

SEQ ID NO: 600951 - DNA, 410 bp, Homo sapiens
  misc_feature (309)..(309): n is a, c, g, or t
aggctgcagtgcattaggtgagagaaaataaattaaaagcatactcattggaaaggaagaaataaaactgtctctgtttggagaggacataatttgtctatgttatgaaaaacccaacagaatttaagagactatataatctgagacttatgtaactgttgcaatgatacaagtctcaattatgcaacaaataacgctgtatttgcattacgtaataagcaattggacaagtgaaacaataaacaacacaagttacttacaatagtcaccaaagaaatataaatctacttcaggaataacgcctatcanaatatgtatatggatcccttactactaaaaaactacaaagacacaagattaaataaatcaacagaatgccataaaataatatagagatgaaccattgttca

SEQ ID NO: 600952 - DNA, 1139 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttcacaggaaaaaaaaaaaacacaaaccacacaagcgacacaacacacaccaccacaaacaacaaaaaggc

SEQ ID NO: 600953 - DNA, 393 bp, Homo sapiens
  misc_feature (65)..(65): n is a, c, g, or t
  misc_feature (92)..(92): n is a, c, g, or t
  misc_feature (96)..(96): n is a, c, g, or t
  misc_feature (162)..(162): n is a, c, g, or t
  misc_feature (363)..(363): n is a, c, g, or t
atcaaaaggttccttttaccctttttgagaaaggaaaatcctaattgcttcctagaagccagtgnacaatgctccacttgtgcacataggtnctcntggatgaatgcctattatagtgtccatatctaaacaatgctgcaatcacggttgtgttagctcccnttatctttgaaaaaattaacatatcattctctctcattgatgctattgtatgagagaagacaaattaccatctatgaaaaacagataaagtcattgagtcatagaaaactgacccactgaaaatactggagctaaccagcatctatttagggctagaaatcattttggcagatcccttgacagtgacacttctcatgcttngtgggggaaggttgggaattaaaggaaaat

SEQ ID NO: 600954 - DNA, 389 bp, Homo sapiens
  misc_feature (74)..(74): n is a, c, g, or t
  misc_feature (109)..(109): n is a, c, g, or t
  misc_feature (135)..(135): n is a, c, g, or t
  misc_feature (190)..(190): n is a, c, g, or t
  misc_feature (238)..(238): n is a, c, g, or t
  misc_feature (247)..(247): n is a, c, g, or t
gttaattaagtctctgggtgccgagaaccccgaggaacgagcttcgtcatctgcggcctgtccctgcttccacnccaggagcgagtccctgagatgaagtcgggagacngcatcccccgcccccctggctgcggncagtgagctgcggggacatggtgggcgactcagcgatgtacggcgtggtctctgnaactccggaggcccgttctgttgctgatgccctgctgctgggtactcntcgggcgcntagcggaaatgtgccgaagaaaattctctctggcggtcggagctgtgccggctgccgtcgctgtctgtgtcgggcgagctgtggccggggagtgcccgctcggcacgcgcaggaacctgcgcgccaccgcggggggcaggtc

SEQ ID NO: 600955 - DNA, 327 bp, Homo sapiens
ttcggccaggggcatcagggactgcgcccaggtcatgaggtccttgcgccgacgcaccggcagcagatgctgccagttgtagtaggccggcagatcgaactcgcaggtgccgcccgggatgctgatgcggctgcggatgctcatcagccagtcgttcgcggtcagggcggcgccggtcttgccgctcagcgcattgagccgttggtaggcgccgtcgatgcgcccgaccacctcgtccaggcgcgattcgtcgaggccggggctgccacggtaggcgttgtattgggccttgtgcttttcgagctccttgagcaggtcgctcttcag

SEQ ID NO: 600956 - DNA, 950 bp, Homo sapiens
  misc_feature (222)..(222): n is a, c, g, or t
  misc_feature (410)..(410): n is a, c, g, or t
atgtaacgacgattgaaaagattgccacagatcaatcataatgcgactcatggatagtcaagaaagcacgtaatggttatcgcatggtaagacatgagctgaaaatgagttttgatagattgagaggacgtgtagttcggtagtacgttagtgatagataacattactacgtttgtgaagtctaacgacgaatagtgtatgagtgacagaaatgtacttttnatgtaacttaaagtggtgctgttcagatatgcttagaggtgtcatgatatagtatatatatcttgttgaaattagcgatttatgagagaagactcgaggaatgcagatagtgttgttcagagatatacgaaagagcctgttatattttacatttattggaagacttgaaccacatgaaaatgccatcnttgtacttaagaatacgtggagtactttatttgcactgattaagagtaagatagtatgttaactttgttctctgctgagtcaatactgttgctaatcatgctagatgtgataaagtggagattattagtgaatacaatccaacttctttttttaacagttgagattcaatcgttgacctttatataagtaacagttaaattgtaatccatattttgttcagaattcgcatgatattttatcggaaggtcgttaaaaaatgtatgtctgtatgatgcaccaatataattattagatatatggtgagatctggcaagtttaatctaccatcagccattagatgatgcattagtgtagtacattactgtggtatgctaagtgatggtattaagcatgatgtagttgttcaaatgaatattcttgaatagtgtatgtgaattaaacaaggtaatgctatcgctgagttggcagagtttaaaactaccgggttaatataagggagttggaggaaatatgtttgttggaggaatggctttggaata

SEQ ID NO: 600957 - DNA, 432 bp, Homo sapiens
ggcctcccaaagtgctgggattacaggtgtgagccaccaagcctggctgggattctgtgtcattctggatagttatcatgacttcaagcatccaggactctgtcctgggtatcctgagcctgagtgtgtatgtgtgtccagctggcttggaggttgtctacaggcaggttgaacttggcctctgagtccatggcagccttacatgggaaataccaccaaggagcctcatcctgtgcttttaggagatagtttctatttagtcattgctgaatctgttacagacagggtctcaatttcttgcaagtcctgtatgaggtgggtgctgtgattatccacatgttcacttgttctctctagcccctttcaggctcttacacttcctttgctcttttcctgcctcaaggcctttgcacatcctgctctttctgcctg

SEQ ID NO: 600958 - DNA, 289 bp, Homo sapiens
gaagaaacagagcaatgcagaaacaataactatatatatttaaaaactgactgggtgcggcggcttatgcctgtaatcccagcagtttgggaggtcgaggtgggccgatcacgaggtcagatcaagaccatcctggccaacatggtgaaaccccatctccactaaaatacaaaacattagccaggcatggtggccatgcctgtagtcccagctactccagaggctgaggcaggaaaattgctggaacccaggaggcagaggatgcagtgagtcgagactgctggcaaca

SEQ ID NO: 600959 - DNA, 177 bp, Homo sapiens
ctttggaacgaggaattgggagattcccggagtcagggtaaaaaatttttgaccaaatcggagatattttaggggtgtggagaaggggaagggaggaatgggcccccatatttggccttccaggaattaaggagccttcctgtaatatttctttccaataaatattgctttttccca

SEQ ID NO: 600960 - DNA, 929 bp, Homo sapiens
ttagtagtggtcgcccaccactactagtagtggtggtgctgagtagtactactagctgcagctgctgagaggtagtagaagagaagagagtagtagagtagatgacgagaagagtagatgagaagagagcagacgacactagtagtgtcgcgcacagtcagaggagatagagagagcactagacaccagagagagagtagtagtagtagtgtgtgtggtgcgccccacctgctgcgagagcacacgcgcacacgctctgtgagagagtgcgggtgcgcggtgtgagagagaaaatagtggacacacagcagctgataatagtggtgctgtgtgtggtgtgtgagatacatacatagtagttctactcccgcccgcgcgagacagtactcacccgcgctgcgtgtgtgtgatgtgagagggtccctcacgcgggcgcgggcccacacagagtattgagtgaggcgcacgcgagagagagtgtgcgagacaccacacctcctgcggggcacacacccgcggtaaacacacgccgcctccccatcctgtacatagaacaccaaacacccaacagtgtacccgcggcccgttgcggccggggccccgcaggaggtccccacgcgttgttgggggacgcgtgagcgcagcagtaaatgggtggtaaacccgcgcggaccgcgcgaccgtccccgtttgaccaggaagtaggcccccccccccccccccccgggcgcgaaaagcaacaacgtgcgtgctcccacaaaaaaaaaaaaaaaaaaaaaaaaaaggagaactcccccccagacaacgaaaagaggttaaagcccaaacccccaggccccccaaaaaaaacaaaagaaaacaaaaagaataaaaatacgctgagcagatatggctgggtcgagaagagaatgattcccggcgtggttggg

SEQ ID NO: 600961 - DNA, 223 bp, Homo sapiens
acgcccaaggagggagtatagcggaaactcatcttcaagcaggtgagctcacgaagttccagaggtctggggcttgtgactggtgtctgaagaaggggggcagtcttggggacctgaagccttcaaacctgtgggattctgatgttatctcccggtagatagtattgggattgaattacagaacaccccagctagtgtccactggcagaaatttgattgcttt

SEQ ID NO: 600962 - DNA, 1503 bp, Homo sapiens
  misc_feature (329)..(329): n is a, c, g, or t
  misc_feature (430)..(430): n is a, c, g, or t
  misc_feature (1245)..(1245): n is a, c, g, or t
cacgtgaatacgggtgtgagtaacatgagagaatgcataagtgaagtggaatagacggaattcacctaggttaggaacctattttcgatacacgtggactcataccgagtggcgtgatgacgtgtgaatagtgggagacacggagaaataaggtctaggatggatctaaccgagaagctgagactctgaaggagtgtgatatttctcctatcattaaaggcatttaatctagacaatatgagctattgtaccctattgactatgagttaagagcaatggcctatgtcagagtgagatcttctcatatgcgactacggaaggagtcagtnatcatcgcgtttggtggtggtacgtaagatatagagtctacacatctggggcggaagaactaggtacgtatatggatcacattggagagcacctaaggganaaatctctgaacgtggttgatcatcattatctagatccttcatcgtttccgtgctagaaaaaatgaacttgtgcaaccgtttcatgttgctaagaagaactggtagggttaagtatgatttcaccaagaacaaattgatgtgttccacaaattgaatttaaccttttcgcactttggggaaagcaccctgttaaataaattgtttgggtataaatggataaatcaattgggtcaaagaaaagtaatccttgtgtaatcgcaccccgttgttgtatgttttacccacatattccatacacgttacaccagcgtcttacatcctgcggaggacgacacatggcaacaacagggacaacggtattgcaacgcattccaactttcatgggtgcatgcgtcttgttgtacatccttgatggaaccgtgcgtgggtgccccctattagaaaccgtaacttgtgtgcgcgggcactttcagtcgccagggcacggtaacctgttcttcatggcttgaaagtcgccccaaatccaattactttgcaaaccgaattgtataattcccactctaaaaaccataccttggcgtaattctgcaaagggtcagaatggggtcgtccctccccagaacgcacttacaccgcaacagacataggtagcgcaacgaattttggtgggcccctacgaaatctctttgccactttacattccttgagttaccccaacagtgggacctctgggatgggaacattaagcgcgctacctcaccgtggagagtcgtttgcacacataacagggtaggccgtttaacaactcttgganacacgtgcgacacgtgtttcacatacttttccaccggaaggcatgtaacactctttggcgttacccaagtacggtggcttggcttccttggtcgcgaccctggaaggaataccaaaaggtgccagaggcactctcggacactttcgtggccgtattaaaaccctgaatcttgcagacgagtgcgctcacatgggtattcgtctacgcagaaaaagatctggtggaaaaaacagcatttgagcagacaagttagagacc

SEQ ID NO: 600963 - DNA, 192 bp, Homo sapiens
gagttgggcagccggagggggggccagcggcgcccgcagccgcccactgtttgcaaacggcccccgcttcggagcgaaggggagcaccctgccttcggcagcggcaccctccccgggtttggagaggcgagcccggcttcctgcgccccgctccccgtccgcatggatctgccgcccggctcggcggccgct

SEQ ID NO: 600964 - DNA, 366 bp, Homo sapiens
tttttggttcactttaatttggccccagaaccctttaaatccccgtggaaatttaattgttggtccaaaggggaacagttttttggccattaggaaaaacccttgtagggagggtaaaaattttaccccccatggtgggcctaaaagcagcccccaattaagaaggggttcagggtcaaccccccctccttaaaaattcccaaacatataattgaattcctcccccccaatggggccattttttccccctatagaagaattaaggttgggatagggaacatgaaacctttttcctcgggataggccggggtcggtttaaaaccttggattgccaattaacggcccaatttttccaatcacccccca

SEQ ID NO: 600965 - DNA, 208 bp, Homo sapiens
atcccctacaatagccacaactgaatggaaggagtgtacgtgtgttttgaagactgcaacggtcaggcgcggcgggtcactacctgtcatcccagtcactttgtgaggctgaggggggtggattgcttgaggccaggagttcgataccagcctgggcaaaatggtgaaaccttgttctctactaaatatacacaataattagccaggt

SEQ ID NO: 600966 - DNA, 550 bp, Homo sapiens
cccccgccggggtctccaggctacgccgcccgcccgctcgcgaacgtcaggcgccttcccggctctcccattgcctgccgccaatgttttttgcctccggtgggatggctgcatggatggcctccagggcggggcacggcggcaccggcaggccaggtagtggcgtgtagctctcaggccccatgtggatcgccgcccgggtggcggccgggaatggcacggctcgttctcctccaggggcttgcgcaggtcggagagtccccggtacagtttagcgtggtccgggattcgtgcagcccgtggacgctgtctttcccgtgccctgtgtctccgacggcggacctgctggagctttaagctcccaccttcggttttagtactgggcgcgggaagttgcaaaatgccagaatatcgcaaccatccccgcggcccgccgggtttgcaaagggtgccccggccaggagcgggggctcggggcctgcgtccagtcgcgtggcggctccagcccgactgcacgtggactcgcgatggggtgggggtggccacgcgg

SEQ ID NO: 600967 - DNA, 208 bp, Homo sapiens
gctatataccatgagttcgcgaggaacactctggcgatcttctgaccaggatacccctcataggacagagggaaatcccaataccctgctgggtgcgacactgtactgtgtcccaccatgaggacacaagcagtttcacccagtatcccatggtgcttgcggaaaatcaaagccctgcgcactcaggtcccagctagaaattcccaca

SEQ ID NO: 600968 - DNA, 882 bp, Homo sapiens
  misc_feature (1)..(1): n is a, c, g, or t
nacccgctacgagtcgttgtctgttccctacgctacgtgctgtgagtactagccaatcagatccttgcccgcagccctagtgtgtgcctctttccaaatgttttgcgcgcaactggttctccactcgtgggccccccaccaaggggtggcccgccgtataggttctcccccctttctaggcgtccgccttcccagggcgagacactttctctgccttgcgatcataactgtgctgccggggacacaaccagtcctcccacgggggtgattaactaccacggcttttcaccctgctgggggcacaaacccccacccccttttcagggataaacccccaggttctttcggccccctctcaggatgaattttgccccgcccgcccccacgcggttccaaaacacgtgacgcctattgagaccgtcacctgatcacgccccatggtgtgagagcccccttctctccccccgggtgatgtaacttaggcgtttcgccccattggggcttgacagacatactacagcggtcttatttggagttcacacgtctccctgtgtattgccctccctctcggctgcacactttatctgtgacacccctcggcaggaacctccggggagggggacctcttggcacaagtttgtggcctcttcctgcctccgaccccaatgtcaaatcgtgatgcgcgccttccacctccgcacaaaccccagaaggtgttgattgccttcgaggaccccgcgcaactgatgatggacagcccgcctcggcgacgtacacctcctctacgtcgttctccctcggggcccacgtgtatcccggttatcttctcagcccgccgctagtttgccgcacaaaaaactccaacgatctttttacaccgga

SEQ ID NO: 600969 - DNA, 151 bp, Homo sapiens
  misc_feature (136)..(136): n is a, c, g, or t
  misc_feature (150)..(151): n is a, c, g, or t
tataggcgctaggttatttcacagcatgttttttatgtaaccggttttaccgcatcttctcagcagcttctgaccacggctcaattttctcctttacagccatggttctgggtggacacaataaccataggcaccnataggcgcctctann

SEQ ID NO: 600970 - DNA, 612 bp, Homo sapiens
ccctttgtctagtcacgttactaccatcagttagttatggtggtgtctgctaggttgtttctttgtgaagttactcttttaccacttggaattagtaagtatcctgtggagagttactctacataaatatcctttctttgttttgttttgttttgagacagagtctctctctgttgcccaggcgggagtacagtgacaggatctcggctcattgcaacctttgcctcccagtctcaagcaattccactgcctcaacctcccaagtagctgggattacatgtgtgcaccaccatgtttttgtatttttagtagagacagggttttgtcatgttgcccaggctggtctcgatcctgacctcgggtgatccatccaccttggcctcccagggtgttgggattacaggcgtaagccactgcgcctggcctgtttgcttctgtgaagagacaaggtctcactacgttgcccagctggcctcaaaatcctgggcacaagtgatacttctgcttcagcctcctgagtaactgggactacaggcatgtgccactgtagccagcttattattattatttttactttttttttatgagacgttgtctcactctgtggctcag

SEQ ID NO: 600971 - DNA, 205 bp, Homo sapiens
cattcgtagcccaattacgctgaatatctgccacaacggcttggcggaatggcagactggcatatacttcttttttcagttccttttcagttaaaccactatccatatcgtgttcaaaatcagtctcataatacgtcacatcaacccaagggcgttaccgtcaccgatagcgtccttattcgtctaccggtgtcaccgcggcccg

SEQ ID NO: 600972 - DNA, 130 bp, Homo sapiens
tgtacaacgatgagaacgctggcttttagagtcgcaaagtttcagaatgccgtgcagccaatggttttatcttctggagttaggtggaggaacgctgtgtctaagatgagactgcgaacgtcactgacat

SEQ ID NO: 600973 - DNA, 119 bp, Homo sapiens
cctgtatcccaccctctgcaagcagtaagtgattaaaatacttactcctcactttctactattcctcctcctcgagttcttcacttagtagtgaccaaccaggcaccaggcatcttgaa

SEQ ID NO: 600974 - DNA, 1012 bp, Homo sapiens
agatagtgccatcgcactccagcctggacaacagagcgagactccatctaaaaaaaaaaaaaaaaaaaaaaaaaactcacgttttgggttttggaaaatgttctgaaccctgtggaaataccggctgaataaatgggtaatacccactctagggcttggtttcaaaaaaacttgtccctgtcatttcggaattggtaaacaattatgttttggccgcttttctcacgaaatttcagttcatttttctccagtggtttcagtgaagttcattcctttttaaaagaaaaaaaaagaatccgtggtaatttcgtcgtggttcctctgggctattacctcctttatagtgacataaagtttcccctcatttagtggggttaccccacatttacggcgttacgaagaacattctcttttagttccagaaaaacagtagccttgggttcagttctagccttcatgtgggttaagctcatagggtaaattcgggccaaatcggggctagaaaaccagttccccttgtttgtggctgggtccttaagggctctcaccttttcccagctatttggggattgtatatacttcgggcttccttgggtgcggtgtaccatcttactttttgtttttggcactaagctgtttgttgtcctcccaaacttcttttttgtgggaacgccgaaattggtaaactcacccctgttaaaccttaacactttgggaaggcctaggtgggcaggaaatgctttgaatccggggaagttcaaaccacgccgggcactgttgtcgcacccgctctctacaacaaacaacacactttattgaccggtggtggcataacgcgtgtgcccgataactcgaagctccttaccccaattgacagtgcgttgccctattgccctggttgaaaacaccctctttcaaaacacatgtcctgtgagggccccgttaccgaaagagcggcgtgcactgctgattataccgcccggaaccttaatacacggtgagccgccagcgc

SEQ ID NO: 600975 - DNA, 169 bp, Homo sapiens
  misc_feature (110)..(110): n is a, c, g, or t
  misc_feature (132)..(132): n is a, c, g, or t
  misc_feature (148)..(148): n is a, c, g, or t
  misc_feature (169)..(169): n is a, c, g, or t
attcgcgggcgcgtcgacacatgagaggatcacttgagactgggagattctgaggctgcagtgagctgtgattgcaccactacactccatcctaggtgagagggcaaganccctttgcttttccccaagggncaaaaaaaaaaaaggnggggaaataaaaaaaaaaaan

SEQ ID NO: 600976 - DNA, 496 bp, Homo sapiens
  misc_feature (25)..(26): n is a, c, g, or t
  misc_feature (33)..(33): n is a, c, g, or t
  misc_feature (36)..(36): n is a, c, g, or t
  misc_feature (38)..(39): n is a, c, g, or t
  misc_feature (41)..(41): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (58)..(58): n is a, c, g, or t
  misc_feature (124)..(124): n is a, c, g, or t
  misc_feature (494)..(494): n is a, c, g, or t
atcgccctgatgctaaacggtatcnnctgggtnctntnntntggcncancntggcganacatgcccagaaacgattcggcccttggtcaacgatctatcaacggttccggggatggcgtgattncggagcttttgatcagatgctcaagcgtcttcatatccgattgaatgagcagggtttgattgacttggaaacatggatgatcgactccactgccgtacgagcaacccgggcctcatcaggtgccgggaaaaaaggggatttgaagaaccgcaagaccacgcgctcgggcgcagccggggtggcctgacgaccaagattcacatgctgtgcgacgccaatggtgtgcctctgcgtttcctgttgtcaggcggacaagccagcgatatagcctatgcccacccgctactcgatcaggcttgcatacccagacagcgcggtcgcccacgcaagcgttgccgctggttgctggctgacaaggggtgtgctttcnca

SEQ ID NO: 600977 - DNA, 304 bp, Homo sapiens
ccatttcatgttgcccactggcacggcagggagacttctatgttgccttgacgattgacaggacgacagagtcggaacatggcgggcgcttgttggagggcccttgacacccaggtggattggcccaagcgacgctgacaccaatgaagtgaccccgagttcttgtaagcttggaagtgaaccctggcagccggggaggactccgctggcacactgccacctggggcgaacagccgggctgggatgacggtgacccccgacaggcacagcacagccgagtcaggccacgcccccttgagactgt

SEQ ID NO: 600978 - DNA, 1426 bp, Homo sapiens
gctgctggagattatcacgaccgagaaaacttccacagacaccagtgcttacagctgtagcagtatggtctcaagcaggggaaggtcatcattgtggttaaggatggacctggacttctatactaccaggtgtctatgcgcccatgatgtctgaagtcatccgaatcctccaggaaggagttgacccgaagaagctggattcccatgaccacaagcatttggcttatcctgtgggatgccgccacactggatggatgcaagttaggtagtggatgtagcagaaacatgtggcggacagatactgggacaaaagactaaggaggcagcgcgcctggcagcgtagagaacaaccaagaacacagactcgcacgacagcatagagagtcacaaaagggactaaacataacagtcacgtcacacatcaacgggcaagaggcctaaacacaatacacataccagagcgtcgtgacagcaccgccacggactacgcaactaccagacacaaggactacgcacatcacccaccagacgctccaggacagacagcccaccgataaaaaacctgacaacacccactacaagaccgacacgcaccataccacgcaacacagaccagagaggacacaaagccataaatagtgacaacaaaagagacaaaatcaatagatagaacacacaaaacacagggaaaatacaaatagagaaagcacacacataggcaaaacaacgaagaacaacaagaaacacaccgaaagaaaacagacaacaaaaacaaaccccgcactaagcaaacgaaaaaaagagaacaaaagaaataagaagaacaaccaagacaaatgggacaaacacaggcgaacaagaacacaagtcggaacaccagagaccacccaacaggacaaaaaaatgaccacaacaagacagtgatggcaaaccaacacacaaatcacaacaacaatggatacaaacagaactacacatacaccaaaaagcaaaacaagaccaccacaaagaagaaaaaataccacaccaagaagacagcccggcaaaacagaaacaaccgacacaacaaagacagataaacacaacaatgacggacaacgaatgaaactcaacaaagaaggagacgagtaaaagaaaaaagagaaaacggagcgaacacacccgaagacgcagaaaaggcaccgacaagagagtagaacacactacagaacaccacacggcacacgagagaacacaagatgaacacacaagaagagcagacaccgaccggcaacaagaaggaaacgaggacgagcaagacgcacagacaaacaaaagcagcggatgcagaaacaaaaccataaaacagtagaacaaagaggaagaagagaaacacagccacaaagagagaaggcagtaactcacctacaaataacgacaaagtaaa

SEQ ID NO: 600979 - DNA, 386 bp, Homo sapiens
acggggagcatgaccttgcagtagcacaggttcagacactgttgagttttaaacaggtagtaattcaaaaaacttaacacaccaacaaaaaaatcaggagtgtacgtcagaacattgtgcgcttcacactcatatgatcccagcatattgataggccctcgcagtcgaactggttgactctaagcgatcaggatacgcctgggcaacatagtgagaccctgtctctacaaaaaaaaaatagaaaaaagaaaaaaagaaaaaaaatagctgggtactatggcacacctgtggtcccagccacttgagagcctgaggtgggagaatcacctgagcccaagaggtcaagatagcagcaagccatgttcatgcctctccccgggatacag

SEQ ID NO: 600980 - DNA, 226 bp, Homo sapiens
  misc_feature (75)..(75): n is a, c, g, or t
ccacagaacctctaaatcccttgtaattaactgttagtccaagaggacagctctttggacactaggaaaaacctngtagagagagtaaaaatttaccaccatagtaggcctaaagcagccaccatttaaggaagccgttcaaggttaacacccattacctaaaaatcccaaacatttactggactccaacaccaattggcccaatttttcaccttgaggagactat

SEQ ID NO: 600981 - DNA, 949 bp, Homo sapiens
tcggcccctctgccgtggcgcgcttgttggattccccttgcgtcccttggctatgctctggctctgggtgggcctgttgtgtgccgtgtttccggtgtttgtcgggccttgtcctctcgtgcttgtttttggttttcggctccttggtgaagtcggtgtgctccttcctctagttgccttgctgcctcatggtgcttgggtcctctgctgccctggttgtttctttaccccatatgggctgtgtgcgggctctcggtgttcatctctgtttgctttgagcttgatccacttgtgcttcctgcttgtggtgaactgtcctgcgtgtcatcaccgtcagtggatgacggactggctccgtcttgtggcgtctgggtctggcacttgatgggtctggtgcctgtggggtatacctcccgttgttctgtgagcccttgggaccctgttcctgctgtatgtgtctccgtccgtgtcatcttgggttatggaatggccagtgaacacgcatcccagagagcattttccctgctgcgaaatgacgtttcttgcgccacgtctgtttgctgctaatgattgtatagaatcaactgttccttcttccctcctgatatcccagcctgtaatggtgagaatgctgctcttgcttccaaatatatagataaacggaattgccctccagggtaatccctgttgcctttttcccgtctatataagggaatgtcttccttcctatctatctgcaaaatggacaatctagacctccttcttcatccataagtggactgtgccagtacaatacatgctctcagcccccaagcctagaaggacctctagtctccttgcctgtgtggaatcttccccactccatccctcccaagttgcctgtagttgataatgtactcactcatgctgtactaggtgctgaagcctgacaaccttcgtgggtgggcct

SEQ ID NO: 600982 - DNA, 1319 bp, Homo sapiens
  misc_feature (338)..(338): n is a, c, g, or t
  misc_feature (664)..(664): n is a, c, g, or t
  misc_feature (689)..(689): n is a, c, g, or t
gcctctctccagtggtccacgttgatctgtgccctaccgcgctccctggtgcttaccgtgaccacgtctagactctatcgctcgtgctgtcatccataagctcgagcgactcagtcctattatcatcctcttagacgatggcatcctctcgcatgatccgcgatctagcctgcttagatgccacagggaatccagagggcagatccgatgaaagctccacatactctctccttgaggaatcagtacatacatatttagagacttatcttagtcacgtaatcacttgatttctagtaagctcgcgagacgtcacgtctacatgatagtggctttcccanaaagcggcgatcgacaaggacgtatcacagaaattgattctcatatctcagggggcatgaagagtagatgagtcgcttagattgaagccaaaagaaaccaacacaattcgaagtgtctgcatagttgcctctcacagaaggcgacttgagccttgatgatcagactagagccacagagacggttctgtgcgaaggaaccacatgtcctgtgccttcttactagtcacagcgaggcgagaaatggtgagtgacactaatgtctcgcttcttgcagatgtgtgagagtgccctgtcaatctctgacatctatccccttgtgtgacacnttgtgtgaccttgagtgcacccctntggttgtagttggaaggttaccaggccatcgaacccgtctcgacttcgagaatagccacagtttaggacaacttagtagctttggacaggctacaagatttgtgtgcaaaagcgaattggcgcccaacatgtgggtgtttctaactgagaagccaccccccacctaggaagaaacttttacacaatatataggaacacaaaagtgtgcttacttagtggtataaattcttactcttaccttaaaacaaggatcactacacccaaggacagggttccaaacctactttgtggttataatttgcgctcagaacgatcgaagtggctcgaacatagtggtgttgccgctacaaagaaaaacctttgtgtgtggtaggccatttaagaatagcgcgaaggggaaaattggggtatccgtcggatatgtgcttagggggttaggcctcaattaggcgtcgcagcgcaattcattacatccttcccccttggctacggcgggtgtacggacgtccaatgggcaacaggtcttctggggatatagacaaggtctccgggtggggcgtttgcgccaaggaattccttatcccacttggctgtgcaattatgtttgacctctgtccttttttgcgcaca

SEQ ID NO: 600983 - DNA, 349 bp, Homo sapiens
  misc_feature (151)..(151): n is a, c, g, or t
ggatctactcacaacagtcagtcgtcttaaacatgggcatgtattatgtcagatgtcactggattctacgagcgctaagggagtaggatgcccgatcacagcagagccaaggttgtacacggcacattctccggtcagccggcgctggtgnaatcacaccggacgtggctcgatgtagaagtccccatcgccgtcgtacccaccctggaaggtgtacagcagacgcccattgtgacctgagtcccggtccgtggcagagaactggagcatgctggtcgagggtggagcatcctcaaagatggaaccctggtagaaatcccacaggaactggggtgcattgtcattggca

SEQ ID NO: 600984 - DNA, 245 bp, Homo sapiens
  misc_feature (10)..(10): n is a, c, g, or t
  misc_feature (66)..(66): n is a, c, g, or t
ccaccgcgcnggacccaacaggacactgaagatgcctagttattaaaagcttctatttcgaagggngctctaatgtaaaagagggagcagggttttccagaagctgaaatgattacgcaagaaagttagttgttgctttgtagctacaaataaaatttggtgagttcattaaaaagatgtttccagccaggcgcagtggctcaagcctgtaatcccagcacttcgggaggccgaggcaggaggat

SEQ ID NO: 600985 - DNA, 116 bp, Homo sapiens
tttatttacatccgactgccctcggctcacttgaacgtatctgagaagtctgtcaggccctcaaattctgctacatttcctagttcgcaattatatatcttgagcttggaatagcc

SEQ ID NO: 600986 - DNA, 837 bp, Homo sapiens
gaataatgacagtatagcacaagctggtcttgaactcctgggctcaggcaagttctcccagctcagcctcccaaagtgctgagattatagctgtgagccagcgtgcccagcctgaagctagaggctgtcttgaatatgtcgttactctctcagttgggtctaggataagagtctgaagggaggggctagaaagtttcaaaggcggagaaggttgcaaaggcatcatgtgaacaaggcagcaaacagcgatcaagccccatgacgaagggaaccatccatagactcgaagtgatgcctattcgtcgaaattgtaggaatcgtcttcgtagctatacttatgattgaatttcagtcgtgctaaatagcgctaaatgctaggttgagttggcgcttctgggcagtcaaattgcagccgatgaggcctttcacgtgcgttatgaatgaagtcgggatgaaaccgatgaggaccagaggatccttctcaccgtgcacaatcaaggcggggcactggacccggggcagcaggtgccggcagatgttaccatctgggagatgtttaaactgtcttatgccatccacccacttttcacaggttctggcaaagtagtcatacccatagagggcttctagaggctttcttgttctctcactccatttggaaacatctcggatgccctcatatatcatgctgtcttcgtcagtgacgtaggcgttggcgccccagatcaccatcttgtggatgtaagatggatatattgcagcagcaatgagtgcggttatgcccccatcactccacccaagcagagaaagcttcttaaacttcagcgccttcatcaa

SEQ ID NO: 600987 - DNA, 719 bp, Homo sapiens
tggggttgagcacaggttactttattggatggtacatgagaaggtgcggccccctaggccccccccctcttcaaggggtctacatggcaactgtgaggaggggagattcaggtgtggtgggggactgaggtgtggcagggacctccccagcaggtgagggtctctctcttcctctggttgctcttgcgggggcgtgggtggctccaggggttcttactcctgggaggccatgtgggccatgaggttccaccacccgtgttgctgtagccaaattctcggtgtgctcattcccgggaaatgtgagtcgttgacaaaggtggctcgtgtgagggcaatgtgccagccccagcgtcaaggggtggaggaggtgggtgctcgcgtgtggaagctcagaggagaccccctgttgggtgcctcaggtgttaccccaggtatgcccttgagggggccctccgacgcctgtttcaccaccttctgtgatgtcatcatattgggcaggtttcctagaacggcaggtcaggtcccccactgacacgttggcgtggggtgcgccggaaggccttgccagttgagcttccgtacagctcggggttgacctttcccacggccttggacgcgccattaaagggccgatatattttctggaaccccgcgccatcggccactcccgggggccccagttttggtggagatgcagacggcaagcctccagacctttg

SEQ ID NO: 600988 - DNA, 247 bp, Homo sapiens
aaaccatcctgactagaggagcagtgagctgctcccagcccaacatgactatcaagaaagacattgagaaggacagccccaagtgtgagagataggacatggtacatccatatagtcacttgccctctggcttgggctcctttaactggctggggcctgacacccgttttgaccacattgctatggtagagaacgagggcctggaggcccagaagttgctgccctacccaccgacttacccccggcc

SEQ ID NO: 600989 - DNA, 780 bp, Homo sapiens
gggcaatattgaggagtagcagagtttgtatagagaagaacggacaagctagatgaagtccccgggaagactatcaaagtctatattagtttaaagagtccatgcgaatacatcaagtcaagagatagcattgtatgagattatccttaagcaaattgaagcaacgtaactgaaagatctaaaagatagacgattgttaggtaaactgtaaaacgactctatgggaacattggttctccgacccttttgggactctccatcggaaaatttccacgatcaaacacggaattcctctaccgggctcgtactccactcaatttcgttcaagaatccaacatacataacagataaccaaagataacaaaagactttatcaagctgacttggaattgtgtgctgcttgctgttagtctacggggaaaggccactgccaatgatttaacttttaaaagcatcttatctaaaagaaaggctatccagtagagcccagtgctcccttgtccctcttttaatgatcagggcgaaatgtacttcctgatgtaatgaaccgtaatatctgatttccatgtcttataggtggatgtctgtgcagcatggtcgtccaccgattctggctgtcctatgtctcaggaagaagcccacttcgttgaggctgaccttcctgatcatacacacacacagcccagcaaaagcatctcctgaaccgaaaccaacctgttggttgggagactgcccagacatgattgatgacgggttcccgcctgctgtccccgccttgaa

SEQ ID NO: 600990 - DNA, 547 bp, Homo sapiens
agcgggaaggggctgcgaacgcgaactgcatgtaggaggtctcaccccgagcgagggagctggcggacggttcgtcctcgtccttgtgggtgtgaccgaggtgtacgcgctgcaggcgtgccgaaggacccagcgggggcgatcggccacgaatgtggaccagcctgggtacgatccgtgccccggaaggcagtacagttagacgcgtgcgaccgtctgggtgggggccggacagggcgtgcggggggagtccgccaagagtgaggaggccctgcgcgtgaatcggatgaagacgggcggagcgagagcgcggagatgccggaccgcggttgcgcagtgcatcccggtcgatgcgatcctcgcttgaagcggaggcccgaccttcatcgcatgtgagctgcgggattggaaacgtgctgtggatgaatgccgcatggtattacaccggtcaacttaaatccaacggaggaattcccaaataatgttccagtcaggcaaagtcgccaaaggagggcatttacgcaagtctagactacaggagacagcg

SEQ ID NO: 600991 - DNA, 1258 bp, Homo sapiens
agcggaggttctcgagaccttgtgctccggttgggccacttgcactcccactgcctgcccgtcctggcctgtctggaccagggcccccccgactgtcccatgtctccttgctccgaagaatgctgtatcctgtgtcccgcgtggcgggctcgccccgaggcaacggttgtgcgcggcgccgacagaatgttgctgcgagtgtggtgcttgacggtcgctggggcgaagtcgaagcgcttgactcgcgcacctggtggcgcggagcgccgtcgctccgcgctcgtggggctccttggtgactctgttgaatcctccgcgcgccagagcccgggaggaccgaagggtggtgttgccacgctctccttccagtgcatggttctcccatgatgcgggcccactgctcgcggctgtgcttcttgcgaagcgcaccgcggcggttcctgtacggcagtgcggagctgggacacaggacaccccgcaggctgggtgcgaactgttgcatgccccgctgcgttataacgcctggggggaaggcgagctcatcgcagggcgtggagcctacagccgggcgggtgttcccgcccttgctcggcacccatagcgcagggcgataaccgcttctcctagaggaggggccctcgggaggacctcgtatcccttccaaattggggctcccctccgtgagggccattgccctctctagttaacgctcacctaacatactctagggcaaacgcgcagccggccagagggagggtgctcccgcaaggttttgctttgcttttggcacccgataaccttttcctcaggctccatgtaggagggcgcaccctgtgtggtcccacagaacgcggcattctaggtgggttttggggttgagctagcggaagcgacaaggcggtaccctctgtcccggacggtatgcagagttgagaaaacgcttggcgccagctttagacagttgcggcaccgtttgaagggaagggggcccgttgggtggcctctgtaacaggcgggactacgttcggcatccgcacggggtaagagcttagagaaacacctgtgccttgctacaaggaaagcgttggcgacacatgtcgcgagtacatgtttgacggccacggaacgaaaacggagctttggcaacggggacaatttcaatacatttaggtacccttctccaccaggttaaaaagcgcggaacgaagaattggcgccggaaagacactacttacagcaagcgggaagagctctaaac

SEQ ID NO: 600992 - DNA, 289 bp, Homo sapiens
acgagccgaagacgttcgagcataatcctcataagtgtccagatgcattgttactggtgccaggtctgcagcatgggcggacagtgcgcaaagtgcaggcacctacacatgcatctgatcactcttggggttccctaggacgttgagcagctcggcgtgggtcgggtacaggcccagggcccgcatcacatccccacactggccgtcgatgtgtaacatgccatcacctgtacggtcaaacagctggaaggactggtcgaactctgagaatctggtcttcgggtcgatt

SEQ ID NO: 600993 - DNA, 1101 bp, Homo sapiens
gttttagtactttgggggtggttatacacaagcgcggcttgtttctctcccgttgtttttttatggagggggggcgtttgtataccccgtgttccatggtgttatgcaccccttcgttgtgctctgagttgttccccctgattttgtcgcctttttcctgtgtgccctgggtatttgcccccttgtttctctgtcaacaacgttttcttatctcctatacttgtaccttttattattttttaaaaaatttttccataaacactcttctaagggatataaatatatggtccccgtttgtgtacattattctcttgtggcggggccgcagtcttagctcttatgggctctctctcgtttcgcgctcgtctctccaaatttccgttttgggcgtattcctgtttacgagttcacctccggagcagagaggtgcgctacggagagtgtgccctcctcgctttttgcacactctaaatattgcacaatttgtggcccacacacacaaggggtattcctgagacactttctccgaggtataacaccccgcagttatcacgcgcggggagattataatgtcttttcaaaacttgtgcctgataaaatgaatcttttctccccactttatttttccctatggtgagccccacgcggggcgctcctcggcgagactctccctggagagcgcgttgagcacactctcgagtgtatgtaaactctctcgcgaggttttgagagggccgcaccactctgtcggtatatataaaatattaacattcacccaaaacagttcttgcacatccaattagagttgtgcccccacacacttatagaggtctatataaacacacagaaggccactttctcccggagaccgtttataaaccacacaaccacactctttcaccccctacacaccgagaccgcggggtatatatactatcgggtcacaatgtctcttgtgaaaatttgttggagcgcacaaccaccacggttttaatgcccactctgttctcctaagagaattaattccccctaaaaatttttgtaaatatgggccccgttatttaccccttagcaccccctttaccccctttagagacccca

SEQ ID NO: 600994 - DNA, 149 bp, Homo sapiens
atcccctccaatgctcactccccggggaagcagattgtctcttctgatcactgatcctgtgaggcttttgaaaatctttctgatcctgcccagctctcaagtgtgccacttcacccccttttatcaccccaagcagtcagttgacactc

SEQ ID NO: 600995 - DNA, 834 bp, Homo sapiens
atggggctgcgccccgccgttgttacctggtattgtaagaacaagccgtacccaaagtctcgcttctgccgaggtgtccctgatgccaagattcgcatttttgacctggggtggaaaaaggcaaaagtggatgagttccgctttgtggccacatggtgtcatgatgaatattgaagcaagcatgtcctctgaaagccctggatgtgcttgccctgaatttgtgccaataagtacatggtaaaaatgtatggttggcaaagatggcattccatatcctgggtgcggctccaccccttccactgtcatcctgcatcacacaagatgtatgtcctgtgcttggtgtgcttgacagtgctccaaacacacgtgcatgcagaggtgcctttgtgaaagccccagtggcacttgttggccatgtgttcacaatagtgtgccaagttatcatgtccatcctgcaccactgctgcagacacacggagcatgtgattgatgggcctgtgcatgggcacaagttcaatgtatccttggccgacagaagatccacactctcaacagaatgtggggcttcaccaattgtttcaatttgcttgattgaattttgatgacattggtggattgaacatgttgatacatcaccaagaatgtgcatgtgtgggtcaatgtaccatccccaagtcgtggccatctggacaagtgagagggacctgcactcccttgatggttcccaaatgtgatggccccctcgtcatagtcacaaaacagactacttcctgtccaaacagaaaaaaaacacacacgaggcttattctatgtctagatatatgataaattgac

SEQ ID NO: 600996 - DNA, 348 bp, Homo sapiens
tggacccctcctcccccaggaaggcttagagtggggaaaagaaaaaaaggtaaccctgagggaggagtttatgtaaagggggtgccgggggacaaaaaccgccttttaaaggaaggttcaaaggaaaagtgagctgtagttatgtgggcatgttgggggttgcatggggttagggggaggtttgggggcacagggaagcctgcagtgatggggatttttaatttgttggttttttaatttaataaggggggcatgggtgtggaggtaggtcagaattcatccagttggacacactgaaagggggcaacttactgtatgtcaggggggcctcgaaaaagctgtttttga

SEQ ID NO: 600997 - DNA, 1387 bp, Homo sapiens
aacatgcatctgcctgcagtgctctgcagccctaggcattcatctttcattttcaccgctaaggtgggccatgcactaggccatcgtattcagcaaactcatccactagaaccatcgctcacatacacgcaccacgctcactcacgctagctagcctcaccttcacactatgtccctatcacataggcagcctgctcttccgcccatccatcaggcacggcttccattacactgcattgtccccgtagttcgtcagcgctacaaccccgtagacgcaaagaccgtagcgccaagaagtcgcacttgtgcacgtagtcagtagtgcagtcggccgctaacagtcgtaagctatgtcctctcccacaaagcaacctttcctcggaccctaatccgggacatgcccccgcaccgcttaccctccggcactaacccccgcacggccattacaacacccacagtggcacaaagcactcgcgtactcaatacatggtacaggcactcacatatccatttgatcctcatcacagccagccccagtcaccatcattccacattcagcgtctgtctctccaattggaactccctggaacgaacacggccctagtacggactcttccgcaccagcgctggcaacaccaggttcccccttaacacttacagctacagcagaaggcaaaccaccactctccgacttcacagacctctgggcacgcgtgggcaccgctacaccacactggcggcatttggcccgccaccccccccacccacccttaaccccacccacagccaccctatccgtcaccgcaaccgccccgggcaaattaccccgcaaatgccactgcctaagggactgccccgcccatccaccccactccccgcccacacaccccccacaacggcacgccacacacgcacccccgcagctcacgcagtcaccgccacccatcgcgcccgacaccccgccttactcaagaaaaagcaccagccctccccacagcccgcacacacaacacacgccacccacagatgccgcacgcgcccgcgcggcccccactccaaacgaccgcgtaccaccacagacagacccctgccggcctacacacagacaaggccgaggaacaacaccaaacgaaggaacgcacactactgcgggcacacgcaccaaccacaaaactggccagcagaaaagaaaacaaccaacaacgacaataagataaaacccggtcacgaacgcaacaaacgcgcccacaccacggccatggcgccaacaacacaccagaacgacgcacacacctaaagacgaccgcaacacaccagcacacccaacataacgcgacaaccacacagccgccctaaaccacagacacacccacacgccgacacgaac

SEQ ID NO: 600998 - DNA, 247 bp, Homo sapiens
ccgattgtgaaataggtaggtcttttatcacatttactatcctcatcctattactattctgacattgcagtagctctgatccaagcttatgtgtttacactgctagataagcttatacctacacgacaatacataatgacccaccaaacacatgcataccacatagtaaacccaagcccatgaccacttatcggagccctatcagcccttttaataacatcaggcctacctacctatttcacaatcg

SEQ ID NO: 600999 - DNA, 747 bp, Homo sapiens
gctcctttacccttggttcccacatgcacagatgctacggacgcttttcctcccctgtccccactcagccgcagcatccgcggcgtgggcgcgacaggcggcgtcaaccgatgccgagggccagcaatacgcaggagacagggagaccgcagtacaaagtgtagagcagagacagacgacagaggacgaaacgaaagagaacgagaggacgtgagagcacgcactgaacaagggaaaaaagagaaacaagacatgcaggacgagaagcgacgaaagaaagccaaagagaaggaaacaagaacaagaagaaaagcgcgagaagacagaaacgaggaaaaacaaaccaaacaaagaagaaagaagagccaaggaacacaacaagaaaagagaacagaagaagaacaagagcaagaggacagagatgacagaacgaagacaaagaacaaaacgaaagaaagaaacaagacaaagaaaaggaaaaagaaagacaaaaagaaaacaaaaagagaggaacaagacaaaacagaagaaagaagagcaacaaaaagaacaagaaacacaaaacacaaaaaacaagcaacacagacgaagacacagaaaaaaaaaagacagaagaaagagaagagaaaaaaaaacacaccaaaagaagaaaaaagagacgaaaaaaagaagcaaacaaaaagcgacaaaagaagaaaaaacaaaaaaaagaaaacacaagaaaaaaagaagcacaaaaaaaaacga

SEQ ID NO: 601000 - DNA, 316 bp, Homo sapiens
  misc_feature (29)..(29): n is a, c, g, or t
  misc_feature (50)..(51): n is a, c, g, or t
  misc_feature (65)..(66): n is a, c, g, or t
  misc_feature (71)..(71): n is a, c, g, or t
  misc_feature (73)..(73): n is a, c, g, or t
  misc_feature (101)..(103): n is a, c, g, or t
  misc_feature (105)..(106): n is a, c, g, or t
  misc_feature (136)..(136): n is a, c, g, or t
  misc_feature (150)..(150): n is a, c, g, or t
  misc_feature (216)..(217): n is a, c, g, or t
  misc_feature (285)..(286): n is a, c, g, or t
  misc_feature (304)..(304): n is a, c, g, or t
  misc_feature (306)..(306): n is a, c, g, or t
gttaagctctctattaagttgagaaaatnggaacttcaggtgatcatgtnnagatattcaagttnnaaaantnatttaaaaagcacattcttattattaannncnntagaaagtacagagaaggaaattttaatanacctacacctaganacactaagatactggtaacgtagaaaaatgtgtagttaatgccttgatggattcttttctattttnntctctagcaatatttatgtctatccacagaaagcgtacactcatgtatttgcatggctaatatatttnntgtaaagttctatatatncncaacatttca

SEQ ID NO: 601001 - DNA, 87 bp, Homo sapiens
  misc_feature (5)..(5): n is a, c, g, or t
  misc_feature (49)..(49): n is a, c, g, or t
ttcancctgaagagggcaaagtgacggagtgacaggagtggatgcgatnagatgtggtttgaagctgatgggtgccaccctcattgc

SEQ ID NO: 601002 - DNA, 164 bp, Homo sapiens
tactatgtcaaggttcaaaatagtaatgttaaaaatgaaatttggggccaggtgcagtggctcacgcctgtaatcccagcatgttgggaagccaaagcaggtggattgcctgagctcaggagttcgagaccagcctgggcaacatggcgaaaccccatctctac

SEQ ID NO: 601003 - DNA, 796 bp, Homo sapiens
tagaaacaaagtctcactactgtcacccaggctgaagtgcaggggcactatctgggctcactgaaagctccgcctccggggttcacacttattctcctgcctcaggctcccgagttagctgggaccacaggcgccttggcaccaggcccagctaaattttggggtattttcagtaacaagatggggtttcaccggtgttaagccaggatggtctcgaatctccttgacctcgtgaatccgcccgcctcggtctctcaaagtagctgggataacaggctttgagccaccgctgcccagtgcagcttctccaaggtttcaaggggattaaagccctaaaactctcgagggctgaaaatcaattcctaatgtgggatatgttccccaagtattgcctaccgaaagccatacaagaataagacgtgagcagtcgacagcagctagggtcaaggcaagatttactgaagccatagatgggtccaaaggggggctgagcccccataatcctgagccatcgatcttgccaggggcctgtgtgagccccaagagggcaggacggggggctcctacacaaccaaattagcctcgggggaacaatacccctggggaacgctttacacaaacccacaagaatgtccattaagaggtacaaacttgcaacccaaggttaaggggctctggagggatttgaaccaaggtttaaacgccaaaagaaagctgtacagctaatttattgcccaaaaataaccttcagtaaaggccataaagaccgctataattaccgggcaaaacatgaaac

SEQ ID NO: 601004 - DNA, 348 bp, Homo sapiens
ctgccacagagaggataatttgaaattgattgatctttgctttaacccaaaattattatcaaaactttagctgcacaggggtgcttgggtggctcagttgattcagtgttttcctttggctcaagttgtgaccccggagtcccaggatcaaggcccacattgggctccctgttcagtggggagtctgcttctccctctctctctgcccccccccccccgctcctgctctctctcttgcttgctcactctctgtctcactcaaataaataaataaataaataaagtcttaaaacaatacaattatagctgcacagagttatgctaacaaaagtataagtgaccctgtta

SEQ ID NO: 601005 - DNA, 113 bp, Homo sapiens
cacgagggctgaggaacaagcgcgggtggcgccttcgggaggcgagcaggcagcagttggtcgtgccgtaacagtgtcccgcgcgcggcggtgagcggcccagtaggcgcgtg

SEQ ID NO: 601006 - DNA, 945 bp, Homo sapiens
gctgcccagccagagttcgcaacactggatatttacaccaaataattgtggttgacttgtctgaagccagctgacaaaaggatcagcttttcccacttgtcattttttcaacaaagcagggcattgtgatccattgtccatagcagttgggtgctggcctctccatcatatatgcatcatatcatcatcatccattctacatatcatcatatcattatcatccatcatcaccatacagttttacacgtgctcgtcctcataagcctttccaagtcaccgacaccaatccaggccacaggccgaatcaagcctcatatttgcatcatcattatacagcgcgtgtactctaaactcaaatcgtgccgctgagggcatgaaattactattcaagcgcacaaagaaaagatttaagagcaactgaggccaaatgagagttttggacaatggggttgaggtcaaacattatataaacaaggtactgttggaattacatgacaaacatgggaagaaattgaacacaggtgtactaatggagtgaagagcacaaaaaccttcaagtattgacgatggacagccacctcccattgccttactagagggatgaaagacacccccagcagccacacacaactttcaatcagggaggatgacacaaaactggccaaatcacccatgtatttccaaacaaccacttttgatccttcgcttaggccccgtcttttacaagtacgatctcatacaaacagaaaggcacgattattgcattccttgcttcacacattccctcgttttccgtggatctctcagaaaccaaatggtgtggccgcccgtatacaacagcaggtcatgcgggccaagacgtccattagaaacaccactttggacgatacactatcagagagcaacaagaagcagcccccgaaactagcgatagcacaacaaccc

SEQ ID NO: 601007 - DNA, 682 bp, Homo sapiens
tgttaaaataagtaactccattgttttcctcttttccaagaatggccgatgtaatggttccctacaaagtcagggcttacttaggctcactaacgagcgctgtctgttgggcggatgcgggtgcatgatgtgcgcacgcttttcacattgtggtgtgttttcaagcctcactcaactcatcctctcattcccaaagcattcagcatccgtgcacacttcctcacttccaggtttttcaaaagcatgggagatttccaggtgggggtccatcaggttatcatcccaatggtaacagatcaagctgggttcttcagtttcctcagttctttggttcgcccatgtagcaaggggttataaggctataggtaaagtcttacagatctccgcccttcagttaacaattcatgggactcattgggcctagcttcatactaattttcaggtacatccttcccaaattgctgtaccataagtccccatattagtccagcagcacaagctacaactccatctgtgtgatcctcatctccagcaatgtggtcacttgaaacgaccgaataaattctactctgggttgtaccaggttcacatccgggtgtacgtactcctgatccccctttaatcccgtggacgatcccagtataaggcttccaagcagattcccttagctcattcagatatc

SEQ ID NO: 601008 - DNA, 333 bp, Homo sapiens
caggaaattttctttttcccagaactggggtcaggaatccctgaagggctacccgtgatagtccttgcaagtaagtcaaggttttatcctgattggaaatagaagacatttccggttgagagaacagattcgttggaagcttaacttttgttgccttttaacgcccccaaattttagggtaatttgattatgaaagagtgaatttttttggccagaaaagggagagcccccaaattgtttttttttttttaaaaggaagtttaatgtccgttgtatcccaaatcagggttaaaaccccagaactttagccaaaataaatgttttccattccca

SEQ ID NO: 601009 - DNA, 127 bp, Homo sapiens
agctttctgcttctcagctgcttcagtcactttgggtcatgggtgacaactgctgtggtggggatcttctccttcctgtagcgctgggtcttgtggtggcctcctggcggcttgcttgaactgaggg

SEQ ID NO: 601010 - DNA, 319 bp, Homo sapiens
gttttttcaaggggcccgggcccctgtcccccctgtttttttccgaagcctttgcccaagctgtaaccctccctttttttgacacccaccaaacgccaaagctttttttaagacccagcttgaaagcccctcctgagggttcctccccgctcccctaaagacaacttgttgtttttcccttagtccttttgttgcccgggttggcctttccttataggggttgtttaaatgggggggtcccccaaaaatagggggggtcccttgaattttgacccttgtcccccttttttgttccctctcccggcccgcccccccctta

SEQ ID NO: 601011 - DNA, 506 bp, Homo sapiens
ggtccggtaaaaatgtctagcacagaagtacatgtggaagaattctctcatcattgtcggtaaaagcaacgcgtctaatattaagacgaagaagataggacagtgatgagagacttcttacaagaatttaaatttggacggtgtgtatcttcaagttccaatgcccagatccatttgccttgtgtcttaagacatacaagcctgcggtttccacgctctcgggctcataagctcaagagttaacatcagagtcctctttgttgcgggaagcccaccaccatctgtgaagggggaaaagggatgagagatggggaatgtccccagaccagtgccaaaatacgcctttaggttgctatttacaaaccagggcgttggatgcctctagcaggcctgagaaaagcaggtatcatcatgtgaaccaaagcaaaagatatggctggtgctcagcccctcctgggctttgagtaaccaaactgagaccagccacagccttccaaccaacccaa

SEQ ID NO: 601012 - DNA, 318 bp, Homo sapiens
tacggacgcagcggggtggcctgacgacaagatacatgctgtgcgacgccaatggtgtcctctgcgttcctgttgtcaggcggacaagccagcgataaagcctatgcccaaccgctactcgatcaggcttgcatacccagcctgcgcggtcgcccacgcaagcgttgccgctggttgctggctgacaaggggttacgacgctgaagcgctgcgccagtattgtgatcgttatcgcatgcagccagtcattccgttgcgaagcatgaagcgcaaaaccaagccaggattgcctcgactttttgatcgcgtccgtagcgg

SEQ ID NO: 601013 - DNA, 405 bp, Homo sapiens
gcaccaagatgagtgacacagaagacgagtagtctctgcatttccaaatgaagtgccaggttcatctcactggggcgtgtcagacagtgggtgcaggacagtgcgtgcagcgcaagaagcatcactgaagcaggaagaggcattgcctcaaccaggaagcccacgaggtcagggaatcccctttcctagtcacagaaaggggtgacagatggcatctgtttaatcgggtcactcccaccctaatactgcactttccaaatgttcgtaccaaatggcacaccaggcagattatatcccgtgcatggctcagagggccctatgccaatggagcctcactcattgctagcacagcagtctgagatcacactgcacggcagcagcaaagcagggtgaggggtgcccaca

SEQ ID NO: 601014 - DNA, 525 bp, Homo sapiens
  misc_feature (178)..(178): n is a, c, g, or t
ccgaaaatggaatagaggcaggtagatcgttgagccaggagtctgagaccagcctggacatggtgagactccatatctacaaaaaaaaataaaaaattagctgggcatggtatggcatgttggtggtctcggttacttgggaggctgaagtgggaggatcccttgagtccaggggttngaggctgcagtgagccatgatcgcgtcactgcactccagcaggggatggagtgtgacgctgtctcaagaaaaaaaaaaaaaaaaaaaaaaaaaaaccaaaaagggttaaaaaatttctcaagagtttgggtttctctatatttccatgggggggttatgtgggggcgacggggcccacatggggcgcttcacgggaggggtacagtgtggaccacggggacccaagaggggggattaaccacggggattccttcactcggcggagaaaagggggaattctcccttccctggattgccccttccttttctcccttccccttctttaacccgggttgaccaatgggtgg

SEQ ID NO: 601015 - DNA, 264 bp, Homo sapiens
ggtcgacggtgtggtggcatgtacctgtggtcccagctacttgggaggctgaggtgggaggattgcttgagcctgggaggtggaggttgtagtgagctgagatcacatcactgcactccagccctgggcgacagagtgagactctgtttcgaaaaaataaaacgaaataaaaacttagctgtaagggtaaaaaattagaaactggctgggcacagtggctcatgcctgtaatcccagcactttgggaggctgaggcagtcgacg

SEQ ID NO: 601016 - DNA, 144 bp, Homo sapiens
aggaccttggagccttaccctccgggagccttatcctgcaggtactaaataaaaaatatgataggtgaaaactaaatgctacattggaacagacccacttagtacttagaagagtgggttggttttaaattatatttctttgga

SEQ ID NO: 601017 - DNA, 150 bp, Homo sapiens
tttctcaccgacaatggtgaaatcaacgacctcaaattacaacgacatggttggcaggtgatactatacaacaaataaagcgaaggtctatagtttaaacagcatttgtagccatgtttacctatcaaaatctacagtctagtcactgta

SEQ ID NO: 601018 - DNA, 187 bp, Homo sapiens
  misc_feature (131)..(131): n is a, c, g, or t
  misc_feature (185)..(185): n is a, c, g, or t
gtgatctagaggatcccatcgtaatatgtaacacttcatcaatatcttagatctttccatgactgctgcacttctacttcagcatatctgtttcacttgcactttatgttatggagacatgtcttccttanactctgaccagcctctgctagtttacattattttacggtggggttacccgtagnct

SEQ ID NO: 601019 - DNA, 440 bp, Homo sapiens
  misc_feature (48)..(48): n is a, c, g, or t
ggagaagcaagccggcgatttgtaataagggggggccgccaatatgcnctgacattccccaagcattgcctttttattttacttctttaagcggtttacccttgtaaaacgcaaaagggttgggccaagtttaaaaggctgtgcggcccctttcccatcaaaaaactactgacaacgaaggccgggcctgcctttcccatttgtttttttttttggcgggcagggaaggaaaaaacttgcctgttggtaaagaaaaaaatggggtggaaaaagtggggggggcccccagtgaaatttaaagtaaaccccagctggcccaaggggtcccccaggctgtaatgcagtttaatcaaagggccctttttttttttgttcaaaagattttaattattggaaggccccatttttttaataggcaaataaaaagtttaaaaacttta

SEQ ID NO: 601020 - DNA, 1037 bp, Homo sapiens
gcacgagccacaatctcttccctcccatctacttggtatgatgcgagctccacttcccagacttctgtgtcatatgccagtcaagaatccgactatgccgttaatcaaaactcttggagcgcgtctactaatcaactgccatctaccagtacgacaagctactatgcgccaaccttcagtacatcggccgattttgctgcttctaatgtaaatgcagcttctgatgtctccactgccagtgttcccattgatacgagtgctaattctatccctttcacaactacaagtaacatagagactacaacgagtgcacctctcacttcggacactccacttatttccactagtacgatgtccgcagctgataacgtattttcgtcagcaaaccctatttctgcctccctaacaaccaccgatagttcagaaagttttgaccaaacttcgactgctggtgccattccggtgcaaagttcagcagattttagtagttctagtgaaattttagtacaaagttcggcggatttcagtagccctagttctccaactactaccgatatatcgctatcagctgccccactgcaaacaagtgaatcaagcagttttaccactgcatcagcagctctaccagtaagttcaacagacgttgatggctcaagcgcctcacctgtagtgagcatgagcgccgcaggacaaatagctagctcaagcagcacagataatccaactatgtcagaaaccttttcgttaacatctacagaagttgatggttccgatgtttcatcaacagtgagcgcattattatcggctccttttttacaaacaagtacttccaacagtttcagcattgttagcccatcggtatcttttgttccatcacagagttcctcagacgttgctagctccagtactgcaaatgtagttagttcatccttttctgatattccaccgcaaactagtacctcagggagcgtagtttcggtagcgcaatccgcatctgccctcgcatttcaaagttcaacagaggtatatggtgccag

SEQ ID NO: 601021 - DNA, 131 bp, Homo sapiens
tgcgctctcttcttatagtcagcgacatgtgtcaatggggagggcctgcatcgtctgctaacctgaaggatctggaggtaacgaggccctgtggccgtggcccagatgacccgtgcaggccagccctccaa

SEQ ID NO: 601022 - DNA, 377 bp, Homo sapiens
atgctgccggccggaagcacccaaccggggacttaccccgggcgggagaaggttccacaaccgggaccacaattaattggaagtggagttttaacggggccgttttaattgggttcttaattccccagtttcttaagggcgagggcggttggtaaacccgagtttttttaacaaggtttacccccttaaaacgagacacaatatactgctacactctcgtggtacatctttctcatccccgacgccggggccgcacagggccgctcccatgtggagctcccaggggtagtagcacttaggaggcctcctactactttttcggcggctgcaacaattggtgggggagtaatcaccagctaataattcatcgagaggta

SEQ ID NO: 601023 - DNA, 214 bp, Homo sapiens
ctccttactggtctgttactgcacgtgcatacattggcggtatgctatctgaacaacgctggccattgccgcacaacaggctattacccgaggcgcccagcgtgtcgcggtattggacgtcgactttcactcatggaaccggtacccacgaatattttctacgggcgcagtgacgtcatgtttgtctcgcttgcacggggacccgaacggtgtc

SEQ ID NO: 601024 - DNA, 1119 bp, Homo sapiens
taagacaaaaggtttttattcaaaaaacgccaagtataaaaaaaagaaataagatctgctttaattccccgtgtacagtattgcactcagataaaaccagcaggctaccgggttgctcaaaacacagccccagagaggatctggaaggccacaccatcgcaaaagcgtgctttccataaattatcctattttacacagtcagaaagtcccttccccattacccaaagaagcgcgggaccccaccgtgggataacgctaggttgaggggccccaaagaagccagggagcctgcagcacgtgtcccgccgtaagttcccggtaacccgcaaaaacgagagcacagcgttcggaagaccttccccccaaagaggtccccaagttcagcagggaggcaaaggaggcaaacgaaacctacgggcacgcagtctaatgggacaccttggggcacatcaggaacggggcaaacccacaatacagcttacccacttcacactaaaattcctttaaacatttggagccctccccagggcgttacaaaagtgggccattctttccaagaaccccacgaatcctaacacacgctggggtcacaaaatcaactttaaaagggggcaaaatttttcttaaaaaatttaaaaatccccctaaaaatcctttttgggtattactaacccgtgccaacgtgtccacccccttttttacaagctaaaccggggacgaatgccattgggtagggagccattcacgccggctgtgaaaaacatccgggccatcgacacaccaggttcagctaaaacccaaagaagggaagacccgtccacacggagtatacacaaaaggggcgggccacaccggggcagcgggtccacagacattgggcccgtgtaaccctttccccagggcacccttcaacttacaaacgggcaggagggcaggcacagctacacaaaaggggcaaaaacccggaattttgagggaacacacggtgaacaaacacatcaatattatcccacaaaacaggaaccaaaagtaccaaaaattgcaacatagagagtcaaaacggatgcatcacattccactagctatcctcgactgtacacacatatagaacactatata

SEQ ID NO: 601025 - DNA, 195 bp, Homo sapiens
cctgacccatgtgccagagcattatgcagactacatttcgatttgaaaaaatggcccagctgaacaaagtgtttctggttttgagagagagagagattgagagacagagagagagagagaaacctagggatcatgatagttatagtctgattgagcaaggattatcttttgaaaatgtgttggttctgtgataca

SEQ ID NO: 601026 - DNA, 227 bp, Homo sapiens
  misc_feature (160)..(160): n is a, c, g, or t
  misc_feature (211)..(211): n is a, c, g, or t
gttagaggatcccgttatgtggtgtaccgtcacagacatagaaaaaaaattatgattataaaaggaaaagaaggagagataaattaggagtatggaattgacctgtatacactactatatataaaacagataaacaacaaggtcctactgtatgccacangagaatgacagtcaaacttgtaataaccctataatgggaaaataatcacgngtaagcgaccacagta

SEQ ID NO: 601027 - DNA, 1218 bp, Homo sapiens
  misc_feature (208)..(208): n is a, c, g, or t
  misc_feature (639)..(639): n is a, c, g, or t
tggggtacttttttggtaaaggcggggttccaacacgttgcccaggggggtcttgaaactcctgagcctcaagctatccatccacctgcctcggccccccataagtggcgtgggagactaacagggcgggagacgcacagacacctaacgccctcttctctttttcttggtgctctggtgagaatgagagggtttggagacgccaganaaccatctggaatgttataagataatgtggcaaaaagggctctgtgtgtgtgtgcccccgggagatgtgaggagacagggtgtgtgtcgcaagagtgggtgtgaagaacccacaggctcttctgtggagaccccaaaggtcgtcaactgatgtgagcttcatcctatataccttataagacaaagaagactatatctcgagacctgtgtgtaagacagacacctgtgtgtgacccctgtggggtatagtgagagagatgtgtgtctgtgtgtgggcggcctctctctctgagtgtgcgtgtgtgtgtgcgccccctctctgtggggggtagagggaactctttttctctctctctctcttgtgggctctctctgtgtgtgggataatatagttggtctctcaggtccaccaactgtgtgggggcgccctangttgtggacccccccctctcaaacgaagaaggggctggtgtatccggaggggggacagctggtgggggacaaaacaacaccacccgaggtcttatgagaagggcaatcctctcagatgttggaacaagctacctacagaaggatgttggagctcttctaataagaagaaacctctcttcccaaagcggagagtgtgctgttgtgttcaccacaccaaacagacgaggtgggtttgttgggcaaatatctcgcagtgtagatgtggtgacacgctgagtgtagtagtttccagtctacagggaggacaggacctactaattctcctcaagaatgttgttgaacacaatttctccccaaacacacgaggaatttattgtggcatgtggggcccctcctccacgaaggaggtggcgaagaacatattatattcccaactagcaagagagggggattaaatcagacaaggggagaccaaggcggtaaacaagggacagggttcattttgtggcgcacacctctttagtggagactgtcgaccacgcgtgggggaaacacctccaaacaagagaagggcccaaa

SEQ ID NO: 601028 - DNA, 103 bp, Homo sapiens
ggtgggagtgccgacgagtcggggcagatcttcatctggtagccaagaagagagcattaaacccaagaacttggtggagaaagatggactgttgaccagtgtg

SEQ ID NO: 601029 - DNA, 340 bp, Homo sapiens
cccagaaaaaacacctctaacaaacacaaatatatgccattcaaaactgggcaagggcggccaggcacggtggctcatgcctgtaatcctagcacgggaggctgaggtgggcagatcacgaggtcaggagatcgagattaccctggctaacacggtgaaaccccgtctctactaaaaaataccaaaaaaaattagccaggcgtggtggcaggtgcctgtagttccagctacttgggaggctgaggcaagagaatggcatgaacccgggaggctgagcttgcagtgagccgagattgtgccactgcactcaagcctgagagacagagcaagacgccgtctc

SEQ ID NO: 601030 - DNA, 283 bp, Homo sapiens
ctgccactgtgcccggccaatacattcattattaacttaaggctgtactttattaaggcttccttagttttagttataagttatcgtattttttgatgcatggagtctcactcatgtcgcccaggctggaatgcagtggcatgatctccagctcactgcaacctctgcctcctgagttcaaatgattctcctgcctcagcctcccgagtagctgggattacaggcacctgccaccacgcccagctaattctttgcatttcttagtaaagacgggggatttcac

SEQ ID NO: 601031 - DNA, 170 bp, Homo sapiens
gcacatcgagaggcttcaactgtataggtggagtaggggattgaagtatcagaaatctacacgggaaaaaacagtattaaaacaacacaacacttaacttttcctctagggagaggatttggacagcgggaaaatattccttacttctcttattattggttgaagccacg

SEQ ID NO: 601032 - DNA, 370 bp, Homo sapiens
gaattcctatttttcccctgattatggggattgatccccccgcaatcctattatgtatttgagtgtgggtatgtgtgtgttatgggggaaggggggggttctttaaaatttttgtggtttgtggcttttttttccaaacattagttccccccctcgcatgcccaggggcccctgcctggcatttttgcatgctgggatcatcgggggagggtagtgaagctcacccctgtcctttgttttggagatttttttttttgcataagtagtccctcctatacaaatagctgatttactgttttcccctttcccctatgggtgctggggtaaataaactgcctttcccccttggttacccgtaataaaattttta

SEQ ID NO: 601033 - DNA, 255 bp, Homo sapiens
  misc_feature (22)..(22): n is a, c, g, or t
agcggcactgagtggaggaggngcagcaaggctgtgccaagaacatttatcaggagttccccttgtggcgcagtggttaacgaatccgactaggaacgatgaggttgcgggtttgatccctggccttgctcagtgggttaaggatccgacgttgctgtgagctgtggtgtaggttgcagatgcggctcagatcctgaattgctgtggctctggcgtaggccagtggctacagctccgattggacccctagcctcc

SEQ ID NO: 601034 - DNA, 1042 bp, Homo sapiens
ttttcgtttttgttctctttcctgctcgctcccttttctgccgttgcctcgtctctgcgtcttctttcttctttttttttggttcctctgttttcctttttttcggtctgggtgtgtctcttctcttctgtctccctcctcgtgtgtcgctcttctctgctcatttctctctcctctttgtttcgtcgtttttggttcttctcctttgttgtcttctgtgtcgggtttgggctgcgtgttcgtggtttggtggtctgtgcctgccttgttggccctgctctgtcgcctcttttgtctgtcgtcttctcttcctctcccctgtcggtggtggttttatttgctttagtcttttccttgttctgttgtaggctcgccctcttttttcgcttcttgcttgttctgcttcctccccccgctccttcgcgtcgctcctcgccccttgttctccctctcgctcctcgcctgctttgtctccctccctgctgctgtctctttctttttttttcctcttccgccgagtgtggtactctcttcttcttctccctcaccttcctcttttcttcttcgtctccctctccctccgcttcgttctctcttcttcgctccgccctctccttcgccctcctcctccctcttccttccgccgccgctccgcgcgcctcccgcgtaatgtgcgccgccgccgttgttctttctctcctccccgcctcctcttctttttctgttttgttttttttctctctcccctccccgctcgcggcggctttgttctgtttcttttgtttttttctcctctcttttttttccaccccccccccccccccctcccctctctcattactattattatgttttttttttctctccctctctctctctctctcttcttttttataaaaaaacacaccccccctctctctttgttgttttttttttgtgtgtgtgggcgcccccgcgcgcgccccccccccccccccgtgtgtcgtggtggggagagagagaaaaaaaggcgtgcgcgcgcgcgcgcccccccccacaaata

SEQ ID NO: 601035 - DNA, 296 bp, Homo sapiens
gaggcggccgaattctaccttcagcgatatcccagaagaccagaacagctctctgagctgtggaaaccgccctggcagtgcaatggagtgtgcattacatttggaaaaaaaatgtgaatcagtcactactggaactgcactaccgtggccactgacaaaaatacccccatttgtgtgacttctttgtagacacattacctgattcagccggtgaaagccatcatagaattgggtgaccacgttacccacttgcgcgagatgggagcgcccgaatctggcttggcggcatatctctt

SEQ ID NO: 601036 - DNA, 694 bp, Homo sapiens
  misc_feature (18)..(18): n is a, c, g, or t
  misc_feature (81)..(81): n is a, c, g, or t
  misc_feature (94)..(94): n is a, c, g, or t
  misc_feature (99)..(100): n is a, c, g, or t
  misc_feature (103)..(103): n is a, c, g, or t
  misc_feature (105)..(105): n is a, c, g, or t
  misc_feature (122)..(122): n is a, c, g, or t
  misc_feature (137)..(137): n is a, c, g, or t
  misc_feature (139)..(139): n is a, c, g, or t
  misc_feature (152)..(152): n is a, c, g, or t
  misc_feature (162)..(162): n is a, c, g, or t
  misc_feature (176)..(176): n is a, c, g, or t
  misc_feature (185)..(185): n is a, c, g, or t
  misc_feature (188)..(189): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (275)..(275): n is a, c, g, or t
  misc_feature (331)..(331): n is a, c, g, or t
  misc_feature (592)..(592): n is a, c, g, or t
  misc_feature (605)..(605): n is a, c, g, or t
  misc_feature (663)..(663): n is a, c, g, or t
ccaggtggggtgggtgangctgtccatcgagggctctttggggggtgtgggctctgggcactgcccgctgagaaagaaaangcagaggcagganaatanncancntcctggatggtactgangtgacttgagttttngnaatttggctttanccaaaaagcnggaacaatctccanagcactgtncanngaagggggcaggctggccaggcactgtgggctggggagnagnagnagnaaaacccacgtgtccctgggtcactgggttcgccaacngggaaaggacggggaggccacatgctcatgcagacacagggagttagaggctagtnaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccaggcctcgggtgtgacggggagatagaacctggggggcacagaaanggcagcagaggcntggctgcgggctctctcccccacagcacaggcagaagcagcaacgagacaggagaccnaggaggcttggggctgttggtggggggaggg

SEQ ID NO: 601037 - DNA, 829 bp, Homo sapiens
  misc_feature (3)..(3): n is a, c, g, or t
  misc_feature (34)..(34): n is a, c, g, or t
  misc_feature (155)..(155): n is a, c, g, or t
  misc_feature (195)..(195): n is a, c, g, or t
  misc_feature (197)..(197): n is a, c, g, or t
  misc_feature (203)..(203): n is a, c, g, or t
  misc_feature (208)..(208): n is a, c, g, or t
  misc_feature (220)..(220): n is a, c, g, or t
  misc_feature (229)..(229): n is a, c, g, or t
  misc_feature (234)..(234): n is a, c, g, or t
  misc_feature (258)..(258): n is a, c, g, or t
  misc_feature (264)..(264): n is a, c, g, or t
  misc_feature (271)..(271): n is a, c, g, or t
  misc_feature (273)..(273): n is a, c, g, or t
  misc_feature (319)..(319): n is a, c, g, or t
  misc_feature (329)..(329): n is a, c, g, or t
  misc_feature (335)..(335): n is a, c, g, or t
  misc_feature (344)..(344): n is a, c, g, or t
  misc_feature (354)..(354): n is a, c, g, or t
  misc_feature (359)..(359): n is a, c, g, or t
  misc_feature (365)..(365): n is a, c, g, or t
  misc_feature (372)..(372): n is a, c, g, or t
  misc_feature (378)..(378): n is a, c, g, or t
  misc_feature (406)..(406): n is a, c, g, or t
  misc_feature (408)..(408): n is a, c, g, or t
  misc_feature (443)..(443): n is a, c, g, or t
  misc_feature (451)..(451): n is a, c, g, or t
  misc_feature (453)..(453): n is a, c, g, or t
  misc_feature (495)..(495): n is a, c, g, or t
  misc_feature (569)..(569): n is a, c, g, or t
  misc_feature (571)..(572): n is a, c, g, or t
  misc_feature (594)..(594): n is a, c, g, or t
  misc_feature (598)..(598): n is a, c, g, or t
  misc_feature (600)..(600): n is a, c, g, or t
  misc_feature (606)..(606): n is a, c, g, or t
  misc_feature (609)..(609): n is a, c, g, or t
  misc_feature (635)..(635): n is a, c, g, or t
  misc_feature (640)..(640): n is a, c, g, or t
  misc_feature (696)..(696): n is a, c, g, or t
  misc_feature (823)..(823): n is a, c, g, or t
cgncggtccaccccggcttcccgagatacgctanagttgcccccacgtcctgtccgccgcgcccctacccaccgggttgccttcggggcccttcggtgctgtgtagtcggcgtggcgctgtgagctaggcgaacaggaacccccaggcccgccangtctacgctattagcagccaggtagccctgcgggtcgaanangctcanaagangagtaaatgcanaaaaaaaanaaaanaaggaataaaaaaaaaaaaaaaanaaaaanacgtaananaaacgcactcaaaaacaactttgggattggactttttcaatttcanacgaaaaaanttggantatctgganaaggtttttnaaaangtttangaggganggtganttttctgctgaaaaactcaatctgccananagtagcggccccatctgggatctgtcactgctganagcaccananggcacagccgtaatcttctgcacagcctgcactccccgaaanaccctccttaatcaaaggatgtctgcgcgcctgagctcagctgaccgcgccgggagcaccagggccgttggatncnnccccagcccgccccctccccangcananagccanggnccctcgcgtcttcgcggcacgttaantaaangcggaaaacagacagaggctgatgtcattgctctcacaagatcataaacgtaaaanagtcatcctgtgagaatccctgaaaatgactttaatgaataatttcagagacagttatgactttggggtgattactgagcaagaatatgaaaaccagaattgcaaagcgaaggcggatggtcaaaangcctgg

SEQ ID NO: 601038 - DNA, 858 bp, Homo sapiens
gccctttcccctggctggcagcgcggaggccgcacgatgcctggagttactcgtaaagagaggtgaatcgcagcacggacgttcgtcaagagctctggcagccttcctcaaaaagtccgggaagctgaaagtccccgaatgggtggataccgtcaagtcgtgggcaagcgaacaaacgagctgtgctccctacgatgagaactggttctacacgcgaagctgcttccacagcagcggcacctgtaacctcacggaggtggcgctggggttggctccatgacacaagatctatgggggacgtcagagaaacggcgtcatgcccaagccacttcagccgaggctccaagaagtgtggcccggcgggtcctcgcaagccctggaggggttgaacaatggtggaacaaggaccagagataggcgtgcgcaaactgatcgacctcagggacaaagagatctgggacaggaatcgcctggacacggtgtgcagctgccaacatagaagcattagaacaaaccatgctgggtcaataaagttgcctcaattcgcaacaaaagcataaaggataggcgggaactgcgtcacatgaggtgcgagcgtaccctggggcactggaaaaagacgtctcaagaaagaccatatggggaaggacgactcgcgggagactaagagaaggtgagactaccagtacaaacctgcggggaaaccccccagggataccccaagaagacaaacgccacgggggaagaccgcataagagagctgcccagtaccttaccaaccaaaacaaaaaaaaaaagacgcccggaaggacagcaccacgcagaggtaggactggagaacgggataccgccacaatg

SEQ ID NO: 601039 - DNA, 236 bp, Homo sapiens
gccccaggggcaaagggggccaaccaacctcaggggggagtgttttggggtccccctcctccaaagggcttgggccccccccgagggggcagcgaaaggagtttccccatccccggtcagtcccccctgccccgtcccctttcccttttcctcggtataaatcatgttttaagttatggaagaaccgggccctttttcagaaaaaaacccaaaaccccccaaaaatatacgtggga

SEQ ID NO: 601040 - DNA, 662 bp, Homo sapiens
agggctccaaaatgtgcgagtgaggctgtggggactcgctgagcatcgtagggggagcgtgcagagccgatgcgagcctcacagtaccggagcccggccgtgccgtgccgtagggaacatgcacttttccattcccgaaacacgagtcccgcgaggctggggacagctggcggtatccggctacgtggctataacattcacgtgaatggagtcctgcacatgtcgggtgcgctactagccagctcctggggctgcacgagcaggtgggactagcacccctgcccttgagacagcttcaagcccttccctacacgtggacatcagtgtctcccttatacccgctctatcttgttcccgtagggctgtagtttcccctttaatcactgccacaggttcggcaagacccattgcttgggaagcagcgagactttcaacagtttcctgctgtcgggcacaacaggcagacacagcaggtcccccacagacgcaagtgtcctttgcgaatgtgcctgctcaaccgggcagacaagtcctggtcaacgttgctaacttcagactcagacctgcggatgtcctggaggctgtaagctgcaaagctggatcttccagatgacttgattggatactttagtctattcttagttcgagaaacatgaggactg

SEQ ID NO: 601041 - DNA, 871 bp, Homo sapiens
tgggcaaaaaacaagacaaccgattttttatttatccaaaagtaaattctccaggtgtaaaaagaggccacaagttattgttgtaaaaaaaaaaatttaaccattctggcatacccaaggtgcgtgcatttaaatgtgaaaccacctaaagacagaaaacagagacatgtgaaacacccactggaaaaccagccacccggagctcagatccggctacaaagcaccctcctctacaagagaacacgtggaactcaccaatgggaagaagcaagatcacgtggagggtggaacggcaccgaaaccgtggaaggtgtgacgatgctcaagaagtctcctcacgacagaacctcagtgggccccaaagtgcccccagaaacctcaagagcaggcccccaatagcagagagtgacaaccccgcaactccgtgtacgcggcgggaatcaccccgagccgagaagagaaagaacatgcgtgagctttgtgaggcccaactccgtgaaagttgtgcccacgtctcgcaaccacacacagtgttcaatctagagacgggaaataactgcgcgccaattacacaccgcgggacacgagtacaaacacccagcgacaacgccataaatgagaggctccgtagggagccactcagtcggccggagaaccagccgggaacagaggataaataaatcgcacgcacgcagctgtataccagagcccacgtacgaagggaccgcaacaagggagacatgtgtgacctaaagcggcgcacacagtggagacacactccccccatctcgagcgagcactatgacccgacgtgcacaacacacgcgcggccactagtagaccaagtgacaacaaacgacgcacccgacgc

SEQ ID NO: 601042 - DNA, 224 bp, Homo sapiens
gctatccagctctggagagggaggatcatttgaggccaggagttagagaccagcctgggcaacaaagtgaaacccttgtctacaaaaaatttttaaaaattagccagggagtggtgtggtggctcatgcctgtaatcccagcactttgggaggccagggtggattacctgagttctagaccagcctaaccaacattgagagaccctgtctctagttaaaattcc

SEQ ID NO: 601043 - DNA, 986 bp, Homo sapiens
  misc_feature (463)..(463): n is a, c, g, or t
  misc_feature (986)..(986): n is a, c, g, or t
ggtccgtgcaggtgcataagggcaccgggcgcccctgtgcgactggcgcgcatggtgtcggtcgcccgagttgtgtgacccggcgcgatgactcttcgagcagagtttgcgctgtcgactgaatgacgtgctagcatgactcggctgcagtctgggatctgctaagaagaagttagctctagccgcggatccgcatcttacgccgtggcgcgaatgactcgcgggaaaagggaaccgctccaggagaaagcgtagctgcaatggctttgtatgtgaatgaacgtacccctaccgggcgctacctgattcagcataggaggctcacggaactctaggcggtggggagccgtgtttggcgttctctggatttgagtgcgttgcctatggcctgcataggccagatgagtgcaattctagggatttcatcattgcctgaggatctaggatatatccaagagttgtnttcatatgaacatgagagggcacatgggaagaccacaaggaggtaaattaccacacgtccggagcgtaaggacgcaaaggatctcgagtcacgatcgcaacggacgtctgtggttggcatgaagtcacagcgctatgtggtcccagtcctctctgtcgttcgcgcatcgttaggctcggtgagaacgaatctcctgctcgcgttcggatcgttccgcgcgttgaaattcgcgcaggaagactacattcggagtttcttctgctgtcggctctccccgtaactggggcgtgcggcgttcgcggggccccgcgtgcaagaagcgacagtaattgtccgaagagaaggggccatggggtggggggcttgggagcgggcagagcgacgaagtgaaggaagcgcttaagttctcagcttggtcccttcactttgggcttgcatggaattgaacttcagtaaaactttggcctaaaatggaaagcagggatctaccggcgtatagaaacaaaccgtgacaaaaatgccn

SEQ ID NO: 601044 - DNA, 357 bp, Homo sapiens
  misc_feature (179)..(179): n is a, c, g, or t
gaccaccatccagtcacctcccacaaggccccaccttcaatattgggaattacaattcgacatgagatttgggtggagattcaaatccaaaccatgtccttttgcttttttctgttttgtttgtggagtagatttttctccatccctttactttgagcctaagggtgccattgcatgtnagatgggtctcttgaagacagcataccattggttcttgcttttttatccaagtcaccactgtgccttttaattggggcatttagcctgcttacattcaaggactcagtgacctttgaggatgtggctgtgaacttcacccagggaggagtgggctttgctgggtccttcccagaagaa

SEQ ID NO: 601045 - DNA, 197 bp, Homo sapiens
cagcaggacacagcacaactgtctacacactcggttatccccctagggaataaaacctcaggggccaccagtagaagggatgagagctttccctttctgcactgtatacacaatctatgtgtactgtttgaaaaaaccatgtacaagcactttgttttaactttgacatgaaaacattaaacacttttttttgtata

SEQ ID NO: 601046 - DNA, 146 bp, Homo sapiens
cgattcagcttatgtggagcgagatgcggaaacggggcttcgaggtggtatatatgaccgagcccattgactgacgtactgtgtgcagcagcatcaaggaatttgatggtgaagagcctggtctcctgttcaccaaggcagggtct

SEQ ID NO: 601047 - DNA, 941 bp, Homo sapiens
ggcctggtgtgatccgtcctgcgcggttgtctctggagcagcgtctttaatctccgtccgccttctctcctacctaagtgcgtgccggcacccgatggaagattcgatggacatggactttgatgccccctgaggccccagaacatatcttttcggtgtgtgaactaaaggccgacaaagattatcaacttcaccggtggctcattgcatgacacacatgagcaccagttatctttaagaacggtcagttcaggggcttggttgcacgaggcatggagttgcacatgttgaatccagaggcacatgaattacgaagggccggtccacattaacgtaccactggcaactttttgacacaactgtctgtacagcccaaacggtttccccttgggggcgcttcgacattaccacccaccaaggtggtcttagagggtcttgaagtgtggttcaagggccagtgcattattccgtggacacgcactatagtagctgtggaggaagattgcagagtcaggaagatgaccgaggcggagggactgtgaccttctcaacgtatatctggcacgcggctgccctgaggtggtagcacggttccccagacaacaaacaggtaaaaccttgtctgcttactgacagatgatgcacgctgatgacgcacaggcgctgatcgacgctgcgcagctgaagctctgaggagaggaagctggaaaacaagcccggggagaatcaaaggggataccccgccacattggccaaggtcatcagagggaagctcaaccttccagcccagacaaaggcagactctcagaaaggaaacctcaaacccaggctctggcgagaccagactagcgcgcacaaggctctccaggcgtcaaataggaaccgcgcacagaccctcgcggcgacaaaatcacaccaacacggcacaatcgaacacgtct

SEQ ID NO: 601048 - DNA, 151 bp, Homo sapiens
  misc_feature (64)..(65): n is a, c, g, or t
  misc_feature (93)..(93): n is a, c, g, or t
  misc_feature (104)..(104): n is a, c, g, or t
  misc_feature (111)..(111): n is a, c, g, or t
  misc_feature (114)..(114): n is a, c, g, or t
  misc_feature (117)..(117): n is a, c, g, or t
agacacaagtcttcactccttcctgcgagccctgaggagccttctttccccagacatggccaannagggtccttcctatggcatgagccgcgnagtgcagtccnaaatcgngangangtattcgcggcagctggaggagcggcttggtgga

SEQ ID NO: 601049 - DNA, 812 bp, Homo sapiens
aataaagtataggcgagagaaatggaagacctggcgcaatagatatagtaccgtaatggagaagagatgaccaattataagctcaaagcataactatgaagctaaaggaactagacccctagttactctctctggcaatagagtgacattcaatctagcaatatagaccttcagtcataggagagcacaacaggcataggaccgccgagaccagacgagctacctgaggaaacattctaagaagagctaaggcctagcgccgttctatggtagacaacaagtaggtggagacatattatataggtagaggcgataaaactaccgagacctggtgatggctggttgtccaggatgcatagaatcttagtttcaagctattcaaatttgcaccagcagaataccgtctaaatcctcgcttgtaaacttataatgtggttagtgcacaacagatggaacttcggttcttttggagcagctgagtgaagagataaatgcttgtaacgagagacgtaaaagataattgaaaacaccccataagatagggtcctaaaaagggcaagccatcaagttaacggacaacgcgttccaaaggtcgtcataacaacgcatctacctagaaagaatcccgacccatataattgaagtcctcacataccagatcggaaccagatctatactactcctatagaagaaactgactgtagagtgataagtaacatgaggacatactcgctccggataaggccgtgcggtcagattactatacactgaaactgtacatattacacgaggccaaatatgctacaatgtca

SEQ ID NO: 601050 - DNA, 440 bp, Homo sapiens
ggtgcatagtaggatccccgcatgagtaaatcttgtgttggagatcatcactgcactccagcctgggcgatgagcgagactccgtctaaaaaacaaaaacaaatatgggggccactcagacggtctagggcgccggcctaggtagtaagtcgagaaaggcaattttaaatgtatgtgcctatttccaatttcttcctgagactgctgtgacggcaaatgtgttgggggatgagccttcctccctggtggagtcaaaaccacaccagcgcagggtccttgccttgactggctctgtaagcaggttctggcccttcagaacaggccgttcgctaaggtgtcattgagagcgattttcctcgttctctaactggaggaatggttggcataatacctgagcagtattttattagaatcctaaggtgtagcagcagccgtgattg

SEQ ID NO: 601051 - DNA, 195 bp, Homo sapiens
gcctgggtggtccgtgtccgttcatgttgccctggtggagtgctggccagctccggtctgccaggcgaggcggacggtagcttccttgtccctgtctctgcacagccttttttttttgagatggagtctcgctctgtcgcccactgctctccagcctgggcgaaagagtgagactgcatcttccaaaaaaaaaaa

SEQ ID NO: 601052 - DNA, 673 bp, Homo sapiens
ggccccgtcattgggggtgaatcagaaaaattgccccttgtggggcccaggcttccttctctgtttgccaagattttgttattgttgtcttgtgaaaaaatatcccctggcgcaccccacccttggttaaggttcccaaattgagggcctctccctggtatgctttttgtaagaatttttggttttgttcctttaaacggtagagcctcacccaggggtgggtcttgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatatgcagtacatttctggctgatcccaatcagattcccgctaatggaagaagtttagaatctttcaggtggaataaagtcacatgaaagcaaaacacaactatatatattttcagcttttttgccaagttaattttttttca

SEQ ID NO: 601053 - DNA, 312 bp, Homo sapiens
tgtgtacacccaagatactcgaaatacaagaagcacactggaagtcgtaggcgtcaggagaccactagagttctacagacagacttgtagaaaacactagatctgacttattattgaacttgtactcaaccctctatttatttcgagagtaaggggttgcccggcccagtccagcctctcatctcatcagtcattccaatgccacaaggcggcggctggctagtgacctgtggcagctgtggcttcaacattacgggcagagaacacggacaggagttagtacagagatagtaacgcacaaaactgcatgtg

SEQ ID NO: 601054 - DNA, 382 bp, Homo sapiens
gaaacataattaaaatagttgaatttttgatgaaaattttctgtaatcttcacttcaggtttcccaattaagaaatgacagtgaaggctaggggcggtggctcactcctgtaatctcagcactttgggaggccgaggcaagtgaatcacctgaggtcaggagtttgagaccagcctggccaacatggcaaaaccccgtctctactaaaaatacaaaaattaaccgggcatggtggctcacgcctgtaatcccagctactcgggaggctgaggtgcgagaatctcttgaacccgagaggcagaggttgcagtgaaccgagatagtgccactgcactccagcctgggtgaagagcgagactctgtctcaaaatcataaataaat

SEQ ID NO: 601055 - DNA, 161 bp, Homo sapiens
gcggtagccgaggaggggagtcatagagggccgactgtgaatgccgggtgcatgtgcggaggccaggagggtcgactctgagtgccaggtgccatgtgcggtggccaggcagggtcgactgtgagtgctgggcaccatgtgcggacggcaggacggggagg

SEQ ID NO: 601056 - DNA, 1514 bp, Homo sapiens
gctgagcacgctccatactgggagaggcttctgggtcagaggaccagtctgcagagggattccatgtggctggaagcgatggaggctcacacagcggacacgttgtcgagcgtacctgcagcgctagggactctgggtcatccagggcgacggccgatgacacccttccgagggctctttcgtggagtgctgagccgtgcgatggttggcatgcgaatcccgacaggccgtgatactagaactgcgatcgacgaatgcggcgccctgcgcccgactcgcgggcgcgcccacgcaaagcgcagtgggctccgcagctgagacgactccttctaacaccaggggcccaagggcgcgagacacccgtgcctgtggcatgcagcaacgacatgcgtgggaagcgcgtgagccctgacttggccccacgccggctcggatcgctgggccagggggaccccttgagcgacatgtcccgatggaagaacggacacaacacccaagaggccctcactgggcagccgcagataggacactcccccttatcggagcgcccacacgcccagtccaacgggcggcctcgagatcgaactgccctgggcaacaggacgagttcccaagggtggcaacagggcgaaacaccggagggcaccatcaacctgggccccggacgtgaccacagggttccccctgagcgcccttgcgccctgcaccacgaaaggccacacccgtggccaggggccacccgaagcaagccaaggacccgcctgcgcctggctggcgctccataggcgcaccccaaacactggacacgaacgccaggcgcatgcgccaacacccaaacaaaaaccccgtggagaaacacctactacaccaaggggtgccaaggccattacataccggcgcaacgggaccccacatgtggccgacccccaaggaaaggtccgttatcatcggaaccccaagcgctccatccaccgacgaggcgccactggaccggaaccgacgtggtctccccaatcgccagaccggctgcacaactggctggccacgagggggtccgcaacgggagccggcccacccaggagaggcagcttatcctggcatgagaccccaaccaatctgggtggttactaatgcccctgggtaccttaggctcaacacagcactaggggaaagtgggccccccactgtgcctccctttcgatgtcggcaaaatggggaggcaccacgggatgacaagggcaaattaggctccgactccaacatggcaacgttggttcggcaccattggctctggcacctctagtctgattgcacccaatggcgagtcacagacgcgcgtcacccttgtcctctgcaaaggggtacactcttctctaacctcccctccgaaacggagggaatctgcggccaatcagaacccctctggcttgaggtgcagagatcaaacaagttcggcttctccaagcaaaaggcgatgtgggcctcatgcagccatccaaatgggcgcgggccag

SEQ ID NO: 601057 - DNA, 173 bp, Homo sapiens
  misc_feature (27)..(27): n is a, c, g, or t
  misc_feature (61)..(61): n is a, c, g, or t
tttactgttcacccgaccggcacaagnaaggtccggacccccatctgggagtttacaccgncatctcatgtcatgaagatactcatgcagtcctatggagaatttcattggatattccatcaaaaacagatgttatttcatcaggggttgtcacagtcacaataattggatgc

SEQ ID NO: 601058 - DNA, 370 bp, Homo sapiens
gaaaccccccagatattttctatgaatttacaattaactgcatttttaagtgggctaccatcataattaggggattcctgcaaatgagaaactcttgaggtagaacacattaatgggtgtgacacagaggcagtagataaatatttgaaaggggtgcatatctgaacttgtttccaaatggaaagggtttcatgaggtgacaggggcttttaaacattcattagaccgattattataattttccttgttaaatcattgcaacagttgcatgggggacaatggatattttttgaagaattgattattccactttcaatttttaaaaatcgaggggattaaaatattactttttaaatatgcatagaaaata

SEQ ID NO: 601059 - DNA, 741 bp, Homo sapiens
tggggggtagagggaggtaggtggtagtttggtgttataatattgtagagtgggggtgatgaggaatagtgtaaggagtatgggggtaattcatggtgggccatacggtagtattaaggtgtggggccattgggtgttaaatggaggtgaggcagggagttccgaggaaggttagttgtgtggcaataaaaatgattaaggatactagtataaaaaaatcaggttcgtcctttagtgtggtgtatggttatcatttgttatgtgaggttagttggattagtcatgtgtggggtgggtgatatagtcggtgtgttgatgaaatattgtggagggtggggatcaaatagagggggaaattagaatgatcagtactggcgggcgggttaggactggttgaacaggtggcataaagggcttgagggggataggctgctctgcaaaagggtactgaggggtaaaggatagacacgataggcctggggatggctcgcccgaagtcagcaatgcgtgggttgctctgaagcatgggggcaaccaccggctgtgaggggtaggggcgccaggggctgacacactggctaggatggcctgggacctgctgagggttgaggggatgtcagaaagaaaagggcgaggcaacaccaaaagggaccccaaccgaggggcggaaacacggagggcaaagaggagggttgacaaacatggaaaaggagctagcccgaatgcaggccagagaagtac

SEQ ID NO: 601060 - DNA, 381 bp, Homo sapiens
  misc_feature (6)..(6): n is a, c, g, or t
  misc_feature (79)..(79): n is a, c, g, or t
  misc_feature (124)..(124): n is a, c, g, or t
cgggangccaaggcaggaagatcagagccccaggagtttgaaaccagccccaggcaacattagtgagaccttatctctncaaaaaagaaaaaaatagccaggtacagtggctcatgtctatgancctagcactctgggaggccaaagtgcacagatcacttgagtccaacagtttgagaccagcctggacaacatgatgaaaccccgcctttacaaaaaataacaaaaaaattagccggctgtggtgttgcacgcctgtagtcccagctactagggaggctgaggtgggtggatcacttgggctcaggaggtcaaggttgcagtgagctgtgatcacaccactgcactccagcctgggcaacagagcaagaccctgcctcc

SEQ ID NO: 601061 - DNA, 147 bp, Homo sapiens
ctagtggacctgtcttcatcatacctacccgtcttcatctcccgggtcagcgattctcctgcctcagcttcctgagtagctagagactacatggtgcacacctacatgcccagctaattttttgtatttttatgtagagatggggtt

SEQ ID NO: 601062 - DNA, 175 bp, Homo sapiens
cctcaaactgcgcccgagctagtctcggatacctggtgcccgctgccatgctcagctcgcttctgcattttcagtaagatgggtttcaccatctctcgaactccttacatctagtgatccatttgctttggcctcccatagtgttgggatcacaggcttcagccaccgtgccccg

SEQ ID NO: 601063 - DNA, 510 bp, Homo sapiens
gcgagcccaagtctgctgtgcaggcattgattggcggtctcggggtgtttatcatcaatcacagcatctggctcgctaatgtccgcctgacgctcacacgccatagtatcgcctagacaccgaggcacttggagcgcatgaaaaaacgccccattgcttgcatgatgcactgattgcctcatagacctatgactagaacgctcccattttcgcacttactatggagctagaacgtgctccgttacccatcgcatattaccgcattcatacagatgtactaatgaacgtgttcctttctctaaattgagctcgaatatgatgcctcatatgacatatcaaccaggcacatactgttaggcttgacttatgcccggaggttataccgcaattgagctcatgcccccgggccatatatcacccctgtcttataccttgccaattttcttccaccctcccttgtctgggatacaagaattccaggaactatcacccacccgattcacccttttg

SEQ ID NO: 601064 - DNA, 478 bp, Homo sapiens
  misc_feature (71)..(71): n is a, c, g, or t
ccccccggggggggctggacccgcgcgggggtgtttttctcttttaaaaagggggcggccccccccggttngggggtttttataaaaggggggggtgtgggggggggaaaccccttcttcagaggggggggggggtctttttttttgggggggggggttttttttttttttttggggggggggggggttttttcccccccgttttttaaaaagaggggggggggggggcccccccccccccccttggggtgggggaaaaaaaacccccccttggccttttcccccaggggggggggggggggggaaggttttttttttgaaccccccttttttttttttgggggcccccccggggggggggggggcccaaggggggttttttttttttttttttttgggggggggccccccccccttgggggggtgtttggccccccccccgggttttccccccggggggggggggttttttttttga

SEQ ID NO: 601065 - DNA, 171 bp, Homo sapiens
gccgtcatcttaccccttcagaccacatacccaaattagctatattctcagtgttgtgctattcagctggctggctgtgctgcagtcacgctgtcccaatcctggagcatgtcacacattcattacacaggtgcaatgaagaaagagtgcatgcatacttctctctccact

SEQ ID NO: 601066 - DNA, 399 bp, Homo sapiens
atttacttcggaatttagagagttatgtgcacaaatttaaagttgaagtaagagacgatcgtggcataacagctatcaccaggctcggtaggtttgtcgcctctgccgataaatcctatctgtaatttgctacatagacgggtgtgctcttctagctgttcataggtagctcgtctggtttcggaggtctcagcattggctcaccttgcatagttaattcaagttaattcattatgcagaaggcataggggttagtccatgctatattatgcttggtcatacgatttaatcttggccatgaggtactagatctattgcgacaggtttcagattcaatcgcatatacataataagggcaaatggcatggcaaaggttgtatgctagagagtagttctgtc

SEQ ID NO: 601067 - DNA, 407 bp, Homo sapiens
acggcctacaagaggtcaacgttataacggttacgcatttgatcactacaggtacttgtagtacctagagaaggaacccatcctggggtcggtgcagctcggtattgctactcgctaacgagtagattctcatttacagagaaagcacacataagccaaagccagaaagcaatccaagccttacagttgtccaatacctcagggccagttggctagaacttttcttttccctcagcccataatcacttagagttagccatacacacaaacagcctgacaatctgaccagcatttccattgatataaaatgtaagcattccttcattctgtagttaggaactccaacttcagccttatctccaacataatttcccaatttaacctatgtactgatatggacatttctt

SEQ ID NO: 601068 - DNA, 389 bp, Homo sapiens
atataccgcaccgagcacgtatcgatctctctaataacggtggatgggcacacacatccagctgaaagaccgatctctctcttgaaaatgtacagtacgaacttgaaccagttttgagaacattagaagagataactttatcctgactgctgtcaatacagctgaagaaaacagagttagagagtgtatcaagtgccattcacctatgtgacaagaataaaatggaattatctctgaacatacctgtaaatcatggtccatcaagaggaatcatgtggatcctctcagctccatgaacatagtggttctcctgaaagttctaggtccctgccagctcctcaagacaatgatttataatctagaaaagctcaagactgttatttactgaa

SEQ ID NO: 601069 - DNA, 198 bp, Homo sapiens
aaaagaagaaatatgccttctccttggttgttccacagagttttagaaaaaatctgttaaggatgggtaaatgtcaaactaccctacgcagtcatactataccttagccatcagattgtacttcttcacaccaagctctgtttacattccgaaaggtgtcatgaaaaaagttctgttcaataaggttttggaatgtga

SEQ ID NO: 601070 - DNA, 175 bp, Homo sapiens
ggggggctttaaaaagggattaaaattacccctgggagggagaaagggacaaggaggggggggtgcatttttccgtcccccccctttccccccgtggaggggggggcagtttttaggggggaagtccccttctgttcagccccaaaaaaaaggggccgttccctgggtccgttta

SEQ ID NO: 601071 - DNA, 324 bp, Homo sapiens
gttgattttctgaactttttacattttttaaaggtatatatcatatgataatactaaaaatagtgctaactagatgttaaaaaataaaagagagaatggtaattatgattatgattgtgattatgactttgattatgatttttggttagtagaagaaaaggttaaacccttaagttttagctctggcttggctgctttaagatctggggtatattttagagtatacttttctctaaatgagtggttctgtgttcttgagggagttttaggctttgtaggagagctttcaggactttcactgcagggagtaaggagggggccaaa

SEQ ID NO: 601072 - DNA, 429 bp, Homo sapiens
atctagcaggataccccttaatacagaggctacagaaacttaaattagctgacttaagatgagcttagcagtggtgtaactaggtctaaggtccttttgaatcactgtagcgatcttaattttgctagatttggagttcaataaattgagtatcctgagttgcccttgctcttctggtctggcctgcacagggcccagcggagagatttgttcttgtgtcacttatagcttggtgtgggtactaacttagcttttttcgactttgtcttgtgattgaccgtggctataggaggattggacttttgagttgggctctgggtctcttggacaactttacaatttactggcttccaagacttcctgcttcttaacccccagccagactattcatggcccattcagatcttcattttcatcccacatgtgcaa

SEQ ID NO: 601073 - DNA, 150 bp, Homo sapiens
atagatcagtcataagcatatatgtactactcatgtagttcatttaaagctaatctgaatcagtgcatgtatgctagagtatttgtagctcatcctgatttcaagcagtttttaatagaaggcctttgttgttttcattaggtggctaaa

SEQ ID NO: 601074 - DNA, 691 bp, Homo sapiens
  misc_feature (307)..(307): n is a, c, g, or t
  misc_feature (320)..(320): n is a, c, g, or t
  misc_feature (382)..(382): n is a, c, g, or t
  misc_feature (391)..(391): n is a, c, g, or t
  misc_feature (394)..(394): n is a, c, g, or t
ctggaaggagatcagcagcagctgtgagtgctcttcctccctgggacggggtggctactcagtaggacaggcggcagcagctggagggccccgaaccctgtcatcccatgagcacctgtcatgcactcctcacagagatcgtgggcttctccctctttaatccgttgttgaacaacgtccacattaataattcagcccagctctgttgtgggacaaacaacccggagtgtagcaaggtgccgcatatttgcaggacaggatgaaagcgttctggagatggatgggggacatggctgtacaatgtggnggatgcacttaanaccactgaatttttcctttgaaaatggctaaaataatagattttgtatgtattttaccacantaaaaaatnaanctggccgggcatggtggcctacacctgtaatcccagcactttgggaggccaaggcgggtagatcatttgaggtcaggagttcaagaccagcctgggcaacatggagaaaccccatctctactaaaaatgcaaaaatcagccaggcgtggcggtacatgtctgtaatcccagctactcgggaggctgaggcaggagaattgcttgaacccgggaggcggaggttgcagtgagctgagattgctccactgccttccaacctggacgatggaacgagactgcatctccaaaaaaaaaaaa

SEQ ID NO: 601075 - DNA, 257 bp, Homo sapiens
aatacagagtgcagaaaataacccaagtgtcgtcagcagagagctggttgcttaactcacactcacagaggggacacatcatatccacctgaagtgtcaagcgtacgttgacacttcagaaaatcactcaaagttaggcacgtgtgaaccgaacaatgttctgttaacttctcattcagtatgaactaaattatactatgccttatacattctaattcgaaccacagtccttgcatattccaacatactgagaggga

SEQ ID NO: 601076 - DNA, 1140 bp, Homo sapiens
cacttccccagccagcatcaccttcaccacagggctagaggcccctcgggaacttggatggccaaggaagtgaccccaccgacaccgcacctgactcacttggactgagcccccagttccggcccgcaggctacctgacatcagacttccacacacccatggtggacagaaccaggagatcctgctcccagtgagggatcacatctcactcagcatccttgtgccatctttccctccacctcctacaatgcacgagatccaggccatgtggggccagagcctcctgaccgaccgatgtccacctcatttcaccacagggtgaggctgcggatccccattccccagggaactgcgagggcaggagctgcagacacaggagccggtgcctccaaggacccagcaccaatcttcctcaaaggaaaccagcagagcggaccctgaacagtgtcaaagcgaccatggagacagatgagggcgtagctgggcatgaatgatacacagcgccagacatgcaattggacacagacacaaaccttcatgccagagaacatgagacgaaagacctaatcacccaatggcaaaagagaacaaatctccatggaagcacgatccctagcgcaagagaccactgagcggacacctgcaacacagcccagacacacacacgagcaggaatgaactaacaccacatgccccgtggaccacagcgaaccatcgagcaccgacagacgagaacagacacccaacccgaatcccacccaagacaaacaccgcagcgcaaacaaataccgcaaacaacatgaagtccaaacaacggaaacgacacgaaactcccagcaacaccaaaaacaaccacgcataactgaccgataacaaggacccaaaaagaaagaccaccaacacagagagaccaacacaagaggaccaggcaaaccgacagccaaaccaacccaaggcccaccggaacaccagagccccagaaacagccaacgacctgaccacacagagacaaagaacacacaacaacccacccaacgaaagaaccacacacacacccaacgccagatacaaaaacaacaaacgagaaagacacaaaagcagaaacacaagccaaaaaagaaacacacagaaacaaaagaa

SEQ ID NO: 601077 - DNA, 735 bp, Homo sapiens
cgcggtggctcacacctgtaatccaagtacttggggaggccgaggcgggtggatcacctgaggtcaggagttcaaaaccagcccggccaacatggcgaaaccctgtctgtactaaaaatacaaaaattagccgggtgcggttgtgggcacctgtaatcccagctactcaggaggccgaggcaggagaatcgcttaaacccgggaggaggaggttgctagtgagctgatgatggcgccattggcactccagcctgggcgactagacaaagactctcttaatcaaaacatataaaaaatgaggccgggcgccgtggttcaaagccgggtatatccaagaacttggggatggccaaggcgggtgggatcagcaaggtctgggagatgcgagaaactatcgcaggtgcctaatgagggtggagaattctggtgctgcatgattagcatattacgagagcccattgtactcggggcagagctagtaggagaggagagtggtgggtgaagccagggaggaggaagtttccagcgaagggagatgatggggccattgtgtgtccagccttgggcgaagagagcgagattcgggctcatataaataggacgatccgggagaataattcattcaaaatgaaaaatctggtaccccatgttttcaagcgcatagaactcggtggggaagcgtaggttcactgggggaatttgggccacggaatcgagggagacatgtctaagggg

SEQ ID NO: 601078 - DNA, 122 bp, Homo sapiens
tacgcagtggtgctgaggagcgcctttatgcagctcctggttgaccaccttgaccacaaaacggcggccaggggaagtcggtttgcatttaacgattgccatgatgcaccccttccttactg

SEQ ID NO: 601079 - DNA, 369 bp, Homo sapiens
gcacgaggttcccggctccccgcaccatcatggctttgcctctgaggcccctgacccggggcttggcagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcaaaaaa

SEQ ID NO: 601080 - DNA, 138 bp, Homo sapiens
  misc_feature (109)..(110): n is a, c, g, or t
tgcagtgccgggtttcatgaaaggagccaggttgcttcttatgctggagaacattgacagaaggaaaaatgaaattgtccctatagattctaaccttgatgcagagatnnacttcaggacccatacacgaaacagctt

SEQ ID NO: 601081 - DNA, 770 bp, Homo sapiens
tgcgcacgatttgcaggaggagtgattgactgaatgtctagtgcttgatgtgtgatcgtctccactgactgtccctgtacttttctgtgaatgattgctgtatagatggtactcttgtctgtgaatgaagaaattcatagagtgcatcccgtgtgctcgatatgcagggaaattggctatacaaggtgctgcagcatcttctgaactgtgtgattgtactacctctatgttgagaagatgccctaaagattccatatcagtatgcctggtgcgtcatgctcgagcgagatattgattgggatggtccaagtacaactatgaagaagcttgctcgaagagtgatgtagcatgtatttgttgcacatgaccttgtgcccgaggatgatgtacgtacctcgtacaaaattgtttatttgcctaattctgcgattagttgctcatgcttgtaataggtattcctgcgccgtatttgtcaataatggctgttgcgatgtattagtatgttaaaagaaccctcgatgttccgtccatcgttttttcctttgcgccatttatcgtaatacctgttgatttgttcgcatactaaatcgcgtttaatttgctaaaccaaggattcggatcaacgctgaactattcgttggacattgccgggtttaatctcctcggggatatttattcctatatgacccttccttggcaccattcttctacacttaaggatggagtttgggaccacattgaagggtaaccattctcctgattccttggca

SEQ ID NO: 601082 - DNA, 315 bp, Homo sapiens
  misc_feature (1)..(1): n is a, c, g, or t
nattactggtcacaatatatgaagaactcctaaaatcagcaacaaactgattcaaaaatggggaaaggactttaatagacttttctccaaagaggcacaaatgaccaacagacacataaaaagatgctcaacatcacaattactagggaaatgcaaatcaaaaccatagtgagatactacttcacagttactaggatggctgttatttacaagacaaaaacaaaagcagaaaataacgtgttagctagcaagtggagaaattaaaacctttgtaccggctgagtgcggtgcctcacacctttaatccccggtcga

SEQ ID NO: 601083 - DNA, 117 bp, Homo sapiens
ctattatccagctagctgtgatcatatactatacagacgactcaacactcttgaccgcggggggagaccatctatacaccactatctgatttcggtcacctgacgctgaaatgggta

SEQ ID NO: 601084 - DNA, 126 bp, Homo sapiens
tgtacctccttctggcacgcccattcaacatagtcctcgctacagtatccacaagggaaaaaattaaaaggcatctaaaagaggaaaagaagaaatcaaattatctctcttaactgccaatatgat

SEQ ID NO: 601085 - DNA, 309 bp, Homo sapiens
aggctcagacaagagtcttaaaggtgggggaacgagcttatgatagctgaaacagactcggaaatagaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtgcacccagatgttccagactaagcgctgcttccggctggcccccacctttagcaacctgctcctccagcccaccaccag

SEQ ID NO: 601086 - DNA, 716 bp, Homo sapiens
  misc_feature (8)..(8): n is a, c, g, or t
  misc_feature (126)..(126): n is a, c, g, or t
  misc_feature (128)..(129): n is a, c, g, or t
  misc_feature (131)..(132): n is a, c, g, or t
  misc_feature (224)..(224): n is a, c, g, or t
  misc_feature (234)..(234): n is a, c, g, or t
  misc_feature (238)..(241): n is a, c, g, or t
  misc_feature (244)..(246): n is a, c, g, or t
  misc_feature (249)..(252): n is a, c, g, or t
  misc_feature (271)..(271): n is a, c, g, or t
  misc_feature (284)..(284): n is a, c, g, or t
  misc_feature (293)..(294): n is a, c, g, or t
  misc_feature (298)..(298): n is a, c, g, or t
  misc_feature (301)..(301): n is a, c, g, or t
  misc_feature (308)..(308): n is a, c, g, or t
  misc_feature (320)..(320): n is a, c, g, or t
  misc_feature (323)..(324): n is a, c, g, or t
  misc_feature (337)..(337): n is a, c, g, or t
  misc_feature (354)..(354): n is a, c, g, or t
  misc_feature (358)..(358): n is a, c, g, or t
  misc_feature (420)..(420): n is a, c, g, or t
  misc_feature (422)..(422): n is a, c, g, or t
agtagtgnactgactgaattatgcaacaacatggatgaatttcagagacatgagagtacatactacatgattccaaagctacatttagatgctaaaagtcacaacagtggtggtcttgcagtgagngnngnngggggactgactgaaaaaaaaggcatgacaaaactttctaaggtggcggaaatattctaaacaatgatctgggtggtgatgacacaggtgtnaatatttggntttnnnnttnnnttnnnngacagggtttcactctggnacccaggtcaggnggcaggggnncggncgngggtcantgcagccttggnttnnccaggctcaagcnatcctctcacctcagcntccnggggggctgggaccacaggcacacaccaccacacctggctaatttttgtatttttttgtagngntggggttttgccatgttgcccaggctggtctcgaactccaggcctcaagtaatccatctacctcggcctcccaaaggattgggaccactgatgtgaggtgtatttgtcactattcatctaactgcatacacattatctgtgcacttactgtatataaattatacctcaataaaaagtttatttacttctttatattaaatgtctattaataagctgggcgcagtggctcacacctgtaatcccagcactctgggaggccatggcgggcagatcacttggggccagaagtttgag

SEQ ID NO: 601087 - DNA, 617 bp, Homo sapiens
gtacgtggatcgtgcctgtaatccctgcactatgaagtgcttgatggcgggtcatgagagtgtagattgaacatctggctactgtgaaatccgtctctatacaattacaaaaaattagtccaggcgtggtgtgtgggcaaccctgctagtcacagcgtacatagagaggaggctgtgaggctagagagaaatgtgcgtgaaccatgggagagtggaagctttgaaagatagaagtcgaagaatccacgaccacatgtcacgtcacagtctggcgcagacaagaaacagagaacatgatcttctatcacaaacaatctaatttttggagaacaaaaaaggctcatattgatttaagctaaaaaaaataaccctatctataaaagggagtatgctgtggtgtgtgtggtgatatattaaatcactccataagcatattagtaaaagttacaatagtgaagcagatatggtcccaggagaagtgtagaaaactaatttaagggggccaagatggtgtgttcacaatcagacttgacaaactacctacaaatcagtaagcggcataagacggaatgtagtggtaagaaatctcctttcattcaagggtttagcggggggaa

SEQ ID NO: 601088 - DNA, 966 bp, Homo sapiens
cacgcgtccgcccaagcctgaagtttcagtgagtaggggtcctgacgtgagctttagcgtccccctttagcctccctcttcgattccttgaagaccctggtgcagcttaacaagagggcccaggattgttggatccccagccctgtgacaagggttcctgtccagttttccccctcccaggatttcgatctcagttcagcgaagtcaccgacccgtcctgagccaaatgaggacaccaaggtttaggagcacagctcccgaggcgccgtctacctaggccccgtcccctcctcccggctcctgtcgtgctcagctgctgagtagcccgtccctgctccagggctccttctctggggtccagggtccctttgtggcctctgcctcgggcggggcccttcagtcaccgtcgcctcggtctccctgactggttcgcaggcctgggctatcctggccgttttttcctggtcgggtctccgtggtgctggcgactgccgatgggctccctagtcccttcgctggcctccgtccttgatcttcggtgggctcgggctggtgtatctccacactctatgtgccccatgagccgggtttgagcctggagggcccggctcagccctgttcagcgcgtacatgcctcgtgcgaaggttgttgatctaccctcagcgcacctctatggctggcgcccgaccgtccaccgggctccgtggggcggtaagaaaaccctaccgagcaaattatcccgaagtcatgagcaccttgcttcactccccgtgcccaccttccgccagtaagcccaagcaccgcagatgcccttgtggcagattccacaccagcgcagaagcccaacatccgtcggacggcaacgcctagcgcaactgcaagtgtcaccccggaccgcgccagacacatacacacagactatgtaaataaacacaccagacagcgcacagcagggacacacaagc

SEQ ID NO: 601089 - DNA, 260 bp, Homo sapiens
cggtggagtcacacggggcacctgcagctttgctgggcagagactcctcgcgctactgctgctcccacctccttggccagggccagcctgtggccacgcctgaggtcatggcaggtggggatggatgagcctccagaggcgctgggtgggcagcccccgaccctcagcgcctgtcacctcagggcctctcaggtgtggctgcagcatcctctccaggaagtcttcctgttcaccccagccaggtccatgtggtccgagcg

SEQ ID NO: 601090 - DNA, 239 bp, Homo sapiens
  misc_feature (1)..(1): n is a, c, g, or t
ntcagtcggccggtagcggtcatctccggatgcgttgccttggcctggatgtgggcggccgtcgcgccgaactggttgtcgttgcccgcgacctgcgccttcatgcggatctcggaatggcgccgcgcccaggtgtgtcgcgcgctgattctccgaatattcaggccctcgaccagtttggtctcgatcagcgtctcgctggcgcgggtcagcaccaattggccggtcggcgagctggt

SEQ ID NO: 601091 - DNA, 200 bp, Homo sapiens
  misc_feature (124)..(124): n is a, c, g, or t
tatctcaggattcatttctctgctctacttttttgtggggcatggacagctttttttacggcctagaccagcaggcagcatgcagtcctgaactcgggttttatttccgtggcacagcacaggnctatgtgacacgccgtgttgctatgacggcctctggaaagcctgcattttgtaactgtctttgcacatacgccaag

SEQ ID NO: 601092 - DNA, 859 bp, Homo sapiens
  misc_feature (1)..(1): n is a, c, g, or t
  misc_feature (4)..(5): n is a, c, g, or t
  misc_feature (218)..(218): n is a, c, g, or t
naannccataaatacaagtcataaaagacaatacgataagaacaaatctgtgtcttacttaacttgaaaatttggtcgccccattatcccttcccacgtgttggcgcatataagatattatatgttacacgccatttcagaccccacacctattgagtgaccccctttaatttagaggcctttgtttaagcatccgcccccccaagaatccctgttcnccaaacccataattttccggtggcacaaaagttctgcttgcccccttcaatcaacagcgtgtctccgtattttgggcaccacgggtctgtataaaccttcccacatcccggagaattcaatgtcacgctccccccgcccacataaaccaaacgggtaaccccaccccacaagttaccaactgggccgcctcaatcatctgtgtttaacgagcccccccctgcaagacccgagacaacatcatcggtcttttaagtacattatgttgtaaacccgcaaataaatattccgctcgcctatatcaatagcaacaatcttttgatctctacttcggtccaagataatgtcactccacctgcaccccaagggtgaacaacccacttttaaacatgctgcgtcagtatatattccccataagcatacaaaccctgcagcaggacccaattcccacaaatagcggtttggtcacatgcactaacagacccccgcactggttggcgaccccccaataacccccacattgtatataaaatacaccaacacgggcttctacccacatagataattttcttgtttatctgtatgcctccccggtgtacaccgggaaaagttttttattaaacaagacccccccaacaaaaca

SEQ ID NO: 601093 - DNA, 217 bp, Homo sapiens
  misc_feature (27)..(27): n is a, c, g, or t
  misc_feature (51)..(51): n is a, c, g, or t
  misc_feature (68)..(68): n is a, c, g, or t
atcacctaatgcccacaaggtactctntggatatccccttggacaaaactntcgtcaataaggatgtnttcagagatcctgctcttaaacgcaaggccccgacgggaggccaaggtcaagttttgaaggggagatacaagacaggcaagaacaagtgggttcttccagaaactgcgggttttagatgctttgttttgatcattaaaaattataaaga

SEQ ID NO: 601094 - DNA, 597 bp, Homo sapiens
ccggtaccaaacctgaagttgccaaatacttccagtcactgatctttgacaaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttgaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatccagaatctacaacaaactcaaacaaatcagtaagaaaaaaacaaataatctaatcaaaaggtgagctaaggacatgaatagacaattctcaaaagaagatatacaaatagccaacaaacttatgaaaaaatgttcaacatcactaatgat

SEQ ID NO: 601095 - DNA, 212 bp, Homo sapiens
  misc_feature (65)..(65): n is a, c, g, or t
  misc_feature (99)..(99): n is a, c, g, or t
tcgtcattattgtaaccatagagcatgaattacctcttgaggtcatcagcgacgaatttacgacntggtcaacgaaacaggctacgtgaaattcccctnaactactatatataatatataatataatataaatattaaatataaaatcaataatatataaattaataatataaatatatataaaaatattatatatataaatgaaatgataa

SEQ ID NO: 601096 - DNA, 170 bp, Homo sapiens
tctctattgtttgtttgtctctgtgtgtctatgtatgtgcttattgtctgattgctagacgaccacacaccgtgagcccttgcgggccgggtggtgctgcgtgcactcaactgatgtgaagcgtgaccgactagagtagactccagtattgaacgagacaaaggcccatg

SEQ ID NO: 601097 - DNA, 107 bp, Homo sapiens
gagatagcaatgactctcaagcatttgtggttctgaagatgtaggctctagctcctacggtgctgtggacatattgatgctgtaggtgccatcatcatgattctggg

SEQ ID NO: 601098 - DNA, 230 bp, Homo sapiens
ttgttcatagctccagtacaacagctagctttaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctg

SEQ ID NO: 601099 - DNA, 1368 bp, Homo sapiens
tcacaaaggggtttccagttttataaaaaatatttcccatataaacaactcggggtattccagggcagggacggggcgcagacaacctcggtaccaggtattacaacaactttccaaacctcccttctctctcaaggggcactaccaattaattaaaaaacaaagaacaccaaaaaaaaaaaaaaaaaaaaaaaaaaaaaaaaaaaaaaaaaaaaaaaaaaaaaaaaaaaaaaaaaagagaggggggggcgcgcgccaacaaagaaatctccccgcggggggcgcgcccccgctccgcgcgcgccaccccgcgttttgggagaacacgacgggggcgcgcccactaagagagaggagcgacgagccatctatatatataaagcagagagcgagaggagggggcgcgcgcggacatcaaaacacgacagcgcgggcgagcggggaggacacaacgagggagcccggacggggcaaacactggaggagagagagagagacacccacaccaatgacgcggcggggggaggagcgcaacacaaatgtgtgggggggacaaacaaaacaccacccccaacgacgaaagcacatataacacacacccacagcaagaggggcaagacacacatccacaaccgaccgccccagaagcggatacatactacgagcgcgcggtaacacccaccacacaggcgcgcgagcaaataatgcgcgcgccagcgcgcggaacaaaaaaacacaatatcggccgccagacgcgggacagagcacgacacacctgacaccaacacaaaaactctccaccagaggcggaatcgaacacccacaacaccacaccaccagagaaagaccacacacacccaccgcaccgaacacccacacgcaaaacaacgaagagcgaagaagaagaaaaaacaacaggcagacacgagagaggacgagaaaaagaaaagacaaaaaaggagagaaagacacggaagcaaaagacccaggaaacaggacagacaaagacgaagccgaaaacaagaaagagaagaataggcgaaacgagaggaaagaagacgggcgagacaacgaaagcaaaccagcgcaaagacacacaaaaaacaaacacacagcaaagcaacacaaaacaacgaacaaagagacaagaaagcgaacacagagaaaaaggggacgcacaacagggagggcgggcgaggcacggacggggaggagggagcacgaaggagaacgacgagcgaggcgaatgggaagtgagagagaacagaggcgagaggccagaagacgacgaacaacggaaagaacagcggaaagagaaagcaagaacaagaacacccgggcagaaaccgacagaacgagaaagcacga

SEQ ID NO: 601100 - DNA, 810 bp, Homo sapiens
acaccagaaaatacatattcactaaaaaccccatgaacagccttgaaagtgggaaagcttacattgagaaagtttgcacttcatcatgccccagagaagtaagtccttctgaagcaggagcgaccacgttatgaggttaactgttaacaaggtactaaaaagcttaagggacaccagacaaatttgtactgacagagaaagacatgcatatgattaaaacccgtgtgtccaaacagagaaacctgcaagcagagcataagtggtgcacaaggtttaggcacattttcacatcaaacagatggcgaacagcaacaatggaggcctgatgtcatcatcgctaccaccatagatctggcagcatcttcgggcagtaaacaagaaaacattcaagtcgtcaaatattgtgaacaggacacagacagcaaataggatgacatggtcatctacaactaagtattaaggactcctgtggatatcgattgagccagagcagaaagagaattgcaaacacaaagagaacgctaagccactacgagttacgaaattagggacattattgatccaacgtggcaatcggggacagctcgcggaaaaataccatgggacacataataagacaggaaaggaggggccgggataggaagtggaagctcacaaaagggcgggacgaaagacgtagaacccaatgaaagcgatatagcaacaaaaaagatggaaagtcccaagacagactcgaacacagccagaaacagaaagggaagaaaggcgaatggcacagaaacagagaccgatggaacccacgcaggacac

SEQ ID NO: 601101 - DNA, 178 bp, Homo sapiens
ggaattaagatgctacctctcagcatgatgatgataacatcgtcaactaccagtggtttttcttcaagagcttcggataaagatataactgttccaaagaacacttcattgccacctcggtggtccccagaagctgaacgtcctcactcactctcacagcacactgccagtcagcgag

SEQ ID NO: 601102 - DNA, 655 bp, Homo sapiens
  misc_feature (41)..(41): n is a, c, g, or t
  misc_feature (71)..(71): n is a, c, g, or t
  misc_feature (94)..(94): n is a, c, g, or t
  misc_feature (138)..(138): n is a, c, g, or t
  misc_feature (151)..(152): n is a, c, g, or t
  misc_feature (162)..(162): n is a, c, g, or t
  misc_feature (237)..(237): n is a, c, g, or t
  misc_feature (272)..(272): n is a, c, g, or t
  misc_feature (278)..(279): n is a, c, g, or t
  misc_feature (325)..(325): n is a, c, g, or t
  misc_feature (369)..(370): n is a, c, g, or t
  misc_feature (382)..(382): n is a, c, g, or t
  misc_feature (403)..(403): n is a, c, g, or t
  misc_feature (418)..(418): n is a, c, g, or t
  misc_feature (443)..(443): n is a, c, g, or t
  misc_feature (449)..(449): n is a, c, g, or t
  misc_feature (499)..(499): n is a, c, g, or t
  misc_feature (579)..(579): n is a, c, g, or t
  misc_feature (652)..(652): n is a, c, g, or t
tttattttttttttttaatctgggttttttgggtttggtgntttttgttcattccttcacattgaataggnggaaaactaaaaatgattttganttcactcgatattttggactcctctgatgaacggttctttgcantcacacttggtcnngagtagaganagagtgaggatatgttgtgtctcccacagggccacgacgcacctgatcaaataatcttgtgttacatgtgcaagnatttcccaaaatgattgtatcatcatttccaaaancttgcnntaacaacaccgaagaaacaataaatgtttaagccacactgtttggnttggggtctttcctgctttttttttttttttttttaattgtttnncttacagagggnatggggggtagtggtgtgggnaagggcagactcganggacgtgtgcggggcaggagggggnttccgngtggggctgggggggggggagggggggtctgggtcggggggggggggggnggggttgtgggtagccatttctttgagttcaggcatgttcttggtcagcctcaggttcctcttctttaccctcgtcctgncgggcactttccttaggtttggtttcatctacagcttctatgttctcttcagcttggctgcactccccagtcnccg

SEQ ID NO: 601103 - DNA, 392 bp, Homo sapiens
ttgaatgacaaagccaggtttattgttctgggttaaacctgtgcagccagcctctaaataggggcacgggtacatatcacgttagtaactgtatcttcatggtcacttgtgggttctcagctcctttggaccctgctaaagttctagttaaggcccagtgctggggcacacgctcctaatccaaacagtgcagcctgtggcatgcctaccatgtggcaatatggaggtaggaggagacgatcatgccgtgcatggaggccactcttcccgcgcccttcacacaaaggggccacagggaccccgcttcctgctcgcgcagcacagcggtctcaggcctagagggctccgttacagttaccgctgcccgggcgggtttctgggccgcggctccc

SEQ ID NO: 601104 - DNA, 254 bp, Homo sapiens
catggcctactgcctctagacaccacctctgtgggcagggcatagctgaacaaaaggtagcagacaacttctgcagacttaaatacccctgtctgacagctctgaagagagcagttgttctgcgagcatggcgtttgtgctctgagaacggacatagtacctcctcaagtgggtccctgaccccccatgtagcctaactgggacacctcccagtaggggccaatggacaccttatataggcagctgcctctggg

SEQ ID NO: 601105 - DNA, 1313 bp, Homo sapiens
  misc_feature (548)..(548): n is a, c, g, or t
  misc_feature (633)..(633): n is a, c, g, or t
  misc_feature (659)..(659): n is a, c, g, or t
  misc_feature (685)..(685): n is a, c, g, or t
  misc_feature (691)..(691): n is a, c, g, or t
  misc_feature (695)..(695): n is a, c, g, or t
ggctactgcacattcatcaacactggtgttctattaacactgacctgttcgagtacaagtttgtgaactgccgtctgataaacagtacattcctgcgcaacaaggagggctgcccgctagatgtgacagggacgggcgaaggtgcctacgtggtatacttgtgatcttcctggggcacgactggcagtgcttcctgtgcgaatatcggtggtctgccctgcatcatggacaagatcggcaaggcgtcagaatgcttgctggcgtccagcgtgaatgttcctggtgttctccgtgtttctctctgtctggagggaacagtgagtcggctatgatcgcgtctgctctgcctttttggcggcgtcagcgattgcatcctggaatgcgctggacgtgtgagtgtagaactctacccctcagagaagatgcgaccacagtttgttgagcttcctgaatgcacctgtgtaagcctggcagactgtgctggggatcaggatcttcacatccttcgtgggaatcaccaaggctgcacccatcctctttgcctcagntgcccttgcccttggcagctctctggccctgaagctgcctgagacccgggggcaggtgctgcagtgaaggggtctctagggcttngggattggcaggcacactgtgagacnaacaactccttccttcccctccctgncctgcnatcntgactccagagcctcaactccacacactccacacgtgtaatggatgtctatacgctgtagtagtgcgtagtgcagtgtgcatgtgtgtaaaccccgatgggcagggactacagggaaggctccttcatcccagttttgagatgaagctgtactccccatatatcccacatgcccttgacatttgcacaagagaaggctgagccaccatccttctcccccgtgtaagagaggggcccttgctatccctgtatccaggggttccagaataaggcattcctgaccttccaccatcatatccctctgactaggcacctggtgaaaacacaggtatgcaattatgctaggggctggggctcaggtgtaaaccatggaccaaaagaacctcttagagatctgaagagtgggcctcgggatgaccatctcacatctcactgtgggatgactgggggagaagcaagaacacatcagaccatctggccatccaatttttactgtaaaataatgggaaggaaatattgaagcctgaattttatgacaattaggtttatggatcttattaattaaatagatcagttctacggggctccgaagattggggtgatgggatgatattaatta

SEQ ID NO: 601106 - DNA, 653 bp, Homo sapiens
tggctacaaaagggggtaaagggggtgctatagggtaaataggggccctatttacaaagattttaaggggaattaattctaggacgatgggctatgaacactgtgggtttggctccaaagatttcagagcattgaccgtagttatacccccggtcgtgtagctggtcgacaagtgggttgggtatacagactgtccgggaattcgcatctggtatcttaagcctaatgtggggacagctcatgagtgcacaagacgtctgggtgagtggtaacttatatatagcaacagtgggggtcttcaaactggggaagatacatatctgcaagtgtgtcaacgtccaaggagttcgacaggtttcgcgcatgggtacttaggacataacggggggaagatatgataggagttttgaaaagactttaatttccgtacgatataacaggaggataattcagaaagaggttaaaggaaccaataggaggagtgccaaatagaattgagaagtggcacagggaggagatacggaagacccacgatccggaaccgtcaaacagctcgcagtaacgacccagcgaacgggcagaacacagcctagagaaagacggcggagcaggcaacaccagaacggcacgactccccacgacgcccgaaaaaa

SEQ ID NO: 601107 - DNA, 349 bp, Homo sapiens
gactctacaggatccccctgtgttgctcaggtctcagcatgggagacgaggactaggtgagttattgttgaatagggtacagtttcatctttatgcagagcatgactgcgttagtgtgatatggatgctggtaattttggaagcccatgtggggttccctggaggtctgttaacttatgatctactaaacttgagctattgtcagtgctatgggataagtattacgcgtgaggagagacgggtgtctggagaaagaggtgatactcttgttacctatcctgagatggctggatggcatgcgctcccaccatgaagactggtgctctcctgggactgctttcatcttatg

SEQ ID NO: 601108 - DNA, 697 bp, Homo sapiens
  misc_feature (476)..(476): n is a, c, g, or t
  misc_feature (494)..(494): n is a, c, g, or t
  misc_feature (557)..(557): n is a, c, g, or t
  misc_feature (567)..(567): n is a, c, g, or t
  misc_feature (599)..(599): n is a, c, g, or t
  misc_feature (676)..(676): n is a, c, g, or t
  misc_feature (697)..(697): n is a, c, g, or t
gtctcaggtatgtctttattagcagtgtgagaatggactaatacactacctaaagcaatctatagatttaacgcaatcccaatgaaaattccaatgtcattttccacagaaatagaaaaaacaatcctaaaatctatatgaaaccgcaaaagtcctcaaatagtcaaagcaatctcgaacaaaaagaacaaagctggaggtatcacataacctgatttcaagatacactacaaagctactgtaatcaaaacagtacagcactgtgtaaaaacagacatataaaccagtggaacagactagagagcccagaataaatccacacctttatggtcatttgatttttggcaaaggtgccaagaacacacaacggggaaaagatagtctcttcaataaatggttttggaaaaactggatatccacatgtagaagaatgaaactgaacccttatcccacaccacatacaaaaatcaactcanaatgaattaaagatttanatgtaagtgctggaactgtgaaactactgaataaaatataggggaaaagcttcttgacattgngcaaagactnttttggatatgaccccgatgtgcacactttanatatatacaatttttgtcaattatacctcaataaagctggacacacacacacacacacacacacacacacatttggnatatttgggggttaccttccn

SEQ ID NO: 601109 - DNA, 112 bp, Homo sapiens
atttcgcattatgagggtggtcggagacgactaagagccatacgatcgcccatatcagtggcgggattccttccacgaagagtaccgtccgccaactgaaatggtcgaggag

SEQ ID NO: 601110 - DNA, 176 bp, Homo sapiens
gtgaagagagtatagtaaatgcctcatttaataacatactccttaaagaaagttgccttttactctaccaccgcttgagtagatccagtataagatagaaactcatgaaagtgggtggagcccatctatgacccctcctcttaactaggacgcactatctgtgactgtgactttac

SEQ ID NO: 601111 - DNA, 129 bp, Homo sapiens
tttccccagagtctccaccccaaacagggagctctagattagatgagagagctcccagtcacactcgagagatttgtgctattgtgctccacgctaaagtgcataaataaaagcgatctggtggcctta

SEQ ID NO: 601112 - DNA, 225 bp, Homo sapiens
taaatcatcttccccaatgtgtctgtgaaaccatgtgaggaatggcccactgtatcacatgccatcagcatcacgcactttaaactgcatgcctgcctgaatgaagtgacatgctggagaaccaggtaattgcatttgaatatgtgatgagatgcagcgattggacacagattaagaactggatggcctactgtgtcgcctatgcacgaggagagcagaagcccc

SEQ ID NO: 601113 - DNA, 552 bp, Homo sapiens
cacgaggcttgatctcagctcactgcaacctccaccccctgggttcaagtgattctcctgcctcagccacctgagtagctgggattacaggcacccaccaccatgcctggctattttttttttttgtacttttagtagagatggggtttcaccatgttggcaaggctggtcttgaactcctgacctctggtgacccacccaccttgggctcccaaagtgctaggattacaggcatgagccaccgtgcccggccccggctgctccttctaatcctgttgttcactgcagcacaaagtatttctgaacactggagaattatatttctgggaggcgccattgcctctacagaggaggaaatttaggcccaagtaggaaaaggacttgctcagcatctttgcagctcactggcttaggcaggatgataatccagctctccatactacctcatcatttcatggcatcagcacctactttgtgcagaaagatgtctctgggatagctgtaggtggggctgaaggagcccctggtccctgggcagtgacaggctgaata

SEQ ID NO: 601114 - DNA, 671 bp, Homo sapiens
gatggcggcctctagtggggctgggaatagcctgctcatgtctggctaacggagcggtgtggggcctgcgtgctgaatgccgcctccgcgccttccccgagcggctggccgcctgcggtggccgaggccgcggcgtacggcagtgtgctgtgcatgtgcctccactggcccctgggctggcctgcctgagtaatggacttctgcgctgctgggagttcgaggccctgcggagctgcttcgcctgctgcggtagtgtgggctgctgggccccttccccccttcccatgcccttcccctccaagatgccagctgggccccggctttcctttgctttccctgtttggttcaatggtttgagctgcctgcctgctgtgctttagactgcctggctgacaaaatcacctgatgccatctgacgaagcccgcgaaacctcggccgtcctgggcttgtccctgcatgtttgtaaagcgggactggcaccaacctcagaaaggatgggagatgtgtgcaaaaaagcgccttgtaaaacgcgccaagaagacgctggagtggaggctgttaggagggactctgagcttcacacctgtctgctgccatgggtgcagagccctagtcctgatggcccctggttggcacatatcgaatgcctaggcagaaaggagtgggatgc

SEQ ID NO: 601115 - DNA, 171 bp, Homo sapiens
gagagagaagatgactcagacttatgcttttgagaccttcaactacccggccatgtacgtggccatccagtgccgtgctgtccctctacgcctctgggccgctacctactggcatttgtcactggactctggagacggggtcacccacactggtgcccatctacgagcggc

SEQ ID NO: 601116 - DNA, 231 bp, Homo sapiens
tgttgctgaggtgacctagagttcccagaacactacgagccactgccattttggtacagccatttagtgtaacagccatttatggtaacatgccatttaggtaacagccatttaggtaacagccatttaggtacagccatttatgtaacagccatttaggttacagccatttaggtaacagccatttaggtaacagccagttagaggtagggtaccgtagctcgtaattcg

SEQ ID NO: 601117 - DNA, 352 bp, Homo sapiens
gcttggtcagctggttgctatgttatttttttctatgacggagtctcatgtctactcaccgagaactggaagctcgctggcacgatcccagctcactgcaacctcatgcctcccaggttcaagcgatcctcccatcctggcctcctaaatagctgagactacaggctcagcctcccaagtaactgcgactacaggtgcacgccaccacacccagctaattttggtatttatagtcgagacagggtttcaccatgttggccaggctggtcccaaactcctgacctcaagtgatctacccgccttggcctcccaaatggctgggattacaggcatgagccgccgcatctgacca

SEQ ID NO: 601118 - DNA, 254 bp, Homo sapiens
gcgacgggtaggtatagagggaagtgaaacgaaagctacagtgggggtgaaggcgacggtgtgggtggcggagcagagactggcccatagtaaaaagtaatgtggagcgttgtggccggcaggagtaagagtattaggggtgcgcctgcaagtgggaaactgcgggtgcatccaatagttgataccggatacagaccgccggcggggccagaaacaaggaaagatgcaagtcaagatagagggtgacgaccggc

SEQ ID NO: 601119 - DNA, 784 bp, Homo sapiens
cgggtcggcgggccgcaggagggggtcatgggtaaagattactaccacgacagttgggcctggcccgcggatgcgtctggacgaggagatcaagcgggcctatccgccgaccaggctgctgcagctgaccacccggacaaagaacaaggagcccggcgaccgaggagactgttcaaggagatcgctgaggcctacgacgtgctcagcgacccgcgcaagcgcgagaatcttcgaccgctacgggggaggaaggcctaaaggggagttggccccaatgtggcaggatagctggctggtggtgccgatggtaccatctttcagcgtactacattccagtggcagacccgtcatgccatgtttggcgtgagttcttcgagtggcagaaatccctttgacaccttgtttgggcgcacgtggaacggtggcaggaaggcagtggcagcattgatgacccattctctgtgcttccctatgggcatgtgggtggcttcagcaacgtgagctttggcggtccccgctctgccctaagagccctgcccgaaagtaagcgatgatccccctagtcacccacgacttccgagtcatcccttgggaagagatctacagacggcttgtaccagggaagatgaaaatctcccactaatgcggctaaaccccgacggtaaaagagcgttcgaaatcgaaagaccaaagatattgagcatcgaagtgacagaggggtggtaaacgaactgaacaagatgatttcccaagaaggggaccagacctccaaaattccgtgaat

SEQ ID NO: 601120 - DNA, 237 bp, Homo sapiens
gctgatttaatcaggaaggtcgtatgtttcaagaatttatccatttcctctagatttcctagtttgtgtgcatagaggtgtgcatagcagtctcgaaggatttttattgtatttctgtggtgttggttgtaatgtctccactttcatttctaattcagcttatttgaatgttgtctcttcttttcttggttaatatagctaataatggtatatcaattttgtttatcttttcaaaga

SEQ ID NO: 601121 - DNA, 385 bp, Homo sapiens
ctctagctccggggggtctggtgggtggatagggcagtgtggtctccttagtactggagtggtcattacctctaccattatggaataaaattatattcaggtattgaggggtccagtaactaataatggcgtgaggtattacacttcacaaaatacttatataatcttacagtcaggggccagggctcggggctctctcacatgagctactctcaagctaagcccctgcaatcaaagcaggtcttcggcatcggatgtctatgtacattcctggcttagcttggacatggtccagggtaccaggcaggccagcggtcctttcgtcaggtacgcccagtctattggcctcagctaagcggagggtcaggatgcaaagcagggcagg

SEQ ID NO: 601122 - DNA, 910 bp, Homo sapiens
aaggaagaagcaaagtaaaagagtgcgcacctcgagagttgctgcgcgctctggtaaaagtttcgtaatgtctttaaggcaggttcacacatggatctcgaacaggacgtcctgtggtcctcgcgtatccacggagttttggtccaccgaagggtggtctcttactcgcttacagaccacagaggtcgtctatatacagcgaggcataactttctttgaacgtagagggattatttgccccattaatactcttactcgcgcaggtaccactagtttagtaagccatctagcgagtcagcacgcctcttcccgttcctggtagtttccggctttctctgggaaggccttcgggtctcccttcctctcaggaatttaaacatgggcgtccccgtccggggggcgtaacaacacacggtaatcgtctcgcgtttctctcaagcagactgaaagtccgcaccggggtgatgcggacaatagttacagtttgcgtctcgtagaagactatgaacagacgctctttcgatgatcccgggggaacattcttggcgtgagagtgaaacattcacaatagaatgccgaaatccggtgttcagaaacatggtggaaaggattctctatttgccacactggattttgctacgtgtctgaagaaaacatgtaacaaaaccagtgcttgaatagggcgtaatttgtagctccactagtgccggctaggtataacatgagccccctctttgtgggcactccacgctaataaagggggaaacaccactctggaaatacaggcccatagactgggatcccacattccaagcataggcacggaccaggcaattcttcgcttgggaaaaccccatgtctattttcttcacgagacaaaaaacaagctttctataccccccacataaca

SEQ ID NO: 601123 - DNA, 965 bp, Homo sapiens
ggataaatgctgactccgctcggaaagttctcaagtgcagagtttgctgtccggctgcctagggtctgggaagctcgggcaccctccctctccggggcgtcctgactccacagcccttccggaaccccccatcgtcgcgctcctccaggctgggcctgtggaacgcggtgtctctatttacatttagcccccagactcgagaatcttagctggctcgagtgcacctccaggagagacatagcaatctacagaaggagaacgatgtggaagggtgtcagcatctagctcgtatcgtcaggaggaacgcgcagtcagctctgggtcctgggcgaagaaggagccagtactaggcacagcctatgaagatgacactgagacgtactagcgtgtggaatggcggcgtatggcgatgcctaggtgccgaagtatgatgtggtgactcctaggtaaccagactgaagaccagctataaggtcatggcttgaacaacttctggtggcaatcgcatgtgtcaagcagtgtaactaggcgattcgcgattcggaggcatctgccaaccattcagcacagtcgacatgtccacgcgcgaagaacaaagtccagagcgccgacagacttcaaacagttgggcaccagtcaatccacggagaaagtggatggagacacacagacaacagttgagaaacgatggttgtcaacagtgaccctggttggaactcatagtaggggtcttactagccattcggcttcattggtggaatcatcgtaagggttatgcgcaacaatgtcgggaaagggtactcgccctaaagagctgaaggggtacgcccttgtgacaaacgtgcttaaaagaagaccgttctggatctgtgcacggtccctgagctcgtgggaaagatgacccggggaccaattggctggccaatcagaatccacggaggaactctacggtgccaaaataacga

SEQ ID NO: 601124 - DNA, 301 bp, Homo sapiens
  misc_feature (262)..(262): n is a, c, g, or t
gaatgcctttaacagcaccctaatcacctcttgaatgctttgctgcttagaaatttcctctcctagataccctaaatcatctctctcaagttcaaagttccacaaattgttagggtaggggcaaaatgccgccagtctctttgctaaaacataacaagagtcatctttattccagttcccaacaagtacgtcatcctcagccggggaccttactgtccatatcgctatcaggcttttgggtgaaagccatttcaacaaggantctatggaaggttccaaacttttccccacattttcctac

SEQ ID NO: 601125 - DNA, 574 bp, Homo sapiens
  misc_feature (228)..(228): n is a, c, g, or t
  misc_feature (317)..(317): n is a, c, g, or t
  misc_feature (320)..(320): n is a, c, g, or t
  misc_feature (401)..(401): n is a, c, g, or t
acccgtccggcccgcgcccccgggtttaggcaattgttgctatcggggactcaaaggcccacgtcggtttgggtggaaagtgttccaaggaggtggcccccgccacccgtggggccattatcctggccaagctctccatggtccccgtgcgcaaaggttattgggggaacaagattggcaagccccccactgtcccttgcaaggggacaggccgctgcggttttgtgntggtacgcctcatccctgcacccaggggcactggcattgtttccgcccctgtgcctaaaaagctgctcatgatggctggtatcgatgantgntacccctcagcccgggggtgcaatgcccccctgggcaattttgccaaggccacctttgatgccctttttaagacctcaagntccctgacccccgccctttggaaggagactgtattccccaagtttccctatcaggagttccctgacccccttgtcaagaccccccccaaagtttccgtgcagcggactcaggctccagctgtgggtccaacatagggtttttatccaaaaaaaataaagtgaattaagggtga

SEQ ID NO: 601126 - DNA, 103 bp, Homo sapiens
gttcatagaggatcccgatattttacgggaaagaggtaagctgtctgtcggggactggctgaacgctctacagagtgaggcgattgacctgctcaaacgtatc

SEQ ID NO: 601127 - DNA, 522 bp, Homo sapiens
cggacctgtatctgtaggatgttctggaatagctcggcgaatagagattgattattctcccaggatacctaattcaatgaactcgagaattcatgagacggagacatattgtcatgttgtgcaacataggaccaaatacaatgcagtatccttgctgtgctcgggatcaggctgtccgtgggcagcagaatcggtgtgaagcctctgttcgcttgtcatgatccccgaggttcagagggacggtatatcagcaggaaggaggaaacatccgagccaacattattcttgttgcttaccgatgatcaagatgtggagctggggtccctgacatggtcatgaacaaaacgagaaagattatggaacatgggggggccaccttcatcaatgcctttgtgactacacccatgtgcttgccgtcacggtcctccatgctcaccggggaagtatgtgcacaatcacaatgtctacaaccaacaacgagaactgttcttccccctcgtggcaggcatgcatgaacaacca

SEQ ID NO: 601128 - DNA, 270 bp, Homo sapiens
caggttgacaggctggcaggatcaagaggtacagggactggacgaggcatggagtggtctgaaaacagaggggcccccatgtgctttccctgcattccaataccatgtgctaaaaatactggatgagcataggccgcgtgtggtggctcacgcctgtaatcccagcactttggcagaccgaggcaggccgatcatgaggtcaggagtttgagacctgcttagccaacatggtgaaaccccgtctctactaaagatacaaaaaattagcca

SEQ ID NO: 601129 - DNA, 842 bp, Homo sapiens
ggaatccgccaacgtccgaaagtagtctcatcaacaatccgactaatcaccaccccaacagagtgactaatcagactaacctcaaagcaaatgataaccatacacaacactaaaggacgaacctgagtctcttatactagtatccgttaatcatttttattgccacaacgtaagctcctcggagcatcctgcctcactcagtgttacaccaaccacccaattatctataaccctagccatggcgatccaccttatgagcgggcgcagtgattatgcggctttccgctctaacgattcaaaagatgccctagctccacttcttaccacaaggcacacctatcacccctgtatcgcgccatgactgagttattatcgaagaccatcagcctactcgattcaatcaatagccctggccgtacgcctaatcgctagcattactggaggccacgcgtactcatgctcctaagtaggaagcgccaacctagcaagtatcagactgtaaccttacctgtacactttatcatcttcacaattctagttcttctgacgtatcataggacatccgctgtcgcccttaatccaagcatacgtagacacacctactaggtagcctctacctggcacgacgaagaacccaaccactgactagtctgcaaagaacaatgcaggaccgaagaaatacacccccgatccgaaacaggcgactaaccgaaacaggtgccgcgcccaggccaccggagaacagacaacataccacactgcagcacaacggcaccgtcacaagcagagccacgccagacacaacaataaacaaacgcagggagacagcagttaccacccat

SEQ ID NO: 601130 - DNA, 265 bp, Homo sapiens
agaatgtgtgccgagaatgatagactggatacagaaaaaggaggactgattgaataatacttataaaataaacaaataagtcctcagattacgtattaaaactggtacccaaatctcaaccctatcactccagtgtttacacttaaatctttttaggggatgggcatggtggcccatgcctgtaattgcagcacttagggaagctgaggcaggagaatcacctgagcccaggagtgttcaagaccagccggggcaccatatggag

SEQ ID NO: 601131 - DNA, 115 bp, Homo sapiens
tcggcctcggtggtgtgttgtcatttcgcggttcttagaagagtatttgagtttcaacgggaaggggtctaacgttgcttggggcgggaaactgttgaaaaaacctgttaaccgg

SEQ ID NO: 601132 - DNA, 107 bp, Homo sapiens
cccccgagaaggccaatacccgggaaaaactttgtgaggttatatattcgcagcaatccagatctctatggcccctgggggatatgtgccacgttggcccttatcga

SEQ ID NO: 601133 - DNA, 216 bp, Homo sapiens
cgtgtcatgaagatgtgcacgacgtacgagcttcctcgtcgtcgactcatgaaatttgtgaacaagctgctggcaaacctcactgatgctaggagtggagatcttgatgaccgtattatcaacaccctgacgaggattgtcccgtcgttgtgagttcgtggcctgcggcagcattttcgtgccgccaagcctgaagttaggtaacccaaagtacca

SEQ ID NO: 601134 - DNA, 718 bp, Homo sapiens
ggcgggggtggagggaagcctcccgttcccgccctcgatgcgttgtcttgagcagggtggagccccacgcatctcttctttgggcgcccgcagtgcctgttttgagccctcttgcctgctccgctcgttcccctcccgcaagcacgtcgtccgtcctggcggggcgttctctgcggggcggttgtattttctatgtgttctggtcgcctgtcgcttgtacttacctgcgtccctgtgtggcaggcacccctcgttggcagtcacgttgagtggtggcctgttcccccccccctgtggcccgcccactcttcggtcgccctgtttcttgggtatgctcccgggctacaactgatggggaccactttctctccccagaaatcgctgcgatagtgtttccccactgtgttactacttctcccgtgctccccctgtctgcgctggcgtttttagcttccacaccccctgcgtatggactgcctctttgcagagacggcggctggcggcgtccctgcagggacggtaccatcttctgttatgtagcctcccggggagcccacactacacacacaccaccagacacacacacacacacacacacacaccctcttgatcccttgcttccctccccccgtgcgttctgtgatcgcccagttcaatagccgtgcacatgtggacactccaataaatgttcattggtgacgagaaaaaaacaaaaaaa

SEQ ID NO: 601135 - DNA, 1440 bp, Homo sapiens
ggcgcgggtgtcgtgtggttggctgtgcggtgtgtcgctgcttggctggtcggtggtcggtctcgcagcgtgggccgtacgtggagttggtctctgttactgtgctgctgcgcttgtttgcgtcggggcggctgtggttgtgcgcggttgtgtttgctgcaccgcgagtgggcgtgctcgttttgatggtgtgtgtcatccttggtgcgcacggggcgtcgcctctcaggggttttgctggcttcacgggcgtgctggtttcttactccttttttttggtaccccgcctcttttcgggggaggtagagttttctctgccggccggggtttcgccgccgtttgttgtcacggactatttggggtgatgttttccgggctgttttgcggtgcgttgggtcgtgaccttcttcgcccggagttatttggggtgctcctctccttgagggggccctctccttggagggtgtaggtccgggcgacagtcttccccgagtcacgtgttgttgccgacaggcatccgtttgttcggtgttcttggtttcggggccttcctgggagccgctgtcagcgcggccggagtgtgccacgcccttatggtgaacgcgtgttggcccccccggccaagaaaggggcgaccctgtgagccgcgcaacgaaccctggtttgttgttggaccacacggtggcacgagtgttcggtaaccccgggcaggcacgtgcaagtgccgcaatggtgtctctggaatggcacacacggaaggataaccaagctcttggggtttctttgtctccacccagaccgtgtagtctccgtaattgtgaagacctggaccccttctccagagtcccttggtggaatgcctggagaagttgaccccgcccccacgctaaatggagaacacgtcttacaaatcttgcccaaaaattggggcacacacacccagccgtggcacacagtctccggtccacacttgtgggaatggaaggccaccagatcttggattcttgcccccgggagtatagcaccattgacagggggctctgggggccttctgttgcttggggcctccatcatcttggtggggatgggccacccttctcatgccaccagggaggagccaagaaaagagttctcaacgaggtatctcgcgcataaaaccagggttctcctgaccatctcacccggtaaagaacattaatgtgcctttaggaccaagccatttgctgtgttttgtgtagcacctggtgtcccaggaccagacacctcagcttccccagaggattactgctgcccagaagattgcttctgaagtccagatttttatcagttttgctctttgattccaagaccctgtttttctcactgggcctccccccctgttcccttttttttagccacccaccaattatccaaaaccccacataagtgtttgttttccct

SEQ ID NO: 601136 - DNA, 597 bp, Homo sapiens
  misc_feature (113)..(113): n is a, c, g, or t
  misc_feature (357)..(357): n is a, c, g, or t
attctagaggtcgaggcggccgacatgttttttttttttggtcttcttttccttcagccgagggggccgagctgacgcaaacatgcaaatcttggtgaagaaccctcacgggncaaaaccatcacccttgaggtcgagcccagtgacaccattgagaaatgtcaaagccaaatattcaagaacaaggagggttatcccacctgaccagcagcgtctgatattggccggagaaacagtgtggaggatggccgcactctctcaggacctacaacttccagaaaggatgtccacctctggcacctggggtttgttcgcgcctgcaaaaggtgggcatttattggaggccttcctctcccngccagtctttggcccaagaaatatcacaatctgggccgacaaagatggatctgggccgcaagtgtggctaatggcctccggcccttttacaaccacttctgtggcttggtcacacatttgggccggcaagagacacgacatgtgggtggggtccaacacccaaacaaaccctgggcgtgtccccaaagagaaagaaggtgtcacacaataagggttgggtcccttcccctttgaaagggg

SEQ ID NO: 601137 - DNA, 866 bp, Homo sapiens
gaggggcggtaggcttggtggggtgagctatgtaggtgtccctgtgggtggacgtggttgagtgataggaagcgatcctggatatccgctaactggtcagaatgcagatcttcgtgaagcacccattaccggcaagaggagcaatcacccttgaggttggcagccctagtgacaccagtcgtagacaatgtgaaggcgcaagatccagagatacgggaaggcattctccccctggtaccaagagagaggctctatctttgcaggcaatcagctggaggatgggcgaacttctgtctgattataatatccgagaatgagtcgatcgcgtgcgccatggtctcatgcgtcttgaggaaggtggtatgcatgatctacgtgaagaacttgaatggatggatcattacgtggaatgtggagcccagggatctcatttgtgtgtgtgaaggctacgattcaggatacagaatggtatcacttccttgatcagaagagtgcttatctttgcggcaatgaggtggaatatggcggttgatagtgactaggaccatttaggtggtagtgggaccctggttctgggtgcctgagcatgatgatggcggtgtgcagatgattctgtgaaataccatatctttgggtagaccagcggtcttggtacgcagaagccaagcgattgtgtgcgcaagtgtgtacgttacagccacaggaatagaggaatcgggccggaccctaaggtcctctaaggaggcgccgcgtgggaatgcggacctttttgttaaattctaaagattcccggggtggtcggcccttttgggagcccaagcgcaaagagggggggagaaaccacggcaacgcgaatgaatagacga

SEQ ID NO: 601138 - DNA, 616 bp, Homo sapiens
gcgacctagaggatcccccatgctgtcttcaggatgctgacactgcaccaggatgctgaaagacaggagtcccaatgcctcccttctgctctactccaagcttttcttcttgggtgcattgactcaagtcaggtagtacttctctatgttttgaccacagacgggctgtgttcatgtatttgtacatatgtgtgaatagacagagaaaactagtagccatggggtatgtgggggaactcattccttttaggggaggagatttatctactgtttttgttgtttagtctcacctcagacccaggttaagctggccagggctcatagttttcaaagaagcacagaaaaaattctgtttagcttacatcctaagcatgttctctttatctttcctggaaagctatccacttttaatctcatctcatactacaggagaaaatattatttgaaactgatagctttccagaaggttactgaaatcacttatttttcagtgtcttcactggcaccattcatagtagctaacattagccactttccgtgggcctggtgctgtgttaaagtgcttacatatattaatttctttaaacccgaccatgatcctttcaggaaggactgt

SEQ ID NO: 601139 - DNA, 462 bp, Homo sapiens
  misc_feature (10)..(10): n is a, c, g, or t
  misc_feature (100)..(100): n is a, c, g, or t
  misc_feature (165)..(165): n is a, c, g, or t
  misc_feature (173)..(173): n is a, c, g, or t
  misc_feature (205)..(205): n is a, c, g, or t
  misc_feature (207)..(207): n is a, c, g, or t
  misc_feature (213)..(213): n is a, c, g, or t
  misc_feature (218)..(218): n is a, c, g, or t
  misc_feature (221)..(222): n is a, c, g, or t
  misc_feature (252)..(252): n is a, c, g, or t
  misc_feature (300)..(300): n is a, c, g, or t
  misc_feature (302)..(302): n is a, c, g, or t
  misc_feature (323)..(323): n is a, c, g, or t
  misc_feature (340)..(340): n is a, c, g, or t
  misc_feature (378)..(378): n is a, c, g, or t
  misc_feature (420)..(420): n is a, c, g, or t
  misc_feature (422)..(422): n is a, c, g, or t
gcctgtgcangcctgtatgtgtgtaagtatatgcggtatgagtgtgagtgtgcatatgtaagtgtgtgtgtgtctgtgtatacatgtatgtatgtaagtntgtgtatttgtgtatatatatgtgtgtgaatgtgtgtatttgtgtatatgtatatatatgtgtgngtgcatgnatatacatgcatgtgtgtgtgagcacgtgtgngngtgtgngtgcntgnngggaaccataaggttctcagaatgtcaganatggagctgtttcacgcagatgctactgaaggtttctttagagtggcncncagactctagagtctgagggncaacaacatcctcaagncaatgtctttctcaaatggtcctgaacatccgctaggngtcccaccttctaccacacacaggtccatcccaatccaaatnantgagacaataaggacatgtctgagacagtctgaacaccta

SEQ ID NO: 601140 - DNA, 267 bp, Homo sapiens
aaatgagctggtaccagatcccctttcatcagaaaaaggaaagaagataaagaaagaaacaaatcattaattttaccagatagcagcttttgatggtacagagagcgacagaccagaaggtgcagagtacataacatcctggctgaaagactcatacgaagaaggactgtcttcatactaacttccactggcgcatccaacagcgttgactcatccacagctgtgggcctgcctccccccaccactgccacctcctctactccttcc

SEQ ID NO: 601141 - DNA, 150 bp, Homo sapiens
ggagaattataggaacctcgtctccctggagttttggtctgtcatcccggctaaagtacagtggtgtcatctctgctcactgcaacctccacttcccaggttcaagcaattctcctgcctcagccttccaagtacctgggactacagata

SEQ ID NO: 601142 - DNA, 271 bp, Homo sapiens
  misc_feature (20)..(20): n is a, c, g, or t
gcatccctggacatcagctnttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagcccctgga

SEQ ID NO: 601143 - DNA, 184 bp, Homo sapiens
tactggttgcagcggcatcaccctccaggattggggatgatccacctcagtcctgctaagtagctgggaccactggcatgcgccaccatgcccggccgacctttgcattctcagtacagacaggatttcaccgatgatggcaaggctggaaaccttttttttttgagatagggtctcacttact

SEQ ID NO: 601144 - DNA, 769 bp, Homo sapiens
agcggactcgggccgagccatgcaggcgggcgcgcgtggactacagtcgctccctggtgggtcgtgtggctgcacagttgtcccgcacgtcggcctgcgcctgcagcccgtgaacaggaccttcagccccggcgacgagagttaccatggagtcgctgctgttcctggggtctggtggccaccgtgctgcctgggcctgaacctcatcttccttgtggcttacctgggtctgtgcatgccactgccggtcggggacgatgcggtgcagaccgaagcagcaccactccgtgctgcatcacctggacggccgtgagtgagccgggctcatctgctgtgctgccgcgagggcagtggttatctatgtgaagacacgcggatgaccaacgatggggctgtagccaacttgatgtactccttggacgatgccaaccacaacttctctgggatcgatgctctggtttccggaactacccagaagatgaaggtggacctagatcagcacctggccctggctcagtggagatctttgctgcccggggcgattacctgaagaccctgaagttcatacaggcagatggcgggcagcgtaagtcgtccacgctctcaggactggcccgtgtgggagggaggtcaccaatggagctgaccaaagctatccggacaagactggcttacgtgggagtactaaaagtggctactctaaactactgctctttagactggacctgagtcatctgcctcattgccgcctgggatggcaagggcccaa

SEQ ID NO: 601145 - DNA, 274 bp, Homo sapiens
actgcatacaacgccgccggtcgggtcccctcaacttcttagaaggtacaagtggagttcagtcagccgagattgagcaagtaagcgaggtctgtgatgcccttagaatgtccgggggtgcacgcgcgctacactagtagtggctcagcgtgtgtctaacctacgccggtatgcgcgggtaacccgttgaaccccattcgtgatggggatcggggattgctattattccccatgaaggaggaatgcccagtaagtgcggcgttggagtgctagt

SEQ ID NO: 601146 - DNA, 112 bp, Homo sapiens
aggccaggtgttctgggatgatggacaaagcattgatacctatgaaaatggaaattattttttggcaaactttatagcagcttagaaccatcttgcaaatccgaacccttcc

SEQ ID NO: 601147 - DNA, 580 bp, Homo sapiens
  misc_feature (546)..(546): n is a, c, g, or t
aaattcataatatttagagaatttgtcattttgttaacgacaacaccaacacattgtgaaccactaaatgctaaattgtggtagatgatgcatttcttgaggtacgttctgtgtacacaagcactaacactcaatattgagattctcagttgtctctgtgttaaacatgaaatcatgcctaattgggaaccattatattggttgcaagttgaattgtgttatctccaaagacatgctgaaatcattaacttccagtaccttgtggtgactttatttggataattaattcactgcccatgtttattggtatcatacctaataaatctttgcctaacccctaatcatcaaagatttacccctacattttcttctatagacctgagtgactttctattttacttttaggtctaccgagtatattttgtaataatttttatatagagtgtgatatccaattgaaatccaattgttccagcaccgtttgttgaaactgaattgccttttgcactttggaaaatcagttttccatatatacgtgggtctatntttggaataccacaggggtgaagtacccttttca

SEQ ID NO: 601148 - DNA, 203 bp, Homo sapiens
gaacataaaactaaatggatttatactaacagttacttcagcatttaagagaggcagtacaaaatgtgtctgcttatctgatataattgcatgtataccatgatttaaacaatatcagttatataactaatgccatgagatatatcttactcagaagctctgatgttcatatagacagaaatgcagtgtatagcactgagttc

SEQ ID NO: 601149 - DNA, 183 bp, Homo sapiens
gcagcttccccgcgagcggacgcggcagcgcctctgttctcgctttttcttatttttcccccctttcccctttcttttttatgttttcctttcttttctcccctcccacccttaacaatttcccctgcggagggagttcaccacgggaaggggaagagacaggttaagcacgggaaaattaag

SEQ ID NO: 601150 - DNA, 1043 bp, Homo sapiens
  misc_feature (457)..(457): n is a, c, g, or t
tagttatgtggtgcggcacggtcatttgttttagaaatataaggccgcgctctgttgggtatagatataaatgcggcctcagacacactgcattttgtttggtagaacccctcggtgtggccagttaccaaaaatattttgggtgaacaccatcgttcgtcggtgtgggttatatattccctccgtgtggagcaggaaataatctctatctggaccaacgtgatctatttgtggtcgtctttaaggagcaccatgcagtaggtgtcggtatatagttggccttccgcgttgtgggacatacatctgtctcctatctagtatcgctcacaattgttgggctctcctcgtggtgttgtgccacacagacacactttgtgtgtatagccaagacggccccttagtggagattttcaacaggggcacgaagttgcaattcttgttattaatttccgtcccncacccagggggcgtgtttagaaaatatgcattcataactatctatttttttgtctcgccgtgtccgccaaaagatctccgtcaatttcagttggactgcgtcagactctcgtcgctagtcgtctgcggccttctcataaagatctcgctctcttctcgaaaagagggagttttctcccacattctgttttagctcgcccgtattagaagagttgttggtttgagagtagttttttatggaaaaccctgtcgtaacatcatggcgcatgacgccccccgccatatttacactcacgtgggagaacattttctgtgtgttagttacacaaccttttctcagtgtcgagaatacatctgctatctccctagggagccgacaaaatgttgtgccaaaccgccgaaatgacgtctcctcttctaaataaaaatgttccccacaccacccaaggggggttacctttccccgcccccctttaccacatttacaccccctttccccggggaaacaaccctcctttttaacacccttccccccttttcctcttttcccccaacccccaaccatccccggtttttttttttaaaca

SEQ ID NO: 601151 - DNA, 1020 bp, Homo sapiens
ccaccgacacccacgggcggagatcacctgctgccccgcagacccctgtcccttcctcccggaccagcagctagaggctctgactccagccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaaggaacaagggcagtgcgcatgaacggcatatgatggtgggcactactctccctgtggtgctgtgctcgcgcgctataacatgataaagcgctgccgtactatgctggctgctactagccgcagccatggggcctcctgcgccacccagcgcatcctggccctggcaaacctgcatcacctcctgcctcaccagcctcaacggggcactcgaccccatcagtgtatttcttcgtggctgagaagttccgccactgccctgtgcaaacttgctctgtggcaaaaggctcaagggcccgccccccagcttcgaagggaaaaccaaacgagagctcgctgagtgccaagtcagagctgtgagcgggggcgccgtccaggccgagcgcagaacgttaggactcagcagacccagcaagagggcatctgccctttcccaggcagctcccaggagcaactgaaatctcacgagatggcccacatacctagaatggctaggccagccctaaaggagacggccaagggacaacgcaacctcgaggctgtgatggtacaggtctagaaccaggtcccgggcggacaagggccggaacacccgaagagggccactcacaggccacaccccgaagaccccgcgggcacgacacccagaggaagcaagcggaccggggagagaacagggagagcacaccgcgcacgacgaacacaggcaggcggaaccatcagcaacgt

SEQ ID NO: 601152 - DNA, 419 bp, Homo sapiens
gttactcgtatgtgacacgggtactgtctgagtgtttccataaatccatcagatttagaacctcatctgtccctattgcgaggaggagtagagatttttcgtgccctagcacccatcccatcgatcgatctataacatgcacactacagcaacgctaccacaaggtgtcatcgagcgtacagatggaaccttctgctcaccaacaatcctacttcccggtggcaggagagcaagagaaggacagacagatggcaaggcatgtccaaaagacgagactcagcacaaatgaatcctccccttcgccatctccaggcgtggaggcctgaggcacctcaatccccgataccctactccttcccacccacatctccttgcacccatctggaacctcggttgatgtgagccggctacagagaagc

SEQ ID NO: 601153 - DNA, 221 bp, Homo sapiens
ttccccacagtgagggacacatgccttcccccagctgcgtttattcatagtagatttttaacaaaaaatggggagaaataagtgcatttctgtgaatacggagcccagcgccctcctccacttggaaacggtatcctccctacccatccgtctgtctgtcgcccttctcccggccctcactaagccccggtacttctagtggtctcactgtggagcaaggg

SEQ ID NO: 601154 - DNA, 364 bp, Homo sapiens
  misc_feature (163)..(163): n is a, c, g, or t
actctaagatcctcctttgataggggaggtgtgtgcacataaacggactgcagtgtcaaactttggtgcagtaggaaaactctcagcatgctacatattggaaggcttcaaagcactgaccaagtgttgttttgccccccgtgcagcacattagactctgttncagtgaaatgctacattcaaagtgctgtcccactcagaagatcccagaggatgccattctggctgtgctgggaagtgctaaagttccctccatatgtcactttggagaaggaagcagccaagcagccatgttgattcctctttcaacctttggcatcatggacgatggtagcgtgtaaaatgtttgctctcttcatgccta

SEQ ID NO: 601155 - DNA, 174 bp, Homo sapiens
atcgctacaaaccctcagagaaataatgattaagatgtcccatctattatacaacaagcaggatcctacaacaatatcaccgccaggcattgaggcagcatgcctagtagtcctagcccactcacagaagctgaagatgggacgagtcacgttgagcccacaagccaggatcag

SEQ ID NO: 601156 - DNA, 216 bp, Homo sapiens
tatccagatgaagggtgattatcatgtggcaaaccacatttgcatacgtggcaaactacagagatctcgatactttagtcaacatatcttaaagagttatatcacgcatcagttcaaaatcatgatgagatgctgatcgttgcactatattcatgtctcgtattgttgcacccaatatttcggttcacagttgatccagggggatcctctatatgt

SEQ ID NO: 601157 - DNA, 882 bp, Homo sapiens
gaccatggcccaagggcatggaagcatgtggctgctgagagggtcgtgggccatctccaccaccaccctcgcgtaagggcatgggcccaggctggcgttaagggcactttgcctgcttagtcaaaaggtggcatcgaatcacctgggctgtcacatgttttgtttagtttcatggatagtatgggaccaaacttgcaaattaatcattgcaatctaaggggaaaatagaagaaattaaggtgggggtggggggacggggagcccatggggataaaagtaattaaaatccattgaatttagctatttcacttggggcaacatttaatctccaagattaaatcttggtttatggggaaggttatatattttcatctcatttttatgtatcatctttaagacaaattgttaagtacaaatgaaaatcaggtaacatacaaaggcatttcatcaaatagttaaatttcctatgaaagttagtaaaatacatatttttataataccatgttcaagtgaagtgtttttgctttctgccaagagtcattaaatgatatagcaagtatttgggtctctcttggtgttatcaggattaattgcccaaggctgcgattttgtgagcatagaagaggaaagcaagcatctctcacaagcagtgacatgaatctgtaataatgagtgaggctgttagcaaattttgtgtgatggcagataactcagttttggagaaaattagaatcacagctaccaagaagcacatatcgtttcaactttcccacccaagtattagtgaagtgatttaggaccttgatttatatttcttagagaagctggctcgaggcctttgtttcattactgtttgatgaggcatgatcccttactttaaaa

SEQ ID NO: 601158 - DNA, 112 bp, Homo sapiens
atccccctgcatctggggcttggcaggtctgtcccatcttcagcaaattctgatgtcacacagtggtcagcccaaactgagcgctcagccctatgggctcctttatcagtca

SEQ ID NO: 601159 - DNA, 1398 bp, Homo sapiens
ggagagagagaactagtctcggtttatttttgatgtttcttttttgggaaaagggaagcaaaatttttttcctctgggggggaaaaaaaaactaggggggggtttgtgtccgggacccccatccctaacccttcccaaaaccaaaagaaagacaaagcagcggccaccaaatggggtccctcggcccaaatgtagaaacgccagagaggtcagcggcgtctgggctggggagagcgcaggtgtagacgcgcacaacgggcacagggcgcagggcgcgcgtgcgcatgtgcgacagcgcggggcggccaagggcggggcctgtggcgcccagggggtagagagggggagaaagagggcgccggggcatcgcatgaggagatacgcgggggcaaacgcgcttggagaggggccgtgccggagctgtggcacgggggcccacaagaactctacaggggccaccacaacaaacggcggggaaaggggggcgcctcgcctggagaatgtggtgcctgcgttccccccccactattggggaacacacacagttcggtgttcatctccccctctgtggtcctcttgagagccgcggtttagcgcaccccgcgcgtgttaagaagccgcgggtgtggccccaggtgttgtttcccacgcgagggcaatacctccctgcgggaggggaggatctctggggggccctttggaaaacaccccccacaccacagtgacaagtggacatttggttagagttagcagcacatgaggaattatagggtgcatgaggaaaggccaatcacgtgggcgggaaaaccgcttggggcctcatatccggtgggggccgccataacgggatagagcgcacattgaggaactacaaagggccccccagaagggcgccctttggtgggggcccccaacaacaaacccttcgtggcttgaggagggtatgtacaaagacaagggggcccacaatagtagaacccccggggggggggcccccccacattgtggctcgtccgggggggggcgacacactatgggtgggggcgccctatttgtgggggtcccagagagaagaggagtttcccataaacaacagaaacgagtcggtgcaagcgtagacagggtttcaccccagaggagggaagcagaagccatgtgagtagcgactctgtactggcgaaacccgacaaaaccaagcgggggggggggcccccgtgtgtacacacctctgtgggaggcgccttcgtcaaagagggggcgtgtgtggtgcccccaccacaaattggggggtgcatacaaacggggagcaccggcgccgaaacaactgtatgtgcaaggtgagaacgaactgcacagggaacaagacgcggccacaggaggtgtccccaatgggggggt

SEQ ID NO: 601160 - DNA, 403 bp, Homo sapiens
  misc_feature (13)..(13): n is a, c, g, or t
  misc_feature (22)..(22): n is a, c, g, or t
  misc_feature (26)..(26): n is a, c, g, or t
  misc_feature (32)..(32): n is a, c, g, or t
  misc_feature (36)..(36): n is a, c, g, or t
  misc_feature (41)..(41): n is a, c, g, or t
  misc_feature (53)..(53): n is a, c, g, or t
gcaagtgccactntgtgagganaccnataatngaangccgngtgggggtttanaaacagctgtcgctcgatccggatgagcacctgttgtcgcccgagagagagtacgtcgaagcaggagcagcgagcggactgacagctgatcggtcagaacgagcacagtcgccttgcgaacgaagggctcgcagtggatggaggaggccagcctgaggtcacgccaacaggctgctggcacggcctacaggctgggtaggcgggcgtgccgacgtcaggcttccctcagtccgggcgagggctacctgggccggaaaagccgactcggcctcgggacagagccccacccgatcggaagcggatctttaccgggccataggcagtgactaggccgggctgggcctcccatc

SEQ ID NO: 601161 - DNA, 688 bp, Homo sapiens
agtgagaccctgtctccaaaaaaataaacaaaacccatttttttatagttcatttctttatttattttttggaaagggagtctggctcggtggtccaggcgggcatgatctcagctccattgaaacctccaattcaaggtccaggccaattctcctgccttcaagcctcccaagtagatggggactacagactcacatgccacccacgcctgtggcaaaattatgtggttattctatagctggacaactgtcgtaaaaccccgtcttctctactaacaacatacaaaacacttagctgacgcgctagtagcaacacgccggtgtagtacacttaagttcccagcaacctcaaggaaggtctgagagaaccaaaatgtgatatgaaacacaggagggttgaacagatggaagctggaagccaacagatttggtgccccagtggcacataggcagagctgagcgacccttgggctcaccacacaagaaacaatatcaacaatacgtgggacacctacccggaggatcaacacaatcacgcgaggacggatcaataataaacatatcaacccataggttccgaaaacataaaaataaacaacttaacaaaaaaggtggaatatgacaaagtggggtgtcaacaaccgcaggggcaagagagccaaggctggtaaccccaacgggcgggcat

SEQ ID NO: 601162 - DNA, 530 bp, Homo sapiens
caagatcaccctgaccaacatagagaaactctgtctcaaaatattaaaaaattagctaggtatggtggcacattcttgtagtcttagctacttgagagtcttaggcgggaagatcatttgagctctggaggttgcagtgagccatgattgcaccactgcattccagcctggacaacagagagaccctgtctcaaaaaaataaaaataaaaaaggatcatccttgcttgatcacccaaccaaaggtctctgcccttccagaacgaactgtagccactggctactcaatctcaaaacatcaggggtttttgaaagtcagacatttattttctaaattcagtgataatcagcttgtaagaggcagtgaagggacatctaccaagaaatttccacatgattctgtaattatgaaaagcttctatgccaattaaattcctggaacaaacatcaacaacaaagagtaatagaagaactttgtggaaaacaacaaatatatggcattctttacctcatcctgatccaacatctgttg

SEQ ID NO: 601163 - DNA, 762 bp, Homo sapiens
gaaaacaggcacacaaaccaatggaacaaaatagagaacccagaaataaagccacacatctgtagccgtctgatcttccacaaagttaacaaaaaaaaaatgaggaaaggactgtctgtttaataaatggtgctgggatatctggttagccatatgcagaagaatgaaactggacccctaccttttaccatcttcaaaaattaactcatcatggactaaagatttaaatgtaaggcctcaaacagtaagaatcctagaagaaaacctaggaaacatcattctggacatcggcctggggaaaagaatggatggctaagtcctcaaaagcagacacaacaaaaacaaaaattggacaagtaagacctaagtaaagagctttgtgcacagcaaaagaaattatccacagagtaaacagacaacccacggaatgcgataacaatatttgcaaactctgtttccaacaaaggtctaattactagaatctataagaaaactttaaactagccaacaagacaaaaagaaagaaaaaaaggtataccccttttcccaagtggccacagacaggggacgaggccttttctccggggaagacctcacagtgggccgcaatccttgaacatggctcaccttgtgctttttcccaggaaatggggccattttaaacacccccttgaatttcccgtcttccacccattgcgcggttttttatggaagtccaaggtgcctaaggccaataaatctagaatcgtggaggcgaagggg

SEQ ID NO: 601164 - DNA, 1628 bp, Homo sapiens
  misc_feature (629)..(629): n is a, c, g, or t
ggggtaaacttggcagcgatacgtccaccacacacagtgcattcatcttatagaaaattaggatggtctgtgatctccgtgacctctgtgatctgccggcctcggccctttgcaacaggtgctgagataacaaggcgtgagcccacccgacacgattggagacccaatccgtggtacaaacacacgtgacaacccccggtctctacgtaaaaacttacaaacacaatattaacgccggcgcgttggctgtgttgcgcaacctttgtatgcccccgagctaacctcgggggagtgcttgagacgacagggaacgaaactctgcctttgaaaaccctgtggggaacggaaagcacgggtctgcacgtggacggcccaaaagtgaattcgggcacccaactttggtaacccttcccccggatctgggggatggaataaggggggcggaaggaacatccccaattccttcgacatatatacactgcggatctacacgcaggcaccccagcaaaccacttgcaaggacagtgtgggcggccacatctataatgttcgcaaaaccaaaggggctaaggatcatacttggcgctcctgttgttctgcccgttgttggtcgaaccacaacgtctggntctgggcacactagttggttcccacaggcactccaccacgtcaacacacgcctgcgtcgtgttgggacaagtatatctcgtttaaagcaaactttgacccttgggccgaaggtggcgctcctaggctacaagggcgcgcgcaaccaacacataacggattacaattcgcccgtttccgtggcaagcgtatacacacagacacttaatttgtacgcaaagcacaaccccactgtgtacccaaaagtatctcttggggtagcagaggcaacaccaccagggctccttatgaggtttaacacaaacggtttcaaagacaactctccgtagaagttggtacacaagcgcgggtcgctatcacaaacactgtccaagcgctattagcagggcggctctatggcgggttagacagaacaactcccgtacagttgggggttctaccgcaagcgcgatatacccagacgttaattatacaccaatgggagatgcccgggctactaaggcgtacaacccacatatcattacactacatagtggtggtgtcacaaccaacaccagcagacagacatcgtgatgtgagactgacgcccctctatgagacgacaccactggtgagatgagcacgactcacccacatactagtgtgatccacacaataaccgtataagaggacggagcgcacacactcaaagccgcagtgtctccacaaccatcgcagaacacaccgcatcatagtatagctgtgttagggtactatcttttttttttcatgcctctcatctaatcgaatcacagcatcacacagagccagacggagaactaccacagacgagcatcggagcatacaccagacgcctagcacacatgcgaactaagggtcaaatgcacggagcaagctcactgacacgcagtccacgcaacgcatcagcacaggcaagcaagtcgcacgccgcaagcacaactactcaacagaacagccacgacgcaccaggacagtccccc

SEQ ID NO: 601165 - DNA, 159 bp, Homo sapiens
gacgggcctcattccttaccgtcatgaactaatcgcaatccctcatctcattcccagagacactggccaacaagaagtactgctagagagagacccagtaaaaagatctcagaagttggatatcaaaaataaaaaggtacagacagttttccaggtagc

SEQ ID NO: 601166 - DNA, 116 bp, Homo sapiens
tggttgctctgaggatccccgattggtgggcgttgcgcgggcggcgtcgagttcggcccgtcaggcgcgccagcgtggcatgcagggccgcacgttcggcggcggcctgggagacg

SEQ ID NO: 601167 - DNA, 140 bp, Homo sapiens
  misc_feature (5)..(5): n is a, c, g, or t
  misc_feature (12)..(12): n is a, c, g, or t
aagcnagtaagnacctcctcaaaggtcacgtagtaccctgtaaaactgtgtgtttgtgtgctttcaaagatgttgggaatttatctggggacagtgtgtatggtaagacatgcccttctattaataaaactacatttctc

SEQ ID NO: 601168 - DNA, 600 bp, Homo sapiens
gggcggatcacgaggtcaggagatcgagaccatcctggctagcgcggtgaaaccccgtctctactaagaatgcagaaaattggccgggtatggtggcaggcgcgcatagtcccagctgctcgggaggctaaggcaggagaatcgcttcaacctgggaggtggaggttgtagtgagctgagatcacgccacggaactccagcctgggtgacagggcaagactctgtctccagaaaaaaaagaaaaaaaagaaataaattggttggaaggaccaggcgccggtggctcatgccgtgttaattcccaacacttctgtgggaggcgcaagggcgggcgggataaccgtgagggctcaggagtcggaagaccagcagtgtgccaaatgatggttgaaaacccctgtctcaaaagtagtactgtgtaaaaaactagaaacgggcaaacaccaggggacacacagacaacgcaaagcacaggggcacgagaaatcctgaggatactcacaaggatggaaagagacgggaaaatacacacacgaaaaaacccccaagagggaaaggaaacaaccgagacaaagaagacaacgcaaaaccaaaagacac

SEQ ID NO: 601169 - DNA, 103 bp, Homo sapiens
aggctgcggtacagtaattagatgtagaatcttgttgtaggctgaattttaatctgtatttattgtctttgtatctcagaaattagaaacttgctacagactc

SEQ ID NO: 601170 - DNA, 361 bp, Homo sapiens
gccttagccttgggaggtctgggaagggctggaaatccctggggacaggaaaccccttccttttgccaaatcagatcccgtccaaagtgcctcccatgccttccaccatcatcacatcccccagcaagccagccccctgcccaaccgggcctgggatgggcccccccccccctggatatttctgggagtccctgctgaccccatctctcccaccagtcttggggtttgggtgggaaacattggtttctaccaggatccctgccccccctctccccaattaagggccttcccccagctttggtttaatgtttataaacaaaatagagaaactttccttataaataaaagtggtttgccccga

SEQ ID NO: 601171 - DNA, 557 bp, Homo sapiens
  misc_feature (59)..(59): n is a, c, g, or t
  misc_feature (92)..(92): n is a, c, g, or t
  misc_feature (99)..(99): n is a, c, g, or t
  misc_feature (105)..(105): n is a, c, g, or t
  misc_feature (158)..(158): n is a, c, g, or t
  misc_feature (396)..(396): n is a, c, g, or t
  misc_feature (435)..(435): n is a, c, g, or t
  misc_feature (441)..(441): n is a, c, g, or t
  misc_feature (450)..(450): n is a, c, g, or t
  misc_feature (473)..(473): n is a, c, g, or t
  misc_feature (480)..(480): n is a, c, g, or t
  misc_feature (492)..(492): n is a, c, g, or t
  misc_feature (553)..(553): n is a, c, g, or t
ttggtcaggacttttcagggcctgggcccccacccaagttccaggtaacactgaatttntgggaagagagccatggctccagccatactccncagaatnttatcncagtgaagatggagcaggcctttgcccgatacttgttggagcagactccagancagcaggcagccattctgtccctggtgtagagcctgggggacccattttccccctcacctctttgtttttcctgtttcctttgaagtagactcatttttcacccgattgacctgtcctctttgtgataattttcagtagttggccgtgataattgtgtcctgaaaatcctcgccccccctgggtggtggagaactcaagggtaattttttatcccttttttttttttaattttgaganatacgccctctttcatttgtaaggggctaggaaattccnaatggngtgaacccngggggcctttcccttttccctgncctcccnactttaaagccnagccctttatattttccttttagatattccctaagggcttaaaataaaattttattgaaanagga

SEQ ID NO: 601172 - DNA, 780 bp, Homo sapiens
catggtggcaggcacctgcagccccagccactcggaaggctgaggcaggagaatggcgtgaacccaggaggcagagcctgcagtgagccgagatcacacaactgcactccggcctgggcaccagaagggggcatctcctctctcaaaaacaaaaaagagaaaagaagaaacatccatacagagtgatgatgaaatggcacagtgaacatgcactgtcttatatgaaccacaagtacagttatcagatctatcagggttcatatgtcatatataaaactcttaactacttctcaaacaggggaaaggtcacattaattactccaagagaaagaactggttactaactactttaatgcaggagctcgtggataaacaacgatgagtggataacaaaagcacagtgagtattcacaacagcatgacaaacaacacaggtatactcacatatatggcattgataatcagagacagcactttagctgcctttcttcactgcctagagaaatgggcagcaatcaaggcattcaaaggtctacctcctttccttcttccaacattaaaagcaactaactcaaaagaaaggtatttcaactctttatagataacaatgactagaagtgacaaacatacatccattcgtctcttctttcattcattatcaagatggtggctatgaagaactaactgatccgggtctgtacagtcacagatgtaatatgtcatattgtgatgcaagatgaggcttatcctcagtcctggaatgggtaccaccctttggtc

SEQ ID NO: 601173 - DNA, 332 bp, Homo sapiens
taagatttaacctcagctgcccacagtggctcacacctgtaataccagcactttgggaggccaagacaagcagatcatgaggtcaggagttcaagaccaacacggccaacatggggaaacctcgtctctactgaaaaatacaaaaattagccgggtgtggtggcacacgcctataatcccagctaccagggaggctgaggcataagaatcacttgaacccaggaggcggaagttgcagtgagccaagatcgcactactggcactccagcctgggcgacagagcaagactccatctttaaaaaaaacaaatcgaggtgggaggatcacttgag

SEQ ID NO: 601174 - DNA, 1039 bp, Homo sapiens
  misc_feature (751)..(751): n is a, c, g, or t
cgacagtcgtcgcgtgtctgtaatgcatcacttaaactctggcgctatagtgtaagcgctagagcaccggaccttgccggctctcgatctgacgtgccatgatctgtacatctgtgaaatgtctctggtatgagactgaaatttcgttcgaaactaacgaggatcataatctgtcaatgaatagtcgttggtagaatcctgcgaagtgacatgtgatcgtgcatcgtaagtggaatgtgaatcggatatatttataaaagtggatgtcattgacttaagtagatcatgcatgatcgcacgtctataccctgtgaaatagagatttgtgtagtcgttgtaatttatatattaataagcgtgaatgttgtctagtgtctattgatatatattgatcagatgtagtctgattataagggatttttatcagattcagattatggcattagaaattataataatattatttgctgcatggtatccatagtcacaacactacaagaatagatagcgttagatgtgaacgactagttgggcatctggtagtgaaactactgacaacagtggctggactgaaaaatccgcgggaagcctgggttctcctctagcttattggtgtctccagagctgtccagggcatttgggtcttgccccgggttcaaaagcaaccgtgacccagactatgaaagggtttggaatatatcttggctcactgcaagggaggccctttcaaaacacttgttgagaccgccanggaaagccaaggagcaagggaagggacggcaggcaggtcccgaaaaaggccaggactcgccggaagggggccccagaagcggacgcgccgcaccagttgggttgccgttatcaccccagcccggaaggtatggtagcctgtcccctcaggatcattaaaaacctcgcgctgaaaacaaaggggcgcgtgaaaactcgggcggataccattaagcgagtcagtataaacgcggaacgagacatgaggacggcggaccacacacagtgtggcggacaatacacgcaatca

SEQ ID NO: 601175 - DNA, 143 bp, Homo sapiens
tggaaagggaaaatatactttattttttaatacaatagctgccagcaataaacgggggcggatgttccaaagataaaagaaaatacatgcattctataaaaagcttccatttgcctggccaagaaattaaaaagaaaaaaccc

SEQ ID NO: 601176 - DNA, 186 bp, Homo sapiens
cggcttggccgccacagcgtcggatgttcagagcagcagaagccggcgtcgtcggatgttgtgttgcccgccaccatgagctacacaggctttgtccagggaatctgaaaccactttgctgtcgggctagtcgggggggctagcggggctgtcgggctagtcggggactgtcgggctagtcggggg

SEQ ID NO: 601177 - DNA, 154 bp, Homo sapiens
cttgtgtagctgagcattgatgctggattattgctctgtgttatgctgttgtcctgccgactgcgcccagtgtgtgatccatctagagtctgacctgctgtgcagtcaatgcttgtgcacttggcctgtctgttttaccaactgtcgttgactt

SEQ ID NO: 601178 - DNA, 634 bp, Homo sapiens
  misc_feature (145)..(145): n is a, c, g, or t
catgctgtccggcgcgtcggcatctctccgcttggttcccattctcttatcctgattgacctgcagagcactccctggtccatagactgaggatagcttgcgcattcctcgaaccaagtaaaaagagacatcggctctcgcgtgnggtcattaggcggattctgtgccttgtaaccacaaatacagcactgcgtatctctctggagagttccatgtacctgttgatcaatccaaccaagtgagatccagggaccgacactcgtatttctacatatcacgcacggtccacccgtgctgaacatcactaccacggatctgcctcatcagcgagaaaaggggacttttggccaatgtggcctcgccactcatgtttcggaacttctaccagcaagccccatgccatgcataaagtgtctttaacaagcatggactttttaagccaacaaacccaccctattgcatgggggcaaacggcaaggttaaaccacgacggcaaggcccgaaaggcatggccatggccctggttgccaaaaggcctttccgaacttggaactggtcagggggtccacaacccaaatggatcaaacaaacagaaaaacacaaaacggaaaattcccaaaaccggttttcattc

SEQ ID NO: 601179 - DNA, 471 bp, Homo sapiens
caggaagtgtggagcacacctgctgtggagcacacatgctgtggcgattgcagcgtgtctgaggtttgtgtcgtcgtggaagatactaggtatgtagagcaagtcgcaaacatggattgagactgcatggtggcataaatgcagcaacttgcctgtagcatctagtctacttgcaggacgtggagcacatcacggagagacacaaaacaggtttgtgccataaagtactttatcaaagacaccaagcatgtggtaaatgaaaattattagttcacttccctgctgccatgaagcttagccttaagaaggtgctggattccaaggtttgtcacggcatctcggtcaagactgctttcggaatgcctatgatttcgcatcagctagactgagttgattctgaccagaattgatggtactaagtcggcaccgctaactttacaaaggagacaactacttgacctattgtataaa

SEQ ID NO: 601180 - DNA, 418 bp, Homo sapiens
ccactgtgggccgacctgcctgccacccccctggacaatatcctggatgaattacccctgcatgcttcacctacaagccagctcactgcaatcatccaaagcccagaggagagagccgcaaagacagggttggacttctgcagagggctcctgagctggctctcctccggagctggactttggagggaagcccagacctgcagctccacctccagctcacctatgtgcccacaggaaggccataacaagccactttacctcaccagctctgtgtgcccatctaggaggtggcaagaaagaaaatcttctgacagtttctcaggaacttggggaagaaaaacttgtttgcaaaaacctacctacttagaaggcatttttattcctatactactttgaataaaatcatatatgatctaaa

SEQ ID NO: 601181 - DNA, 342 bp, Homo sapiens
aaggatccccgacgtctgtaaccttctaacttctgcaccaccagaaattaaattagatagggcttttaaaataaattaggttaccaataatttacctcattttattcagtagctattttatccaatttattggctttatatttttctatctatctattcttactccaatacttgtctatagcttgtttttcatttatctatctagaaactcttgacaataattatcattatatactatacttgtatctatctatccaattttcttactaagtaatgtaacattttagccctatagctatatattgtattacctaagcttagtactttatttcttactagcta

SEQ ID NO: 601182 - DNA, 242 bp, Homo sapiens
cctttgttcaatagctatggaaagtatgttgtgaaacttttactggatgggttgctggagaaagataccaattgatgacttttcgccttttgatgaagataccaatttattgcttccagctccaacttatgaatttgaactgtggccaatgcttttgtttaaagctattatcaagctggcaaatattgagtatgtaatgcccctatccctcacatgaataaaaaaagcaaacaaaaccatta

SEQ ID NO: 601183 - DNA, 128 bp, Homo sapiens
gcactggtggtcctcagccattgcctggaccgttctcctctcgtctctctgtactcacagtcttttgtacctcctattgtcatacctcacccaccccgtgggttcaactgccccaagaaaggctgccc

SEQ ID NO: 601184 - DNA, 764 bp, Homo sapiens
actaaagagttggaaagaccggggggtccctttttggcgccccgtgatgtgtgtttttgttcctcacacacattggggggttgtgagtgttctctaatgggcccacaagacagcgacaatttgtttttgagaactcggagagtaaaaagtggtgaagtcacacagacactttgttacaaaaaggaggggggttgcaacaaataattaatctcccccgcacaggtttttgttggcgcacacactatgttcacaacggctggggttattacacaacaaagtatctttttgtagtaagtaaaccctcctcccccccctctttatttaaaaaataccccctggctttttattatttatgtgctccagactacccagagcagcccccccaccattatttcttaaaaaaaatattttatcatatgaataaatatttattattgtggaacaacacacggacttgtgggtgatgaatatttatctacgggcgcacgcagatagttttttaaagtgaatagagagggacgcacaacatattgtatagacctgttttttttgtggaagtttgagaaatgttttctgtggggggaaaagaaaaaacaagagagagtgctataatttctccccccccctccttctgctgataaatgagcactcatggggagcaaccaacattttcctggaaaaatttttttttaaaaaaagagaggttttttccaagggggaactggggggaaaaaaacagggggaaaaaccccccttttttttta

SEQ ID NO: 601185 - DNA, 327 bp, Homo sapiens
agggacgttctctatagccacaatggcagctcagcccccgcgacaccatggccttctccgtggaagcagggcagtgcacactggatgccaccctacatgtgaccattgccctagagggccactgagcccactgaagctggtccggcacaagaagatctacgtcttccagggagaggcagctgagatcagaagggaccagctggaggcagcccagtgaggcagtgccaccttgcaagacacctgtattcccatgtgaagaagcccacctgatttgccgggataccatgggtgattggttgtctgcggtggcggccatttggcagaatg

SEQ ID NO: 601186 - DNA, 499 bp, Homo sapiens
  misc_feature (103)..(103): n is a, c, g, or t
  misc_feature (170)..(171): n is a, c, g, or t
  misc_feature (213)..(213): n is a, c, g, or t
  misc_feature (372)..(372): n is a, c, g, or t
  misc_feature (448)..(448): n is a, c, g, or t
  misc_feature (494)..(496): n is a, c, g, or t
aaacataagaactggtcttctacactttctctgaatcatttaggtttaagatgtaagtgaacaattctttctttctgccaagaaacaaagttttggatgagcnttttatatatggaacattactccaaccaggaactgagaggaccaaggaaacccatgatggggtgagnngcagagaagggacaagaagtaaaactgtagactatagctttntgtcacggatcacatagctgtatcccctcacggtctagctgcaaacaacagacatggagagacacacgatgacttcttgtggtagtatggtcattttatgtctgacacgtgaatgtatcaaccagatttgccacaaggaactgaggggatacagtaatnatgtctatagtggaccaggaggtcatgaagatacacatggaattatactgagaaactgtggtttggtaaaaactangtagtataatcaaccccttgccatttttcttacccaaaaatatatnnnttt

SEQ ID NO: 601187 - DNA, 122 bp, Homo sapiens
aaaatcagggatgatctgattattatcatgttggggttcactttttatttttgcagtgtgtcccaaagcagcagcacgtataggtatagccctcttgctaatcagcttgagggccttagagc

SEQ ID NO: 601188 - DNA, 156 bp, Homo sapiens
aaatcacaatattcttttctgtgcgtaatttaaagtttaaattaccccactctctccccccccctgcttttgttggcgtccaaattttccgtattatttgttcgaagaatatcaaatgtagaatactcatatacgtatacaccatatttctgaaat

SEQ ID NO: 601189 - DNA, 212 bp, Homo sapiens
aagatgacttgcctaagccatacattaaacgtgttttgttgttgttgttgttattgagactgaatctcgctttcttgcccagccgcagtgcagtagcgccatctcactgcaacctccacctcctgggttcaaacgattctcctgcttcagcctcctaagtagctggcattacaggtgctcaccaagcctggctaatttttgtatttttagta

SEQ ID NO: 601190 - DNA, 657 bp, Homo sapiens
ctgaagtgcaagaccagtctgggcattagactatagaaagcccctgtctctacaaagagcagctaaattagctgagcatggaggcatgtgcctgcaggctgagctgatccgagtactgaggctgtaggatcactcaggcccagcagttcaaggatgcagtgagctatgatagcgtcactgtactcctgaatgggcaacagagtacgaccctgactcttaaactgctactattcaaccaatggtgcactgacaatttattcaccagggagcttttgaccctagccatgagtcaggcagagatcatagtgcatgtgatacgttagcgaacaaaccagacaatggctccctgacgatgcgcagctgatcattgaatgcgagtcatgagtggacagaagctactgtcccgactcgaactgtggcagtgaacgctgagacgcgaaacatgagttagtgaagaggggtactatatggtaacatgatagatgatgatgacaggggcttgcgagatgaacggaatgaccttagatgctcgccagactgatatactagccattgcaagaactgtatgtagagagagagcatgctaacccctatggtaagcctcgcagagacatgctgtgtacaatactttaagggcatttgctgagattgtctccc

SEQ ID NO: 601191 - DNA, 275 bp, Homo sapiens
  misc_feature (219)..(219): n is a, c, g, or t
  misc_feature (253)..(253): n is a, c, g, or t
  misc_feature (264)..(264): n is a, c, g, or t
  misc_feature (270)..(270): n is a, c, g, or t
tgcccccccccagggggtaccaaaggaaagttggcagcaggggcctcctcccccaaggcatcccagccagtgccatgtcctttgcagggggagttattggcctactccttccccatgagccctccctgtttgccctgcccaggccaaagggtaaagcacaggggtttccccatactccctcccctccccaggacactcccaggcttgggttttttttanaggtttggcggggggccccagggaggggcccctnccaataaaaanattggntccca

SEQ ID NO: 601192 - DNA, 522 bp, Homo sapiens
  misc_feature (91)..(91): n is a, c, g, or t
  misc_feature (93)..(93): n is a, c, g, or t
  misc_feature (140)..(140): n is a, c, g, or t
  misc_feature (308)..(308): n is a, c, g, or t
  misc_feature (314)..(314): n is a, c, g, or t
  misc_feature (329)..(329): n is a, c, g, or t
  misc_feature (399)..(399): n is a, c, g, or t
gtattaacaagactaaccatgatggatggactgctccagtccccccacctgcacaaaatttgggggccccccagactggcccggacacgantngctaatagcccttgtggctcagcttctcccccacccactgccaagtncaatgacaccttcctctgaaacatcagtgttaccctcatccctgtccccagcatgtgactggtcactcctggggagagactcccggcccctgccacaagagccccagggtctgcagtgtgccccttagttgagtgggcagggcgggggtggtccagcccttggaaggnccccancccagctgcccttgntattgtctgtggttttgaagagtgttaaattatggaaggccctcaggtttccttcctgttcccggagganctttttatttattattaaagtttcctgtttttttcagggggtttgttccctttgggaggagatgatgtaggaggactgtgtgtgtaatttgtgggttttaggagttcgtttttcccagaggag

SEQ ID NO: 601193 - DNA, 912 bp, Homo sapiens
ggacgtgctggcatgacgggtgtccgtgtagaaggatcagtgggcttgagaaattcgaatggtgtgcaaaataatgcctgcaccgatgggggctccataatctggttgacagaaagaatcgtgcatgtgacttgaggtagatgacgtgaaaaatggggcctgatcagaagcgtttagagcaagtaagataaacagaatagggcaggttgggcttaggctttggaggggaatcacggatgttagatacaaattaagacatgatcaggtaactacggggaagcaactttcaggggagtgtgatagtatgatgcgctagagcttttgaactagattttgcgcaaggagatgggaaggcgaattgcgcatactgattgggggacgccatttaggggggatatgaagtcactcccatgcctgagtccacgttcgcgatagatgtagagcccaaggtactaagagctctactaagagtagccttcctatgtgttgttgtcacactggagggacacatttagacatcggctacatgttacggcgtaattggactggatctgctactattaacgaaaggtctgtggtgagcaatatttaaggcattgaactatctggtgcgtagcctccaaaggagacattaggctggctcctccggaaagacttaggtgtagaaatccatctggttaagagccacggtggtgtagagcaattgacaacacagtactgcggtcattggtggaaatgcaaatattctggagggggacctagaaagctgctcagcgaccgacgtttggttggcgacacggacatttctttttcctgtttgcaccattaggaacgtccaccggggcacgcatgtgaaaccaatagtcccggactaccgttcctaccaggttcgtgcgcagtggctgaacacaa

SEQ ID NO: 601194 - DNA, 350 bp, Homo sapiens
  misc_feature (156)..(156): n is a, c, g, or t
  misc_feature (232)..(232): n is a, c, g, or t
  misc_feature (235)..(235): n is a, c, g, or t
  misc_feature (283)..(283): n is a, c, g, or t
  misc_feature (285)..(285): n is a, c, g, or t
  misc_feature (293)..(293): n is a, c, g, or t
  misc_feature (295)..(295): n is a, c, g, or t
  misc_feature (297)..(297): n is a, c, g, or t
cagatcactccctggtggataccacacagcacagagataacaaaacgataatccatacgtcgatggaacacacacagcgaatgtgaattcacagaggtcacccacctgaaagtctactttcctgatattagttgattaggctgggatagtacgccngatgggtctgggctacactggcagaatggaaccaaagcaatattcgacagcctcagagagaactcctacaagaccnctngcatagctacattctgaggcaaacgacagactcttaatcagtaaagtntncactggcntntntgaaggcatggcccaagagaagagacacctacgccataaatcgtagattctat

SEQ ID NO: 601195 - DNA, 117 bp, Homo sapiens
tatatcgagctcggtaccatgatggggtcattgatggcacaatatcactttaccagattaaaagcagccctggtgacaggcgcccaatacgaccaaatccccgtctaggagcgtaat

SEQ ID NO: 601196 - DNA, 86 bp, Homo sapiens
ccctcccccccccccccggtttaattggggttagggcccaagaagattggggtttagccctaggaattaacctttttttaaagcca

SEQ ID NO: 601197 - DNA, 354 bp, Homo sapiens
  misc_feature (354)..(354): n is a, c, g, or t
cttgtcgcccgggctggagtgcagtggtgctatcaccactcactgcagcctcgacctcccaggctccatccttctgcctcagcctcctgagtagcagggaccacaggtgtgcgctgctatgactggctaatttctttttttttttggtagagatggggttttactatgttgcccaggtgagtctccaactcctgggctcaagtgatctgtccaccttggcctcccacaggctgagattacaggtgtgagtcactgcatcttgccagtaaatagatatatgtatttttaaaaaggtacaatggccaggtgtggtagctcatgcctgtaatcccagcgctttgggagttcaaggcn

SEQ ID NO: 601198 - DNA, 116 bp, Homo sapiens
  misc_feature (74)..(74): n is a, c, g, or t
ttgtcgtcacgttggcaggttggctcaagactcctgagctctcatataatccacccgccttggcctcccaaggntgctgagattacagatgtgagccaccggcacccagctagacg

SEQ ID NO: 601199 - DNA, 477 bp, Homo sapiens
aaatgcactgtagtgatccagatgaaccccccttaagagggcatagtgctggagtgtccagacttcgactccagcaaactgttgagataggggccaccgaggctagtgattagtacacgcgatcacttcagtgaagaggagattaccactcacactctggtacctcggaatcagaactccgcaattcgttcgacctggcaaatgtacactcgttctgtcgcccagtcctggagtgccgtggtgtgttctcggctccttgcgacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccag

SEQ ID NO: 601200 - DNA, 244 bp, Homo sapiens
tcccacgatgtaatacgtctcttagcgatcttatttcggaatcacaatgataggctggcatgcgcagttcccagactgacttttccctttggctttgtgattttggggtctcaagatttattatcctttcacacctgcgagagagatctttctgatgctccttctctgcccgtcgtgcttccatctcatctgccaactttgcgctttggctggtgtggtggctggaggtggcctaattgacaaa

SEQ ID NO: 601201 - DNA, 245 bp, Homo sapiens
  misc_feature (197)..(197): n is a, c, g, or t
ggcggcgggaggactgaggccagcggatgtcgctccattcacgtcgtgccgcgcccgtgctgcgggtgtcctcccgttccagctggccgcgctgccagcaggacggaacaggtcgatctcctttcggccaagaggacgttcgtggccggaggcattcggcctgtcgtgattctcgcagggactggccgtggcatccngatcggagcagggtcaatgctgcgtgctgcacggtctcgatgcaactg

SEQ ID NO: 601202 - DNA, 544 bp, Homo sapiens
  misc_feature (229)..(229): n is a, c, g, or t
ccatgatcctctttgtagcactctcttcaacattagttattctcatattaaaacgggccatttacattggtaaacattttaaaaactgtgatgtatccatgctttggaatgcaacactggcacagtgattcatgcctgtaattccagaactttggaggactgaggtgggaggattgcttgaagccgggagttcgagactagcctgagcaacactgcgagaatctgtctntacaaaaaatacaaaaaaatttaggtgagcatggagaccagtaaaaggcaaaacagtagggacagaaaccaggccagtggctgccaggactgtgctgacgggagggctgagcatggtggcacatgcctgtaaccccagctacttgggaggccgaagcaggagaatcacctgagaccaggagttccagaccagcctgggcgacatggcaaaatcccgtctctactaaaaaatacaaaaattggccaggcatgcaccacagggcttttaggctcagccaggctcaggcggctccatggtgcttccaacaaaaattga

SEQ ID NO: 601203 - DNA, 202 bp, Homo sapiens
caggttgttatagactcagaagatgtaatctagaaaaaagtctatagaaaaaaaaaaagtttccctaccctcatcaacaaaaagcccaccctctaagagacattcaaagctagaacttatcacaattctttaatcagtttacaatttacaaacagataagtttaaaataaacaatttacaaaatttttggaaggcatacctt

SEQ ID NO: 601204 - DNA, 166 bp, Homo sapiens
cttgccccattattcctagaaccatggcgacctgcgactccttgacgttgacaatcgagtagtactcttgattgaggcccttattcgtataataattacatcacaagacgtcttgtgatgtaattattatacgaatgggggcttcaatcgggagtactactcgatt

SEQ ID NO: 601205 - DNA, 332 bp, Homo sapiens
  misc_feature (72)..(72): n is a, c, g, or t
  misc_feature (280)..(280): n is a, c, g, or t
gcacagcacgtgctgactactgtacttccagaccccctgccctcaagggactgcccagtccttgcacctcanagttcgccttttcatttcaagcataaggcaataaatacctgcagcaacatgggagaaagaagttgctggaccaacagaaatggcacttatgaagccaattcattttgaaggaagcacaatttccaccttatttttcaaactttggcagtctcaatgtctgtctccgttgcttcaggaaataagctgatcaccatctagtcaggaaagnaaccctacagggtttgtggagacatgatatatatgccaatttgaaccctgaa

SEQ ID NO: 601206 - DNA, 224 bp, Homo sapiens
ttagaggactccccaagcagttaatacagactcaggttgtgattgatgcaggagagattcgcgtcttatcccagcctgctcaccaaccccaaaactaacagtcaggaaggaagctacgtggagcaactgtcaaacatcacaggcggccgtcaggtaccagatacagcaagttgtgaatcatggattagtcccattccttgtcagtgtactctcgtaaaggcaga

SEQ ID NO: 601207 - DNA, 392 bp, Homo sapiens
cacgagggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaaagaaaaatagctaaaatatgattgtaccactgcactccagcctgggtgacagagtgagacccctgtctct

SEQ ID NO: 601208 - DNA, 211 bp, Homo sapiens
atgctcccggtggaaacaagggagcccaaacggagccatggccagtacagtgttagcagtaggactgaccattgctgctgcaggatttgcagtgccgttacgttttgcaaagccatgacgcatatggagcctcaagtaaacacaagtttttcaaagactcacaaaatctagcttcagtggtggctattctagagccctactgccaataaag

SEQ ID NO: 601209 - DNA, 375 bp, Homo sapiens
  misc_feature (76)..(76): n is a, c, g, or t
ttattccagttccacctccaaaaatccaggtttaaattaaaaaattaccacttattattaaaaattaattccaggncatgtgcattaccaaagtaaaggaatcaggaaaccgtttagggcttagttcttaaagagttcctagacccacatcttattgccattgggaaggttggaaagttgatttctggctaatgatcatcacaggttctatgacacagaacagcaaggagttttctaaccatcatcaccatatgctagccatcagcgctcagtaatagtgtaatatcctttgaaaagcacaaaaagattccttgaatgtagtcactttgggaagaggaataaacaggtctctggattcccacccctcccccacca

SEQ ID NO: 601210 - DNA, 778 bp, Homo sapiens
gagaagtacaaagaactgatatttaatttgacagtcttcagactggtcagcattagaaaattcttgcgcttgtatggtactgggtattaagcaccttgctttttcctagttccttcttaattgctgtgtgttctgtgaaccttcttccccatttgctttgtaaattttgtttttcaagcaaattcgtatggtcttgctaggtgttcatcctatacagaacgcgagggcattgatatagtgcagaatcaatgattgtacggaaagttgctgagattagcggaatgtatggttcaaccttaattatagcttcattgcaggactttactgtttctccattttctggaacgctgctgttgctgctttgtgatgacgtgagatcgataagaagaacctagtctagagacaaggatgctagttctgcatatgtctttcccatgcccactagttgttttcccagttacttcaaaacgcagctgtctatatgtagagatgcaaattattaagtgtctccaactagcaataaataaaagcatctgtgttcgaactcatgaatactcttcaatcagccacatagccttgtagcagcagcccatcctcaagcaatctcccggaagcttcggcggggcgggcccctcatagatcgcccacgggctgtcatcctcggttccagggagcctgggagtcaaatggggggccttacgagaaaaaacccgggggaaggagttctttcaacacccgagggttggggcctcaggggcccaaaggcgcgcccaattag

SEQ ID NO: 601211 - DNA, 217 bp, Homo sapiens
ggagtttgagacacagccttggcaatgtagtgagactctacctgtcccagaatatacatataggagaaattagccaggtgtggtggcatgcacctgtagtctcagctgcttgagaggctgaggcgggaggattgcttgagcccaggaggttgagactgcagtgagtttgtgtgtaccactgcactctagcctgggcgacagagcaagactccgtctc

SEQ ID NO: 601212 - DNA, 126 bp, Homo sapiens
tatacatatacgactcgagctcagtacccaggcatgcagcttgtcagattaaaacactgaactgacgattaacagcccaagtatctacaagtcaaccaacaagtcattattaccctcactgtctac

SEQ ID NO: 601213 - DNA, 944 bp, Homo sapiens
  misc_feature (148)..(148): n is a, c, g, or t
ggtggctgtctcctctctccgccatggcgtgtgctcgacccactagatatcggtgtactccgaaaagggggcagtccatctaggccaacacacagtgtccgacgtatatgccgtgactggtcatatccacacggcatccgtcaattcngcacaccagcaatcagttgtagcaagctattgttccacaccaacacttgcagcccaaaccgacaccagcaccagccctatgctgtcagtgcacattagcaggtcatcagactcagtgctagagtctatggggtactggacagagctagtggatcgaataacccagagttcgaggtggtgggactacaccgctactaggaccagggtgctatatggaaacatgtgtcgtaggaggccgaatgttaagcaccaaccaaaacctggcgccgatggcatacgtagagtgaacacaaaccagaaacgatacgccatctgttctgccctggctgcctcagacctaccagcactggtcatgtctaacaggtcatcgtattgaggaagtacctgaacttcctattggtagttgacggataacaggttgaaggctacacagcaagaccacaggaagctgtataggctccgataagacacttaaagcctggaaatgatatcacgaaaggtcatatgcctctcagcgacatgaagacgcaggaaaacaggcaacatgacaaaaacggacgccgaaatccaggagacaggaagcccgggaaagtacatcgaatcaaagagggataaatggggtacttcatcaatggcccatgcaggaagagcgtcaccatggcaactaactactagatatcactgatacagccaaacctgaaaccgtgtatgcaacactatggcgtcccagaaggagcacactggacagtaagccagacatgggaactgaacagagataacggaaactgtgaataaat

SEQ ID NO: 601214 - DNA, 588 bp, Homo sapiens
  misc_feature (205)..(205): n is a, c, g, or t
taataactaaataaccacagacagtgataccggatggtggcaaaaattccgtagaaaaataaaggggattgtgcacatatgggaggtcaggacagtttgttctgatgagtggggtttgagctgagatccagtggaagcaagagagcaagacatgctggtcagcttcttggtgacgggcactccaggcagtgccaatggcaacggnaaagtctatgtgtgcgtcccacgtgggcagaggctggggtggaatagcaaagtgggctgaggatgagggctaagaatggagctcagagaggccacaggagccaggcctggtgagcatcctgtatcagggaaggatttctacttttgccgctgaggatgtggggtgtgactcgggagctttacacagacttgggtctgaaagaatcactggagatgtagtgtggaaaacacttagaaaatgattttcatctgttagagctgctggacatgacaaggtgggatctttggggaatcttggtagaattctgggtatatcttgaaggcagagtttggaggatttgctggtgagtgtgagaaggagaggagccaagttggaatccaagg

SEQ ID NO: 601215 - DNA, 113 bp, Homo sapiens
ttacctattgatttaaaaaccaaaaacccccaaaaaaaagttaaatattaaacccaattaatgttttaaaacccctgggaaaaagaatttcccccaaagtcccaaaatttaaa

SEQ ID NO: 601216 - DNA, 496 bp, Homo sapiens
  misc_feature (84)..(84): n is a, c, g, or t
  misc_feature (94)..(94): n is a, c, g, or t
  misc_feature (123)..(123): n is a, c, g, or t
  misc_feature (132)..(132): n is a, c, g, or t
  misc_feature (134)..(134): n is a, c, g, or t
  misc_feature (204)..(204): n is a, c, g, or t
  misc_feature (211)..(211): n is a, c, g, or t
  misc_feature (237)..(237): n is a, c, g, or t
  misc_feature (242)..(242): n is a, c, g, or t
  misc_feature (332)..(332): n is a, c, g, or t
  misc_feature (376)..(376): n is a, c, g, or t
  misc_feature (388)..(388): n is a, c, g, or t
  misc_feature (399)..(399): n is a, c, g, or t
ctcgtccatccaccaaacttcacagcatgctccgtgcagtgcaaggaaagctccaacccggaaatgtgaacacacatggaccanggcctagatnggtgacccagagaaggagcagtgccattngggtcaggncngaagaatgcccaagaattaatcagaaaaggagaggggtagggaaaggaattcctgacacttcactttttngtgcctnggtgtcttcagaaaaataaagggttnggagnccgggcgtggtggctcatgcctgtaatcccagcacttcgggaggccgaggcgggtggatcacgacgatgtcaggagatcgaggccatccnggctaacacggtgaaccccgtctccactaaaaatacaaaaaatngccaggcacagnggcacgcgccngtagtcccagctactcgggagtctgaggcagaagaatcacttgaaccaggtaagctggagattgcgtgagctgagtgtgtccgcacacgtcttctct

SEQ ID NO: 601217 - DNA, 369 bp, Homo sapiens
accatggtcaacatcagccgtcactccaggcacaggcgactggagcagccaccatctggagcactgctggttgccatggcacagggaaagagaactctggatgctcatgcatcagcaattaaatgctccagcccagaggtggcacatgacacttctggttagagctcattggctggaactagccatatgacttcatccaactaatgtgtcagagaaagtgcaatcctatgtgtcatgttagtgaaaagctgaaatattgtgaacagcctcagttgctgtctctagtcactttcccagtggcggaataaggttggggctccacttggctatttcagtcactgggttcccttctttaggggtccaaatatc

SEQ ID NO: 601218 - DNA, 312 bp, Homo sapiens
gatctagaggattccgacctctagaggatcagacgaacaggggtttggtattgggttatggcaaggggcttttataattagataagttgttgtgatgaaattgctggcccctaagatagaggagacacctgctaggtgtaacggagaagatggttaggtctacggaggctccaggttgggagtagttccctgctaaggcagggtagactgttcaacctgttcctgctccgtgcctccactataggcagatgcgagcaggagtaggagagagggagagtaagagtcagaagcttactgttgtcaatgcgggga

SEQ ID NO: 601219 - DNA, 328 bp, Homo sapiens
gaaccaggaggctgtgtgaatggatgtggaggtctacccacccccagagtatccaaggactgcatgtggcatcctaccaggaatgccattactacctggattccttgatagcccatgtgggtccctgatgtcccagctgagacacttgttctctagaatattcccccagaacccatcccttcggtgctcctctagtagtacaatcgcacccccagctatctgacttcctggcgcacattcttccaaaacagacagaggtaggccctgaccttgtgcagctccgacgatccactgggcgactgacacctggcaagggacgaaatgtgac

SEQ ID NO: 601220 - DNA, 804 bp, Homo sapiens
gcccgttcagtatcgcgcacggaagatggcgtccgccacccgtctcatccagcggatggagtaactgggcgtccgttataacctgagggagctgacaccaccaggagatctcaaggaactcatgccatcctcgccaagtctccctgtgtgaggtccatagccacaagctctcccaacaatttactatgtgcactcgcgattggccgccgggaatctgtgcccccttccatcatcatgtcgtcgcagaaggcgctggtgtcaggcaagccagcagagagctctgcgtgtagctgccacttgagaaagaagggggtgactccagctcctcccataaagaggtggcagctgtcctcggaccagcctttacctgtgacactgcaccctcacggccacccgataactttgcctcctgtggattcctccagggagactgtgaccctactttatgacaaatacgtagagcctcaggtatcaacttctagtttacttttacaaacaactacagacactacgagacaggagttctcacccatggtccaaacacaacaacaacagaaccgcacacaacaaacaacagtgtctgggcccacctcggcgccataaagaaacggggcgcccaagaaaacttcttccaaccaccacctgccgttggcgccggccgccccaagacggacgacgcgcgaccccggccaacacgccgtgcccctgagagaaccccgggccacacgacggcgcctgggctccccccaaataaaagccgccggcggcacccaggcgctctcgaccaccccagggggccgggcc

SEQ ID NO: 601221 - DNA, 206 bp, Homo sapiens
tccccccgggccccccccgggggggttagggttttttttcccccccccccccttggtttaagggggaaaaaaaagggggggaaacccccctcccccttttttttttccccccggggtgggggttgggggttggggggtttttttttttttccccttttttttgaaaaaaaaggagggcaaaaaaaaaaaattccgttttttttcca

SEQ ID NO: 601222 - DNA, 128 bp, Homo sapiens
ctctagaggatcctcctgggtgcatgcatgtgccctggtatcacgcctgtgctggcagctatttcttgttgctcacatctcctgaggcccaggaccctggaggggacggaagaagcagagagcgcagc

SEQ ID NO: 601223 - DNA, 245 bp, Homo sapiens
gagatggaggggcctttgtccgtgttccggtgaccccagcacttgggaacgattcgcttcaaaacggtattgcttcaacttcggttggccaatatttgttaaaaaggtctctttgggccccaagttggctttggataaaaatatttggtggatgatatttggttatgttaaacccattacttacgcgttgggccaaacccatccctaagggtactcggggggagaacacaccctcagatataaga

SEQ ID NO: 601224 - DNA, 200 bp, Homo sapiens
gtgtcacagcaggccccgtgtagatggtatctttctcctttttttcataaaggtgagatgctagacatatgtgacaatgaaaataagggaagagaaacacctatcacattgcatttctattgcaagcaagaaaagaaaactaattcttctacatagaacaaaacaaaaaactctgtgtatttacatacctgaatgttact

SEQ ID NO: 601225 - DNA, 335 bp, Homo sapiens
gaactagtctcgagtgttttgtttatgtttttctgcttagatttaacacattctatcagagagtgcacgatatcaccatgccttatcattggtgaagataaccttgaacttggataaggtgctgactgccaagcctcttcactgtaaagttactggttttccctcttcatactctgttcttttgaaagtgcgttctacatatatatatttggaatttttctgtaaggaagattagcttcttttctgccaagtatttatttaggcaatcatttattttcaacatggatttatagatattgactttattttttagggtatagacctcctctcatttt

SEQ ID NO: 601226 - DNA, 313 bp, Homo sapiens
atggaaggagtgttgtatggcattgatactcggctgaaggtttgttaacacagtgtccaaagaagggacagaggtatacagaatggtctcgtctgcgtagaggtggatcagagaatcacaaacagcaagagcgacatcattgatatatataaaagattcggcccgagaattgaaccctgtggcacccccatagagactgctagaggtttggacaacaggccctccgatttgacacactgaaccctgtctgagaagtagttggcgaaccaggcgaggcagtcgtctgagaaaccaaagctgctgagtctgccaa

SEQ ID NO: 601227 - DNA, 437 bp, Homo sapiens
gttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttttttttccccgggggggcccccctttccccccccccctttttttttgccaagggggccccttttggggggtttttttttacccgggcccgggcccggtttttcccccccggggggggggaaaccctttttttggggtttttttggggggccccctttttttgggggggggccttttgggccccccccccccccgggttttaaccctttggggggaatttaaaatttttaggggttttggggggaaaccccccccctttttcccggggggggggggtttctcttcccgggttttttttt

SEQ ID NO: 601228 - DNA, 230 bp, Homo sapiens
ggggggcccgcagcttcccaaggagaaccctgcatgaacagtatccgttgtttgggctcatgctgggatgtcccagtgctcctgttgccactcctcccagccagcccggtttgctgggggcccggctgggtgtcctccccggagtgagggcttccccccattcccaaagccttagaaaagagaagtggaggggggggcgagtgtgtgaattaaggctcccctccggtcca

SEQ ID NO: 601229 - DNA, 851 bp, Homo sapiens
cctcggtaggtcggcctttttgttccgctatactttagcaaatcttttccaagcgatgatggtatgaactttcacgccgcaaccgtatagtgacatccacaatggccataagctcctataactattcactgggaagacctactactagaatccttcgttcgacagtagcgtgcgttatattcacctgacgattgagcatcgtcagatctgatgcgccggagcgcttagaaactgcctatgtctaatagtcttgacgtggaacgattgtgattccacttttcttgaccttcatcacttcggcgtaataccctagtggcaacccgggcgctatgaacaatcacgcttcgttactcctatgctactcgaatgttaatccctgtactggaacctgccgataagacaacatgcctcctcggaaagggtttactactttaccgcgcttaacagatagtcccggcaccaatcgcacgcgttccatgctagtgtacatgctgagatgctctctgcatcacggtatttccggccactaccatcaagaacgattatcctcggtcctctacaagactctcaagatggcgcaagtagtatcctgtaatttcactaacctctctaccggcgacttccgtctgctcatccccctgccacctctgtttacatctttggtcgatctagaacgaagtagtgcattgagacgagctcctcgcgccgttcctccactttagcacctctcccacatcgcccaattaccggtcgctcatatctatatctcggcttcatgaccctatcgcctcatctcatactagataaccccttatcattcaactgtgccttacgttagtttcgctcccccg

SEQ ID NO: 601230 - DNA, 102 bp, Homo sapiens
aggcatatttaatcttagagcgaaagctataatcactgcgccgtcataaggggatggcatggctaggttatagatagttgggtggttggtgtaaatgggtga

SEQ ID NO: 601231 - DNA, 1018 bp, Homo sapiens
gcacgtctagggcagagtgccctgccgagagccctgtgctgcctgctggagcctgcctgcagacgcggtcctcgtgccccacgtgaaccagtgctcggctgtgcgaatgcccagccttgtgagacacccatgtgatggaatgtgcctgtgctcctgtgctccctcctctgtgccctgtccccacttccctgtgtggcctcggtggcacacatgctgggtgctgcccccaccctgaaatgaccctccactgctctgtcctctacatgatgtcctggcttctggtgaatgtgcctgggtgctcctgtggccctgccttggctccctacgacctttgggctcgatggccatgctcctccccatgccctgctgtcccagctccttgagacttggagatgcatgccaggcaggtgccctggcagctcggctgccacggcttgctgacagctgggagggtttctacggtcttggaggcgtacgttttgaaatctcacatcacccagctgtgcacgcgttgagtgacgtggactctggtctgctgtggggggcatgcaggactggcgccactctctgccctgccatgcggctggtggtgccacaggagcctcaccgtgcctgagtggcgtgcccaggaggccgctctccttcagtaaatgtaacacagtcgaggcactgtcatcgggcagccttccctgtgtgccaacgccagcctttcgcttcttgaaaaccaaattccagccgctgccagtctggggacttggtccgccctggctgctgcagaatgtccactgccagccggaccccctgctcggtttccttctgtaagtggcacacaggcacccagctttggggtggtgctgacgctcccaggggtgcatggagccattgtacagggtgaggttccagaagctctcgaggtgccagtctccagtgagcttcttgccaatggcgtttacggattgtcataaccgccgtcccttgacaggcagttctagcccgactctgcctatgacctcggcaa

SEQ ID NO: 601232 - DNA, 164 bp, Homo sapiens
tatggctcatctttcctcacgtatctgttatcatccgccaactaatatttcactgaacatccaaacttcacgtgtggcttcagaagccggcgtcatgatacatggcatagtggtagactatggtctgacttatttctgtattgtctccgcgtattgagtgagca

SEQ ID NO: 601233 - DNA, 183 bp, Homo sapiens
tgttctatccagccgtgccagggcgaacagcccaccccctagtaccaactgatgctcccctgagacaacctgggagacaccctggagtcagccacatcaaatcagttgtcccccacacaggggagattttgaaagttttttgtttttgttttgttttgaaaaataataaacaggccactgtta

SEQ ID NO: 601234 - DNA, 494 bp, Homo sapiens
gactctagcaggatctccgtgcagataacaacagtgtttataaagtctacagtaatgtccagtaatgtcacaggccttcacattcacttaccactcacttaatgactcacccagagcagcttccagtcctgcaagctttatgcatggtaagtgccttgtacaggtatatcattttctatctttttcttttcttttcttttcttttttgagacagagccttgctctgtcatccaggctggagtgcagtggtgtgatctcggcttactgcaacctctgcctcctgggttcaagcaattctggtacctcagcctcccgagtagctgggactacaggcatgtgccaccatgcccagctaacttttgtatttttagtagagacagggttttgccaagttgatcaggctggtctcgaactcctagcctcaagtgttcctcctgcctcggtcacccaaagtgctgggattacactgcctccagcctttttctatcttttat

SEQ ID NO: 601235 - DNA, 571 bp, Homo sapiens
ccgtgatctcagaagagtgatgctagtccgaagaaatacaatgggacagaagtggcctctccagagcctccccctaggagtcacagctctctacacttctgctaagacagcattatcataagtgctgcaaatgtgccacaagagaattgttttacataaacagggtttttatgctcttaaaaaacttgaagacaagcacttgattctattagctaaagtacactgcagctagcaaaggattcacggtggaatggagccacatactgctgtctccaaactgacatcaccggcacttaaaagattgaattcttaaacacattcggctccagggaagcgctcccagactaattagagttatccatgcaaagttctagaactataagtgtgctttacatattttttactgcatggtatgattgtgtttctcaactgggggaggccactcaactaaaccataattactattgcagattacctgggaagaaaaacagtatgcattaaaggcttcagtaacagccagctttaaagcacagacagtgaccaggactgtcagatgacttccctaggggac

SEQ ID NO: 601236 - DNA, 3805 bp, Homo sapiens
ggatcctctcggggaaactgagttccagtgtcatgggtgaacaacagaagagactagctaattcttgtatatcccagaccaagctgaaagctcctcccacttcacccctcatcgtgattgttatctataaatttgattgcacaatgttgcagacccctgggactccagattggctgggagagccttcctgtgttatggtcaagatcagcctgactttctggaaggaagctggccgatgtcctgttttcagaccattccctggcttggtaaagctgagaagtgcccagatagggagctgtgatacttcgattccatccccacagccaaatctgaatctctaaacttgtttcctgatcatttggaacaggagttgttttcctaatgaggaatgctttcctctattctttgggcttgcctggactgagtgattcaacctaacaccttcccaggtctcaagtgagtcaccccagggctgcactccagcctaggctcacaaaggggaaaaagagggaactatttaagagcaccccctgctccccccttttgctaatcctttgaactactcaaagtatttcaaactactactggggtttgtgttttcttttgaatgtaggatagagggtgtaacagtttgaagctgagggtgagtctaaaagagccaaaaataagatcaaaaactaaatgttaaacgcttcaatagatcatggggggggggtgtcaaagatagtaattacttattggtttatgaatgatggtgaattaaagtcccaaagacactccaggatgctagagaccttctcagagcaaatggggtcatttaggacatttagggtacctttctccctggactttacctacatgtttcagtttctggtttggattgtggcttttcagaggcttataattaataagatacctgttccaaaaggctttctcatgggccattgatgagcgtgtgtcatgagtgtgagaaagtgcttgggaggaaggcgagcttgcaatttctaaaataatgactcatgtaaaacaaggttttattttatgatctgaccagtagcacttctaaactggcttcttcccaggagcaagcagggatctgattttaaaaactaagtgggtaaggtaggagtgagctatgtgcctctgagtacacacaacaccctccaccccaaccccccaatccacaaacaaggaggggaactgaagtctaccagttcttgagtagtgaagcttacagtcccaaagccccagccaaggttgtgaggttaggctttgagcatgcattttaattccagcgcatcagttctgtcagaaggaaccgttctccttactctcacgagagattccagctcctcctcgagttaggtcagtttatgcaccagagtttcgaagctgttcgagtttgtgtttcaactgttctcgtcgtttcctcaataagtccttttcagaggtgagcttgtgctcgtctgcttgaatggacaggatgtaggcggtggcttttttgaggatcactaccttgggggccttttcgttgttttccaattcagggatctggtcacgcagggcaaaaaagctgcgcttcagctcgttcctcctctgacgttccaagacgttgtgtgtccgcctcttgtcgtttcctccgtgtctgaggacctggggctggagcacttgcggttgttgctgatctgcttcaggaccctgccactgtccaacttggccctcttggcagctggatagtccttccttgtggaggggggtgcggcgtagttgtgctggtgagtggagacgtggcacctcttgaggaccagtgggctgtgcggaggtttgctgtggcctcgggatggagatgagcccgactccgacctcttggcaggggtttgcctcttctccacagacaccacatcaatttcttcctcatcttcttgctcttcttctgtaagggaggaagtggaagatcacacttagccacgcctcctgaatcccggacgctatacataggatttgaccgatgctatccaaataccaagttggaaagggaagaaagtaagaatcagatccagacaccatcttcccttctcccagaaaggcagacagggttagggcacaggtgagaaattaccatgtaccaggatatggtatccttgccaattcttacctaagatttaatgaggcttcagacacacccaaagcaaagcacatttcccaagcacctcctatttttaagggactttaccgagaacctttcaggtcccgtgagggatagctgcaaatctcttgctatgactttagcaactccctattttactggaagcacaattaaaaaaaaaaaaaaaaaaaaaagtcttgcagctttgccaaacgtcctggtgttgggggagtgttgggacggggggagaagtccaaattgaacagaatttgctttgaagtgttcaaaagaggacgaaaaaacaaagcaaaacaaaacacccaaaagagcccagctcttcaattctttaggaactttcactagtgcctggctctaaggctataaaggctatcccagcttctgtcattgcttctcttgggtcttagacaaacgtatccattaaattcaaatattcttctggcagtcaagaaaagaagcaggtaattcacccccctccagatcagttcctttatcctcattcacacccttcccagggtaattaaaatgcttaggaggggtaaagggagtggatggagctgaaagataagccagaagatttaaaaacccaaatgaaattcctgaggggtgggaagggtggggggtgggggtgacaaccagggcggtctgggggggggggggaggggagggagggatagctgaagcacgggaatccagggatgaagagctcttagacagaagggaaagaaagggggagccccggaggccaattgaattaatgccaatgagtggtggagaaggaggtccatccaacctctcgcttcctaccctgctgtgaatggggtagcttaccagagtcgctgctggtggtgggcggtgtctcctcatgcagcactaggggctcagggctggcccgtggggaggactcggaggacagcagcgagtccgaggaaggagagaaggccgtggaatcggacgaggtacaggatttgggcgagctgctgtcgttgagcgggtagggaaagaccactgaggggtcaatgcactcggacgcggcggcggtgaggtcctgcaggtacaggctggaggtggagcagacgctgtgcccgcgggcggggctcaggctggtgctgtctttgcgcgcagcctggtaggaggccagcttctccgagaccagcttggcagcggctgagaaaccgctccacatacagtcctggatgatgatgttcttgatgaaggtctcgtcgtcaggatcgcagatgaagctcttgttcaccatgtctcctccaagtaactcggtcatcatctccagctgatgatcggcggtggagaagttgccaccgccgccgtcatcgtcttcccttggggagaaggacgtagcgaccgcaacataggatggagagcagagcccggagcggcggctcggggacaggggcggggtgggaagcagctcgaatttcttccagatatcctcactgggcgcgggcggctgcagctcgctctgctgttgctggtgatagaaattctcttcctcgtcgcagatgaaatagggctgtacggagtcgtagtcgaggtcatagttcctgttggtgaagttcacgttgaggggcatcgtcgtggctgtctgctggagggggcacagcaagggaagcaagtctagag

SEQ ID NO: 601237 - DNA, 273 bp, Homo sapiens
gcggcgccgactactactactactcaccctcgcggccgtcgacgggtgtgtgtggagtatgcggtgtgtccggagtgtgtgatgtgtggtgtgtgtggagtgtgtgattggtgtgtgtggagttgtggactgtgtggagtctatggtgtgtggagtgtgtgtggtgtgtggagtgtgtggtgtgtgtggagtatgtggtgtgtgtgtggagtgtgtggtgtgtgtgtggagtgtgtggtgtgtggagtgtgtggagtgtgtggtgtggggtgt

SEQ ID NO: 601238 - DNA, 562 bp, Homo sapiens
ctgtttgagaggtggggcctatctctgggggcgacggtccgtcgtggtctggtggtggttggagtacctcagcggcctggggtgtcctgagtgcgtcgcgctggctgtggtggtgccgctttgtttggactttcttcttttctcagctcgtcttgtgttgtgcaagcactggtgctggggtcgagcggtgtcgcgaggttaggtgagagcgctctgcgtgttgttcccgcagggggagcgtgctggtgttcatcgtctggtgtctcgggttcttagctgctgcgctggtatgggcggcggtggaatcagccactaggtgttcggcgcatgtgcttgcgcgtgtcgtctgctagaattataagtcttacaggaaatgagggattcgcagatgagtttgttgactacgtgttttgcttgatttcagtgggcggagcacactccgccgccgccggggcgtgagatgacaggtcaatttttcgttagggtcgagtattgactcgttggtttttggacggcttccaaagaaaagaaacaggaaacaaattttcagcccaacaagaca

SEQ ID NO: 601239 - DNA, 1453 bp, Homo sapiens
ctgtgatctttgggtgcgtcatattgtgtgccgccccactgttttttgtgtatgcttggctcctttggtggcgcctcattggggccccccctgatgttgggatttgccacattgtgcccatctcggtcccttggtaggctccattggggcggccaccaacagatttctttgagtccgcgaatttggcccctcggagagcgcctcaattgtgggcgcgcacctaactctcgtccctttttgtggtggccgtcacacttggtggccccctgggtgggccgcactttgtggggttgccgcccaccatgtgccttttttagtggcggtcattgtgggggcccccccgcgccccacatgggggggccaccggggcccccctgtggggccggcttttgggcaacatgtgtgagggctgccacacatgtggggcaccttgggccaccacttggtgggttgtggccccgggttgtgggccgcggtggggcaccaccgctcctttttggatccccctgctgtgtccaccacatcccgaagggattttgggagagtccgtgtggccacaaactttctctgtggagagggaaatgagctttttcgcgcacagggtttcccccctttctctgggtgtgggagcgtctctgggaggagcgccccactactggtcttctcactctggggggggttggtgccaccgccagggagatagggccgcctctgccccacggagtatagtgttgtgtgtgagagaacattttttggccacacatgtctgaagatgtgtccacacacatggggagaagagattgtctattatataggacgcccaacaaatgtccacaacacggagagtttgccggggccccacacagttgggcttggtatacgccgctgagcacactctcacacagagatgtgagagaataattgcgtgagaaagtgccccacaagggggggtgttgtgtgtgtgtgtgtcggttataaaagtgtcgcgagtgtctcgcgctcaagagaggtgtggccccgagagagagagagccccttgctcccgggagtgtgagttgagatttggccacttgagacgctgtgagatgtgcggccgcacgaggagtttgacacgctttcgacaattgactatgagaaacgcgcttataagccacgcttgccctcttgtttataaacacttcgaatatacgaggacccttctgaaatttggtaatttttttcttgttaacccacatctttaatcttgttgggctggaatgtataaaagatcctttataaaaaattcacgttgctcttttggggtaaatttgaattacttttttaaatgagctcggggttccactcttgagctcgtttgcacttgagagttgcacaagtgcgccattttttttgtagttgtggcattttggttgacatcgaatatgactttgcctcactaaataccggttcctga

SEQ ID NO: 601240 - DNA, 89 bp, Homo sapiens
gcggccgcctactactactactgctcgaattcaagcttctaacgatgtacggggacatgccagcctgggttagggagcaagaccgtacc

SEQ ID NO: 601241 - DNA, 273 bp, Homo sapiens
gttgcactaggttcgcaatcacaactgattaatattgataaacaaagtagctctccaacacaaaatgatgagctagttaacttgaaatacactggtcaaacagttgttgaagtcaatcataaccaaccaacatttacacaagatgatttacaaattaaacagggtggctggcaaaactttcgtccttagattggttaggcagaccacacgttgctaatgcattgcttaaccagaaattgatgccgccttctcaaagtatagagcgcgtgagcg

SEQ ID NO: 601242 - DNA, 125 bp, Homo sapiens
ctgtgtgctgcagaagcactgtgtggcgtacaggtcttgcggattcacgtacacttatgatgagtagaggtagttcgtgatgcaagactcatgccaggagaagtgaagagtgctcaggcagcgga

SEQ ID NO: 601243 - DNA, 252 bp, Homo sapiens
caagacactgaagaccctgcccaagaagaagacctctggcggaggcgactcagcttgagcccctccacccccgaaggctgtagagcaaggatgaagcctcaggaggggcctcagacccaggccctggtccacactgtgccagtagcctaggtgtctcaggaccctgggccccgcagatggccagttccggtgactgcccagcggccactcttctggaaggggcttgtaagggacgaataagccccatcttgt

SEQ ID NO: 601244 - DNA, 413 bp, Homo sapiens
tgatccaccttcatatgatacccacagggtttttcacttgcagtatagtatccaataaattacatgagatatccaatacttaattataaaataggcttggggtgggatgatatggcccaacggtaggcaaaggtaagtgtccggagcacattgagacgtaggggtaagcaaaccaatgatggtggggaaaataagggtatataccaggggtattttgggaccttcggatatttcacaacctaaccgacgattttatggggaatggtacccccatcttaaggtcaggggagcatcggtaatcaaaacatccatcatcagtgggggagtgggttaaatatcccagggtggcatccgaaggggggatggggtccaaatggcaaccaggggaccctccaaaagtcgaccggcaggca

SEQ ID NO: 601245 - DNA, 347 bp, Homo sapiens
taaaagtctgtaatactagacagtaacttccaaataaataattacatatttgtacggaggatattcagatgtatgtgcccttcttcacacagacacataacgaaatatcaatgtcatgaaagacaggagacataagagcacgatggtatgaatagtagatgtggcctttgaattctgtttaattttcacttttggcaatgactcaaagtctgctctcatataagacaaatattcctttgcatattataaagggtaaagaaggatgatgtctttttattaaaatatttcaggttcttcagaagtcacacattacaaagttaaaattgttatcaaaatagtctaaggcc

SEQ ID NO: 601246 - DNA, 288 bp, Homo sapiens
atggcacatgcagcgcaggtaggtctacaagaggctattcccctatcatagaagagcttatcacctttcatgatcacgccctcataatcattttccttatctgcttcctagtcctatatggcccttttcctaacactcacgaaaaaattaaattaaatactaacatctcagaggctcaggaaatagaaaccgtctgaattatcctgccgcgcatcatctagaacttcatcggccctcgtgatcgccggatcacctctgagacccaccttggctcataaaaaaaatgcc

SEQ ID NO: 601247 - DNA, 996 bp, Homo sapiens
tgctcgacagttcgccgcacttttctggtgtgtcggcaggggatccacttcgctcatacgctcactcttatatggtgaagtgtcgcgcaatgctcacggtaggttgggccgtatccgtggcgcctgtggctcaccagaggctgctccctgaacactggttacagggcgtttcacttgttggcaacaactgagcctcattagagtagaccgtcatggtagactagctctctatactgtttcctaatgatgactaccatccagtgtgcgaagaataacaggaggaccggtcaatggcctcgagaatggccaaggcgtctgatacatcgaagggtagaaatcccaatcatgcagtgcttccaggagacttacgcacttccgtctccacacaaatcgaaggggggtggcgacgactgtagctggagattacggtgcggttcgagtgccatgtgtgagtctatcggcccaccgatgcgcaggaatgggctcggggcctccattacgatacgtggtgggcgcatggccaaatagggtcaatctggctctcctgtgcccgtctgtgctgcatggcacacgccatgtctctggtcagactggggatgtgaaccggatggagaagtattgcaccagaaaagcatcaagcatcgatccatcaatgcctgtccctgtgccatcaaagtggatctaggggacccccatgtggcaaaggtcatccgatgaactactatagaaaatccgcgagaatgtgacctcgggtgtgacccacttggccatgccatcaacttgccacccaggaagacttgtggattgggccctccggggaaacatgttgggcgtgaatgggcggggggggcttcttccaagaacatcatcccttgcctctactggggggctggcaagggttggtggggcaagtcatcccttgagcttgaacggggaaagtcactgggcatggccttgccggagtccccaactggcgaagttgttcaggtggtggac

SEQ ID NO: 601248 - DNA, 365 bp, Homo sapiens
  misc_feature (119)..(119): n is a, c, g, or t
  misc_feature (158)..(158): n is a, c, g, or t
  misc_feature (185)..(186): n is a, c, g, or t
  misc_feature (192)..(192): n is a, c, g, or t
  misc_feature (205)..(205): n is a, c, g, or t
  misc_feature (220)..(220): n is a, c, g, or t
  misc_feature (230)..(230): n is a, c, g, or t
  misc_feature (239)..(239): n is a, c, g, or t
  misc_feature (244)..(244): n is a, c, g, or t
  misc_feature (260)..(260): n is a, c, g, or t
  misc_feature (263)..(263): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (284)..(284): n is a, c, g, or t
  misc_feature (286)..(286): n is a, c, g, or t
  misc_feature (294)..(294): n is a, c, g, or t
  misc_feature (314)..(314): n is a, c, g, or t
gtgggtttgcttgtcaaggccagttttccagtgacaggcccaggggctgccccccaggtgtgctgggcagacttcagctgggacagaagtccgatctccctagggccccccctgggccnttttccccccgttttattttgttaattaaattctttccnaattgggtcgctctgggatttcttccnngggggncttttgtttctgntcttgttttccccgnggatattggngggcagcgnggttntttttgatactaaaanccnttctttcnggcngcnaatgancntgaaaggntgcctgggcccgctggagcnaaggaaagcgattttgtttggataattaaatggtctgtttttttccttcca

SEQ ID NO: 601249 - DNA, 349 bp, Homo sapiens
acattcttcatcactcgtgggaaagacacccaacagcatcatcttcgtttacgaatgtgtgtcatcactgctgtggtcctggacgaggtaacatgcttctatattttctgggggaaatacattactgtgatcctggaaactttaaaatctcatcttaaatgtatgatatatataaatatatatatatattatttataaagttgtgagttttgcatttaatctgttaatcttccgaaatagtaaaaacttctttaaaactacaacttagaaagctcatctgattcttgtcaaacatagggaacttgtaagatcatttccagctaaattattaaatatgaaactgaataaa

SEQ ID NO: 601250 - DNA, 123 bp, Homo sapiens
gcgatatactccggcctgagtgacaaatgacgtacgacaggaatcgttgaacaaacgaacctttaatagcggctgccaccaatcgcgagggactgaaccaagatcgagttcgtaatttacgat

SEQ ID NO: 601251 - DNA, 453 bp, Homo sapiens
tctcagcaggagcaatttgcgggagggtcagaatcttgtagcctccagcttcatgactcctaaaccacaacaatttccaactcttgtggccaaaatgttagtcctataaaggcagtctagatccccaggcaaggaggtttgtttccagaaaagggtatcatcttcgctttaaactataaactaagttcctcccaaaattagtttagcctatgcccaggagtaaacaaggacagcatggaggttagaagctagatagagtcagttaggtcagatctctttcactgtctcagttatagttttgcaatggtagtttcaatccctccctttcttttttttttttgtggagacggagctctgtcctgtcgcccgaactgaattgcattgccttgatctcagctcactgcaatctctaacccccgggtccaagcaatactctggcctcaggatccccat

SEQ ID NO: 601252 - DNA, 424 bp, Homo sapiens
ctgtgtactgttagtcaggggaggtatgagtgaataagggtctggtctgtactcaaagctcagtataaaaggacattgatcctggctctttatctactggttatctcgacacaccacctgccagtgcttggtttgggaagtaaaacttcctgcgtggtcacgttgttcattttggttttggatgcctttactaatggaattacggggtgggagacctaaccataggtaatttatctctgagggttgctggttggaaaaattactctggactgggtgtatgtttaaggtccagaccattaacacttttatctctagggcattcgattcagatatttctctgcacacagaagagtcatacaagacagccccctagtaccgtacccgacaactggaagacccggtccgcaggaacaccgtttctttc

SEQ ID NO: 601253 - DNA, 144 bp, Homo sapiens
ttcttagtctcattttgctacgctaggtcgggctggtttattcggcgagggacgacctgtaggcgggccgggctcgggggcacccggggtcccgggccatgtgatgtgcgcctgtctgaaggtgaacgaacttcgcgaggagct

SEQ ID NO: 601254 - DNA, 195 bp, Homo sapiens
ctcagcaccttttggactgaatcgatagtctagactacatgtatttcaaagtctctttggcaagattgcagcaagatcatgtgcatatcatcccattgtaaagcgacttcccccatatgggaacacagatagttgattttacacatatatttttgtttatgtgtgtgcgtgctgtaactatgtaacaacagctat

SEQ ID NO: 601255 - DNA, 100 bp, Homo sapiens
aggattactaatagtctatgcacctcttattctatttatcaaaacacattgtgtgagaggcgaggtacacttttaagcactccaattgcagcaggatgat

SEQ ID NO: 601256 - DNA, 435 bp, Homo sapiens
ggtgaagagaaattacaagaaataatactttttgtgtggagatggagtctcgctctgtcaccaggctggagtgcagtggcgtgatctgggctcaatgaaccctccgcctcccaggttcaagcgattctcctgcctcagcctcctgagtagcggggactacaggcatgtgccaccacacccatctaattatggtatttttagtagagacggggtttggccatgtgggtcaggctggtctcaaactcctgaactaaagcgatccgctggccttggcctcccaaagtgcggggattataggcatgagccaccacgtacggccctgagtcctctagctttaaaacaggaggaaataccttctactcttgaagaaatctctagcaattattgggtcacacatcttgcagtgttaaaaaaatctggggatggggatcatta

SEQ ID NO: 601257 - DNA, 285 bp, Homo sapiens
caacttggacaacttcactgactgctatcaactgcctgcccatcgcggcatagtggacgaaaagatcttctgctgccacggaggcctgtccccggaacgtgcagtctatgagagcagattcggcggatcatgcggaccacagatgtgactgaccagggcctgctgtgtgacactgctgtggtactgaccctgacaacggacgtagcagggctggggcgagacagcccgtggagtctcttaatacctattggagccgaggtggtggacaagttcctccacaagcac

SEQ ID NO: 601258 - DNA, 1792 bp, Homo sapiens
cacgcgtcgatcggagatgactcccacgggggcaggcctgaaggccaccatcttctgcatcttgacctgggtcagcctgacggctggggaccgcgtatacatccaccccttccatctcctttaccacaacaagagcacctgcgcccagctggagaaccccagtgtggagacactcccagagtcaacgttcgagcctgtgcccattcaggccaagacctcccctgtgaatgagaagaccctgcatgatcagctcgtgctggccgccgagaagctagaggatgaggaccggaagcgggctgcccaggtcgcaatgatcaccaacttcgtgggcttccgcatgtacaagatgctgaatgaggcaggaagtggggccagtggggccatcctctcaccaccagctctctttggcaccctggtctctttctaccttggatccttagatcccacggccagccagctgcagacgctgctggatgtccctgtgaaggagggagactgcacctcccgactagatggacacaaggtcctcgctgccctgcgggccgttcagggcttgctggtcacccagggtgggagcagcagccagacacccctgctacagtccattgtggtggggctcttcactgccccaggctttcgtctaaagcactcatttgttcagagcctggctctctttacccctgccctcttcccacgctctctggatttatccactgacccagttcttgccactgagaaaatcaacaggttcataaaggctgtgacagggtggaagatgaacttgccactggagggggtcagtacagacagcaccctacttttcaacacctacgttcacttccaaggaacgatgagaggtttctctcagctgcctggagtccatgaattctgggtggacaacagcatctcggtgtctgtgcccatgatctccggcactggcaacttccagcactggagtgacgcccagaacaacttctccgtgacgtgcgtgcccctaggtgagagagccaccctgctgctcatccagccccactgcatctcagatctcgacagggtggaggccctcgtgttccagaacgacctcctgacttggatagagaacccgcctcctcgggccatccgcctgactctgccccagctggaaatccgaggatcctacaatctgcaggacctgctggctgaggacaagctgcccacccttttgggtgcggaggcaaatctgaacaacattggtgacaccaacccccgagtgggagaggttctcaatagcatcctcctcgaactcaaagcaggagaggaggaacagccgaccacgtctgtccagcagcctggctcaccggaggcactggatgtgaccctgagcagccccttcctgttcgccatctacgagcaggactcaggcacgctgcactttctgggcagagtgaataacccccagagtgtggtgtgaggccttgtgcctagccatggagacaaggccggtgtcggagaaccattctgggcaaaactcagtgctgtcacccctggctccccatcacgccttgtagcgcggcagaggcagtctccttggagactgcgctgaccgagaataaatgatgagcagcagagcctcctgggatgtgggtttgtttggatactggggtgacagccagaagctggcactctgcacaggactgccactctggaagaaatttggaccaaaaaactgtttgtgacaccaaaaagcacccccccttttttttatttgaggacagaaattgggttttaacattaaaatgcacattatcccctt

SEQ ID NO: 601259 - DNA, 365 bp, Homo sapiens
  misc_feature (23)..(23): n is a, c, g, or t
  misc_feature (62)..(62): n is a, c, g, or t
ttgagaacatttttcatcactcnttaaagaaccccaacaaacacacccatgacagccactcngtgtttcccccttcccccaatcccctgacaattattaatctactttttatctctatttatttccctagtctggacattttatgtgaatagaatcataccatatttgtccctttgtgtctgtcttcttgcactaaatatgtttctaaggttcatccatgttgtattatgtatcagtacttcatttcattttatggttgaaatattccattgtatgtatgtaccacattttgtatatccattcgtcagctgatggacatttggattgtttccactttttgagtattaataaataatgcttctatt

SEQ ID NO: 601260 - DNA, 97 bp, Homo sapiens
gagagctgtgtcacctataggggctagctcgtcgatgcgacgacgagcgcaggagtagtgagcgaggaagcggcgcatacttcgtatagcatacatt

SEQ ID NO: 601261 - DNA, 327 bp, Homo sapiens
  misc_feature (138)..(138): n is a, c, g, or t
  misc_feature (141)..(141): n is a, c, g, or t
acccccacgacctggtgttgggtctgatcaccccaacactccaccccttggcagtcgacattctgctgtctctatgaatttgactaagtacctcatataagtggcatcgtccaatatttgtcttttttgtgtctggcntanttcacttggcatgtcaaggttcacccatgttgtagcacatgttagaatttcatttctttctaaggctgtatagtattccactgtatgcctacaccacattttgctgatccatttgcctgttgatggatacttggttgcccccaccttttggatttgtgaataatgctgctataaatattggtgtac

SEQ ID NO: 601262 - DNA, 1478 bp, Homo sapiens
gcccggcgattcccacgccagggtcttgactgacggtggtcttgctgcactgcgggaagtgccacagtggttgcatggcaggatggtccaggagtggtggcaatgtcctgccctgcgagagacatcatacttcgcgtaggtaaccactggcgaattcacaccgtgtagtgggcagaattgcccacgatgacaacgagccatctggtggacggggacgactcacattcgaacacccttcttactgctgacaactggtagcgtgggaagaacacagctaaccacacgaggaccaaattgaaagtaggactactagagagccataacggtcaattgactagaggataccgagacatgcgtcgccattagccagatccagacatatcttccactacgcagagacaagctacatacactagggaaacaagacggatagctggcgcgaacgaacgtatgacaccgtggctccagctataaccatatgggcaacggacgactcagttgaccacagtagctaggatacggatccagaaagctgtctagacacaggtgacacaagggaactatcaagggactattcgctaggatagattccaaccaggactataaagagaagagggagacaacataggcctaccatggctaacaaccctacaactcactagcatagagaagccggcatactactagttagaactcatgggacaaaaggagaattccaaaggactagggaaagttactatcccaagtcataacaacgatggtcacacagcacaaagggttgctactaaacaagaacccggaggatccgaaggccacatactaaacttcgtagtaccctagaaagcacaccaaacaagcaacgcctagagaagccacacttcagaacatgatgaccttcaatggtaggaaccaaacaggaaacagcgccagcctacattgcacgactcgaggcccaagcccgaccgaacccgtaagaacaactacgcagggacgcccaaaggcataaaaacacaaacgccacaaaacagacacaataacacaacacacgccaagaccaaagggacaaacagtcacgagtcagcaagagaaacatagagacgacaaaacggaagagagagcccccacacaatgacgagacacaatgaccacgacggataccaaagcaccgcacaacatggagagagcaaaaccgcaagcaatacccaaaatcaccccacatggggcacacccaaataaccgacaaaggaccaactaattagcaaaaagagcaggggagtaacacacaagaagcaacgaatgacgaggaggagaacgaacaccaacgagaagcgaaaaggaatagagacccgaggagccacaagcaaggaataggaggataacacaggcgcacaagagcaaacaaaagagacgtagacgaacagagacccacagaaagaggagaccaggagatacaacaccacaggagagcaaaaccagag

SEQ ID NO: 601263 - DNA, 1035 bp, Homo sapiens
gatagcacatctatgcattccatccaggtcatcgttctaccgactactatctttctcgctcactccgtctctctgcatcctctaatatgccgtaagaaagcttcccattgatcatggtccagtcatatcttatttctttatagatgcgcttcaacatttccgtctttcctcctaaaggctgatgatgtgtcgcacgtattgctcatgctcctgattagtgagcctcgcgatcccacaagatcgtagctcttgatcttacatatttcctcggatacgccagatggagttgatggccgggcgtgacgataacccttgattagaacgtgaagaggcgtacatccaggatggggagagtagctagaatccgcaccattagggaaattacctagttaccctaaaccaggtggaatcgatgattgtaaccggatagaagtctaggtatatttgtggcatttgcagacgtctaagactaactccacaggctaggttaccttatgatcattctcctctgctattttcttaaactctaaatatcaacaacagacctatttgagctgttcccgcaatacttgtttcctccgactccctctaacaagccccctgcctgaataactaactacctgagtcctaccgcctcacaatcagggcaaggcaacgtcagttatccagtgaaccattatccgacgaagaagaaactgctagctctctatactaatctccctacaaatctccttaattatgacattcacagccgcagaactaatcatattatgatatccttcttcgaaagcacaacttatgcccaacttgggctattattcaccgatgaggcaacagcagaagcctgaacgcaagggcaatactttcctattctagacctaatagggtccctttccctaatacattggatggttaactctcaaacccctatggtgcctaacttctataatcactcttggcgcagaaaataaagtcgggcgcaattaataattagggtccaaagcttattgaaggacaccttcgagcccataagcc

SEQ ID NO: 601264 - DNA, 118 bp, Homo sapiens
acaattaaaaaaaacattcttaaataggaagtagctaagtgttgaccctattacaaaggaggagggcagtattttgggatttctaataaggatccctctaggggttaccgatgctcga

SEQ ID NO: 601265 - DNA, 658 bp, Homo sapiens
  misc_feature (361)..(361): n is a, c, g, or t
gaccacccatatggaaccgtggagtacctacagcccttcaggacagtggtgatcccattgcccacgagtcctcacctgatgggtcctagtctccgccgggtttgatgctgttgaaggacatctgtctcctctggtgggatactctgtcaccgcagaatgttttggccacttgcccaggcagctgatgacctggcaggggggcgggtggtgctggccctgaaggaaggccataccttgaccgccatctgtgatgcctctaaggcttgtgtctcggctctgctcagtgagagctgcagcccttggatgaggcagtcttgcagcaaaagcccaacatcaacgcagggcccgctagagaaagtcntcgagatccaagcaaaccctggactgtgtcaaagtttccccgctggtttggccggtccctcgaaaggccccaacaaggtaaacccaaggaggcccaaatttttgagcccaatggcctttctgtcggtgggggccaaacaggcccaggtttcggcagcccgggaacacagccccaggccggcaaaggagcccatggagcaggagcctgccctgtgacgccccggcccccatccctttggggttccccattgtgattttgtttattttttctattaaaaacaaaaagtcccccattcca

SEQ ID NO: 601266 - DNA, 112 bp, Homo sapiens
  misc_feature (1)..(1): n is a, c, g, or t
ntcgagtgtattcaccactgcggtgcttgctccctgtacaagttcgtcgacacgtgagcacgtgtgacctccaaatatcgttagctggagctggtcgatctagaggacctcc

SEQ ID NO: 601267 - DNA, 313 bp, Homo sapiens
ggagtttgagaccagcctgggcaacatagcaaatgttatgttgccacctctacaaataattagccaagtgtggtggcatgcacctgtagtcccagatactcaggaggctgaggcaggagaatcacaggtcgaggtttgtagtgagctgtgatggcactgcactccagccttgggaacacagtaaagacccgtctctaaaaaagcagaaagggctgggtgcactggtcacaccttatgatcccagcacttttgggaggcgagacgggtggatcactgaggtaggagttcagatagcggggcaacatggtgatac

SEQ ID NO: 601268 - DNA, 1822 bp, Homo sapiens
ggatataaggccccaagcacctactgtaccccatacttgtatgtgaagaacgtatgtctcaagtaaaccacatttggagtaaaaaaaaaaaaaaaaacaaaaaaacaaaaaaacggggcgaggccgcgccgaacaaaatatctcccccacgacgggtcacacgggatcaacagctgcgcacccacgaccacatctgggccacaaaggggcgcccacacacacgcacacgccgaacacacacacacaccacggacacagtggacccccaaaaaccaacaaccgacagagaaacggagaaaacaactgcagcaaacacaacgagcccaacaacgagagaaagaagaacaccaaacacacacaacacggcgaacgcgagagagaacaacaccacattaggggaccaccaacaaacaaccaccaccacaaaacgaggagaaaactaaaacacagcgaaatcaaataggaggaaaaaacaaaacaatataaaaaagacgaacagcaccaaagagtagaatacaacaaaacagcgggcagaacaaaccaaacccacagaaagcgacgcgaaacaacaacccccacaagaaccgacacataataaaacaaaaactatctatacggctcacaacacccgagcccacaaacatcatcaatcactattcaccacacacaaccatcttctcacaaccacaccacatcaacaaccattaatccctgtacaaataaaaacacatacacaaacaatctcaaaccaccaaatcacacaacaccacccactcaactaaccaccaaacaacaaagaaacacaaacactaccaaaaatcacaaccaaacaccaataacacatatacttaattaccacgactcaataacacagaacacctatcacaaatactatacacaaatcaccacagaaatctcacaaataacacacactaccacaatcacaaagataaaaaattaaacaccaaaatcacataatcaccaaaaaacaacgaaaacacaaacaccacatagataaactcaactaatcaccaaaacaatacacaccaccacaaaaacaacacgaaccaaaccaacagaaaacaccaaacaaacacacaacaaacagtcaacacacagcgacagtacagcgggggaacaggaccaagagaacgcacatccgacaaccgacgagagagaagaggcagacgccagcagcggaaagagaaggaccgaggcccggcagagagcgcacgaaagagtcaacgacacacagagtgacccaacagccaagtcagacgactcgacgcactcggaccgcaggagtcaagccacgaacgcgacgaggacgaagacagtgagagcaagacgagctacacagaggcgtgccgacgcacaccgcggatgcgggaggacggaacgcagcagaccagagagacgaagacgacacagctgcgcatgacaagagcgcgcacatacacatgaacagagctgaaagcacgcgacaagaacagacaagcacagcaagatcattgcgcgccattccaaatacaacaacaacaagcagcaaacacacacactcaataatcaaacacaaaacatcaaataacacatcatacataaacaacgaatcaatcaaaaaaagaaaatatataactacacatactcaacaaaaacaagacaagacacatacccaaacaacactcttaccgcaaagaacaaacacaatgaaaacaacaaagaaaagaccaacacaacataaaaacatcacacacaactcatgcacatgcgatactatacaaataacaacacacaatcacaaacataataacaactaaacaac

SEQ ID NO: 601269 - DNA, 244 bp, Homo sapiens
aaacgcctgtatcttaatgtcttcacatcttcgaagactattccgtctagtatctggatcatcgctggccatgtctaattcctcatctcccaatctgaatacctggggtatctgcttccacaaagaatccagtagaggctctattagcaggagctttatgatcaggatcagaacgtgccaatatatacataccacttagcttttcctccggcggttatccacatcttctgaccatgaataatat

SEQ ID NO: 601270 - DNA, 551 bp, Homo sapiens
ttaccttaggctgtgatgaaacaggaggagtactgatcaaaggctttgatagggactgtggcagtttggagttttggtctctgatccgtgtttattacgatgattttaaaatatatatacatttataggctatattctatctggcattaataatatttggtattgataatacagatacagacttgattatttgggaaagacatgaagcagactccattatgtctttaagttgagctaaagtatacatcttaactactgatagtatatggaaagacggaactattctgtacctgttagtatccttcacagagagctagtggcatctgacacagaaccatgatacctggctgacactccaggatggcagtaatgcccaagtcactctgtaaaagcccaacactgtaaatcatacgtaatgtttatatgcaaaccagtagtcaaaagttaataattttagaaagaagaggttagctcataagtggctgtgttgtaatgaatgcagtagctgtttggcagctttctgaatccttggaaggccctttgtccacagt

SEQ ID NO: 601271 - DNA, 185 bp, Homo sapiens
gtagcatctgaaagatacaccgtgagagtagcaaggtagcattcggcatcatgccttgagcacgtggacttgtgaaacaggaagcaagggcttcagtgtagcccattcttgatccagagctgttgcctgttacagctgttactcatggatgtcaaaggcagctgcctggtgccctgctagcatct

SEQ ID NO: 601272 - DNA, 146 bp, Homo sapiens
gatctagaggatccctgcagtttagccacaaggggaaggggaagtttactaggccaaggatgatgaggtttcgttgagtttcaaacaatgtatgtcaggcctaaaagtggatgccaaggcagcaagtatattgtaacacatttatg

SEQ ID NO: 601273 - DNA, 172 bp, Homo sapiens
ggtctcggcccgaccccgtccgttgtgcatgctctctttgtttagcttagtaattaggacgctgcgcactgtcacatgatctggaaaatcatcaaaatgcacttattgaaagatgctcaatagttgagacttccagtgacttatttgggcctcagccccaactagctcaatc

SEQ ID NO: 601274 - DNA, 186 bp, Homo sapiens
acaaatccaattactggtatctaggttaaagtacattttgggaatcactgtgctatacttgcactttcctgaaagtataaaattttttcaaaataaaaagtgttttactgacaggcgcagtggctcacacctgtaatcccagcactttgggagactgaggtgggtggatcacttgaggtcagaaaa

SEQ ID NO: 601275 - DNA, 450 bp, Homo sapiens
  misc_feature (217)..(217): n is a, c, g, or t
gggagccaggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccncgagtccggccagtcccacctcccatgggtgccccgggagcgccgcgcgagaacatcaacgttgtcaagtacgtgggcaagcgatcataagacacctcaaatgcaggattctgtgaggtggaattccaggggccccctctccatccaggaaagagtgggctgcggaacttacagcaggcagcaatcctggagatgaaactttatccaaaagcggacacaccacaaacatgagg

SEQ ID NO: 601276 - DNA, 369 bp, Homo sapiens
  misc_feature (48)..(48): n is a, c, g, or t
  misc_feature (85)..(85): n is a, c, g, or t
  misc_feature (96)..(96): n is a, c, g, or t
  misc_feature (98)..(98): n is a, c, g, or t
  misc_feature (127)..(127): n is a, c, g, or t
  misc_feature (131)..(131): n is a, c, g, or t
  misc_feature (186)..(186): n is a, c, g, or t
  misc_feature (195)..(195): n is a, c, g, or t
  misc_feature (200)..(200): n is a, c, g, or t
  misc_feature (224)..(224): n is a, c, g, or t
  misc_feature (260)..(260): n is a, c, g, or t
  misc_feature (279)..(279): n is a, c, g, or t
  misc_feature (325)..(325): n is a, c, g, or t
tgggtatgcgccaaccctattttagggagggctcaaagtaggtggagnagatgtagccaccccgcatggagcgctgcacgttttntttaaaaagcngngggttgttttgcaggacctttgggggttntttntttagtgggtttttggggttgggttttaagaagagatattggagggaataaattntggagtttnttgtnaggattggtttttagttttttttnaggatgttgagggagatgttgcttttgaggtcaatnttggggtgatagaccattnttttacattttaccttggggggatcatgcgggtaaccctggcccancttaaaactgaacacaaacttcccactcttgtagaagccctcat

SEQ ID NO: 601277 - DNA, 921 bp, Homo sapiens
  misc_feature (42)..(42): n is a, c, g, or t
  misc_feature (263)..(263): n is a, c, g, or t
  misc_feature (311)..(311): n is a, c, g, or t
  misc_feature (388)..(390): n is a, c, g, or t
  misc_feature (406)..(407): n is a, c, g, or t
  misc_feature (409)..(409): n is a, c, g, or t
  misc_feature (411)..(411): n is a, c, g, or t
  misc_feature (424)..(424): n is a, c, g, or t
gccggtggagcggaagtcactccctgaggcagtggcgacagnggcgcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggncgtcccacgagctcacagaagctatgaacagaatatcaaacagattgngcacctttgcctctgtggagcagttctggaggttttaatagccacatggtacgtcctggggcacctgacagggccannngtgattccatctcttnnanangaaggaattaaancccatgtgggaggatgatgcaaataaaaattgtgtggcaacgtggattactcgggtgcggaaagggctgtggccttcccgttgctgggagaaatctcatttggggcattgctgggggaacagttacattggttggggaggagatctgtggggctgtggtggttgccgttcaggaagaccttatttcactatggaataagactgcagtgaccaaagcaacaagcagaatcggaacattcggcgagtgttaaactactccaaacattatggataaaactcaaccgaggattaaatgcaggagggtgggccaaaggtcctttccaactctggagccgggtgaaggcaggacttccttgggtggcatatgaggggctcgagctggtgaggtaaccgagacttggtggaaatgggatttttaacgggcaggaaaaggcatatgtgaaaaaaaagggggatatggggaatatagtgtagattatcactgttaagtagacaaac

SEQ ID NO: 601278 - DNA, 954 bp, Homo sapiens
  misc_feature (123)..(123): n is a, c, g, or t
  misc_feature (190)..(190): n is a, c, g, or t
  misc_feature (237)..(237): n is a, c, g, or t
ctctcctctcttggccgtggcttctgtctgtgaggaggcaggagctgggtgagtgggagcctatgatccccagcggtctggacagaccagtgtccacactgctgacccaacaggcttcgcgcnccacgaagacctcgcagggaatcacgcgcagacagaattagcatccagcagactaccgcactgaccntggctcttgtgctccatcgccctagtgcagtgcatcgaggtagggcntcaatagcatgtgtcctagtgagaagcgccccttgtcccctcagaagcggccaccgacgtaaggcagcaatgtaggctcactggagcttaccctatcagccgaagggctatgcctgcctgggagtccacgagaggatcatgggcacgatgcgagtacttggacgagcccatccgtgagagaatgcgcatcgacatcgcaaattctcgcatcataccaacggtcagcttcagatccaaagtcggctacaaggtgtccttatggtgctcccaccacttggagagctcaagctaatgtccctgcgtgtccagcagcccatcagatgcgaaccttgggagggtggacaggtgaccccgaccttcctatccctttcgcgaacgggcgcttccattggaatttccaacctttggggccctccggccccgtcgggttcccggcccccgcccccttctcccccccctgacccttgggggctttggtggtcggagccccttgagggttggggggccacaggacgggacgggttaactgctgccggttccagacgagaagggtggttggtccatgaagcgttgaccattagattccccatccgtacacaagggcaggggacgactttcgatcattcagaagccacgccgcagcacaccctagggtgataaaggtaaatgatcgggggcttcaccgctttgcccaagtggaaaggccttctgttcacc

SEQ ID NO: 601279 - DNA, 794 bp, Homo sapiens
  misc_feature (148)..(148): n is a, c, g, or t
  misc_feature (355)..(355): n is a, c, g, or t
  misc_feature (565)..(565): n is a, c, g, or t
gagatggagtatcactctgtacccaggttggagtgcagtggtgtatctcggctcactgcaacttccacttcccgggttcaaacgagtctcctgcctcagcctcccaagtagctgggactacaggtgtgcgccaccatgcccggctaantttgtttgtatttttagtagagacagggattcaccatgttggccaggctagtctcgaactcctgacctcaactaatcccccccaccttggcctcccagagtactagaattacaggcgtgagccaccacacccagcctgaaaagtgatttttgctgaaagaaggagataacccctttccatcctcagcatgtcaaagcacacggtggnggcccttcctcactattttgtcctagaagtagtgggaaggcacaagaattagcctctctgaaaccccctcatctcaggccctgccctccctgttgcgggacacactgtgcatgctgtcatctgtggacccacggcaccaggcagtggcgtttattgacaagttcgtctctttctgctaactgtatggacccatgtggcgggaaagactcntgattatcaatgcatccccagcacatagcacagggcatatacctgctaccaaaaatgttactgaatggctgccagggactttagaaacattatctcccttgatcctcaaaaccaccctccgtgtcagcttctaatgtccccattctgcagatagcatgactgcagaccacagaggcacaatcagctgtccgcggtcacacagtggggagctgcagggacagggtgcagc

SEQ ID NO: 601280 - DNA, 740 bp, Homo sapiens
  misc_feature (148)..(148): n is a, c, g, or t
  misc_feature (511)..(511): n is a, c, g, or t
gagatggagtatcactctgtacccaggttggagtgcagtggtgtatctcggctcactgcaacttccacttcccgggttcaaacgagtctcctgcctcagcctcccaagtagctgggactacaggtgtgcgccaccatgcccggctaantttgtttgtatttttagtagagacagggattcaccatgttggccaggctagtctcgaactcctgacctcaactaatcccccccaccttggcctcccagagtactagaattacaggcgtgagccaccacacccagcctgaaaagtgatttttgctgaaagaaggagataacccgtcctagaagtagtgggaaggcacaagaattagcctctctgaaaccccctcatctcaggccctgccctccctgttgcgggacacactgtgcatgctgtcatctgtggacccacggcaccaggcagtggcgtttattgacaagttcgtctctttctgctaactgtatggacccatgtggcgggaaagactcntgattatcaatgcatccccagcacatagcacagggcatatacctgctaccaaaaatgttactgaatggctgccagggactttagaaacattatctcccttgatcctcaaaaccaccctccgtgtcagcttctaatgtccccattctgcagatagcatgactgcagaccacagaggcacaatcagctgtccgcggtcacacagtggggagctgcagggacagggtgcagc

SEQ ID NO: 601281 - DNA, 414 bp, Homo sapiens
  misc_feature (3)..(3): n is a, c, g, or t
ggntcgacaaaatatatatatgtgtatttttagacatagtctccctctgtcacccaggcttgagtgcagtggtacgatcaggtgcacgccaccacatctggctaatttttaaaaatgtattctagggacagggtctccctgtgttgcccagggtggtcttgaactcctgacctcaagtgatcctcctgtctcagcctcccaaagtggttacatgcatctatccatgtgttaaaatcggtagaactgaggccgggtgcagtggctcacacctataatcccaccactttgggaggccaaggcaggccgattgcttgagctcaggagttcgagaccagcttgggcaaggtggtgaaaccccgtctctaccagaaatacaaaaattagctgggcatggtggctcacacttgggtagtc

SEQ ID NO: 601282 - DNA, 108 bp, Homo sapiens
cctctgcttatggtcatcttgttttatctattagcctacctctacacttccctttccctttacccttttttcctgcatggaacatagattgacccctagacatgctgc

SEQ ID NO: 601283 - DNA, 719 bp, Homo sapiens
gtatccagttacttcagcatcatgaagttctaaaccagatttggatcccgcaactataatccctttatgttataccaattactatgatttttacacgttctgagcaatattaaaattctactggatttccaaaagagacttataccccactgactaactaacacccaatatccactttgtaatactccatgaatttttttgccactttacactttgacccttggctttagtgaatgtccactatttaattttttaaggcacccctgtacacccgtttatcctacactttatcaccctttcttaaagtgttaagattctatggctcacattctatgtatttttcttaactttaccaaataaccctgagaaccacgtatagattttgtacacttaatttgagccgcttttttattaccttgaattatataaagtgcactgttaccttagaaaaattaatatttgctgctttactcttttgccaaacctttgctgtaatgaatggatttgtatttcccatatgtatcttgactgccttttgtaatatttactgctttattcctaattctgctttaaagtactgaactgggcatgaaacattaaaatattaatcccgaaactgtataaactggatgttgcttaaaatctgtatcactgccctgttgaaaactcagactgcttttgtgatgtttccaatgaataaaactatcctcccctcgtta

SEQ ID NO: 601284 - DNA, 217 bp, Homo sapiens
tttgagcttgcagatgttatggtacttgtgtacaagtggtgttgtaatatggaggagttggaaaggcttttagtttgatgaaaatgttggaaacagtggacacatatctgagagggaggaacgaggcagcgtggtgaatgcccaggaacaagatggctaagctttttgttaaaaccaaatcacagacggtgggtggcaaagcatgaagttttcccca

SEQ ID NO: 601285 - DNA, 465 bp, Homo sapiens
tctcaccccatcattaggctctgactagctatcttgctgtgctaccgtaatattctccctcacataccaggtgcagatgtctacattcctcgtggcccactttatgacttttgcactctgatttatattttaaaagcatctctgtggttgctgtgaagaataaaggaaggaggcaaggcaagtgtggaagcaggctactcacttaagctgttgtaagtcatgacttagactgtccttgaggttggactagggtgctagtggtgcaggttgtgagatttgggatcgtattagttgtctatactgtggaacaagttatcctaaacttagcttaagacagtaaatgttatctcacagcaatttgagtgtagcttagctgggtgcctcaggctcagggtctcacaaggttacagctgagatcttctctgaggctgctgtgctctcaaggtttgaggggaaaagaccctg

SEQ ID NO: 601286 - DNA, 122 bp, Homo sapiens
tctagagtatcccccgacgtagaatcatcaggacagcatcctcaatcacccaacagcatattcggttgcatcttctacacactacagctatagttaggttgcctgcggccacgctgggcctc

SEQ ID NO: 601287 - DNA, 315 bp, Homo sapiens
gcgtggctctagtgctggggtttaacatcactagaggtatggtcataggggtcttcctaggtacagaaggtcctagagaaatacccactttcttttataactatataaatctctttactgtacagagattgccattccagcgttcagaacacaggtgagatagtgtatctcatatgcataccccagcaaacattaaaattgtcatcttcacacatggacagggtccactggtaagtcctgaatctcacacatggaaaaaatacacagttgcaattgtagactgtcatatatgaacatccagcaaagaaccacacg

SEQ ID NO: 601288 - DNA, 193 bp, Homo sapiens
  misc_feature (35)..(35): n is a, c, g, or t
  misc_feature (119)..(119): n is a, c, g, or t
agtggcgatcactgagtcagagtcgagacagctgncacacagagaaatccgtctctactaaaatacaaaatagcgaggcgtgtgcacatgctgtattcctgtactcggacgctgaggangagatcacttgaaccgcgagcagaggttgtgtgagttgagacacgccattgcactccagctaggcatcagacag

SEQ ID NO: 601289 - DNA, 86 bp, Homo sapiens
tgggggggggggggggggggggggcccccggggaaatcccccccaaattttttttttttccccaaaaaaggggttttcccccccca

SEQ ID NO: 601290 - DNA, 140 bp, Homo sapiens
aaaaagggggggggggggtttttttttcccctaaaatggaagccccctgagggcagggggggggcccctttttttatcaaaaattaaatttaaaggcccccccaaaagggggcccaaaaaaaaaatttttttgaatgata

SEQ ID NO: 601291 - DNA, 115 bp, Homo sapiens
  misc_feature (64)..(64): n is a, c, g, or t
  misc_feature (80)..(80): n is a, c, g, or t
  misc_feature (101)..(101): n is a, c, g, or t
ttcccaaagtgctgggattcaggagtgagccaccgggcctgggctggctttaatgacttttttnaaagggatggctcaancaaagcacctgtgtgtgccantggaaaaaccatgg

SEQ ID NO: 601292 - DNA, 495 bp, Homo sapiens
aggtaaagtccttcctggagtggatgctctcagcagtgtttagtgcttttctgccttttggttcctgtgcatagcccctaagtcaacatagcactgtctgcatctctgcttggcattagctaatgtcttcccctttgtcaagaatcagctagtagccaagggatgtagcgccaggaaccctcaaacagttgcagaacatctcagctcatctttgctgtacctggaaattgcctatattcttcaagatcccatttgaatttcttagagactaaaccgttatgcattcttgagtacatatatttatattatgcctgttaaaacaaagtgggctgtgttagcttagttctctttctgaagtagcttattctgattcgctttgtcattgtttcaccactcagcacggaaacaagatgaaattccaattactggtacggagggagatgaagttggtgatatattaaataaataaaaagatccattgaaactggaaaaaaa

SEQ ID NO: 601293 - DNA, 880 bp, Homo sapiens
ccaaagggcacctttggattccatgtagcccatggcagtggccggcgagactcaggctctatgtgcaggccatggctgacctggacaccgcgaagctgtactcggggctgctcagggtcggggatgagattctggaggtgggcggggccaaggttgctggactgggcttggctcacatcaaagagctactggctcatgcggagagcttgtccattcgtgtcctgagacaaaggccggtcccccagtgacccagaagtaccgctgctcttgctgacactcctacaggacccctgacccacacacgcagcaggaggggctagaaacatgccacccagagataacatgtgaacggaaaatgcagttcacagatcaggcatctgtctgggcagtggcagaagctgttctgatcggccccctgcaggaagaggccgagtacccgtgtgtacgttcagttaagatcactaatttatacaggtctagagacagagaatcctggtctcctccttcacagaagtggtcacgttcctttgttggagggagagaactgcactgactaatccttgggttggtccctgagagctggctcagcttctggccacactcactgagaaggctccccagccccagaaacagagacagcgtggcacctggctttgtgccccatctctttcagcgtggcttcctggttcctgtgaccctttggtctggtccgaaggggcccggtcttggccagctgaagcaggggccatattcctactggtgttctgggaaaatgccgaccgggttgggcccctggtgtgcctctgggagtcgggcgctttaatctcgttttcgccccttggagttcgcctcctggcctaatgggggggccccttcccag

SEQ ID NO: 601294 - DNA, 1007 bp, Homo sapiens
  misc_feature (57)..(57): n is a, c, g, or t
  misc_feature (95)..(95): n is a, c, g, or t
  misc_feature (118)..(118): n is a, c, g, or t
  misc_feature (124)..(124): n is a, c, g, or t
  misc_feature (140)..(140): n is a, c, g, or t
  misc_feature (151)..(151): n is a, c, g, or t
  misc_feature (164)..(164): n is a, c, g, or t
  misc_feature (173)..(173): n is a, c, g, or t
  misc_feature (196)..(196): n is a, c, g, or t
  misc_feature (210)..(210): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (241)..(241): n is a, c, g, or t
  misc_feature (283)..(284): n is a, c, g, or t
  misc_feature (293)..(293): n is a, c, g, or t
  misc_feature (329)..(329): n is a, c, g, or t
  misc_feature (340)..(340): n is a, c, g, or t
  misc_feature (362)..(362): n is a, c, g, or t
  misc_feature (364)..(365): n is a, c, g, or t
  misc_feature (428)..(428): n is a, c, g, or t
  misc_feature (435)..(435): n is a, c, g, or t
  misc_feature (443)..(443): n is a, c, g, or t
  misc_feature (446)..(446): n is a, c, g, or t
  misc_feature (484)..(484): n is a, c, g, or t
  misc_feature (491)..(491): n is a, c, g, or t
  misc_feature (518)..(518): n is a, c, g, or t
  misc_feature (522)..(522): n is a, c, g, or t
  misc_feature (537)..(537): n is a, c, g, or t
  misc_feature (559)..(559): n is a, c, g, or t
  misc_feature (562)..(562): n is a, c, g, or t
  misc_feature (576)..(576): n is a, c, g, or t
  misc_feature (585)..(585): n is a, c, g, or t
  misc_feature (588)..(588): n is a, c, g, or t
  misc_feature (671)..(671): n is a, c, g, or t
  misc_feature (686)..(686): n is a, c, g, or t
  misc_feature (767)..(767): n is a, c, g, or t
  misc_feature (801)..(801): n is a, c, g, or t
  misc_feature (888)..(888): n is a, c, g, or t
  misc_feature (901)..(901): n is a, c, g, or t
  misc_feature (915)..(915): n is a, c, g, or t
  misc_feature (942)..(942): n is a, c, g, or t
  misc_feature (986)..(986): n is a, c, g, or t
cagtccagagtggactacattctgagtgtgatgaacgtgcctgactttgacttcccncccgaattctatgagcatgccaaggctctgtgggaggntgaaggagtccgtccctcccacnaacgcnccaacgagtaccagcngattgactgtncccagtacttccnggacaagancgacgtgatcaagcaggctgacnatgtcccgagcgancaggaccngcntcgcngccgtgtcctgactnctggaatctttgagaccaagtcccaggtggacaaagtcaacnnccacatgtntgacgtgggtggccagcgcgatgaacgccgcaagtngatccagtccntcaacgatgtgactcccatcancnncgtggtggccagcagcagccacaacatggtcatccgggaggacaaccagaccaaccgcctgcnggaggcnctgaaccnctncaagagcatctggaacaacagacggctgcgcaccaccnctgtcancctgtccctcaacaagcaagacctgcncgcngagaaagtccttgcngggaaatcgaagattgaggacnacnttccagaatttgcncgccacacnacncccgaggatgccacccccgagcccgcgagaggacccacgcgtgacccgggccaagtacttcattcgagacgagtctctgaggntcagcactgccagtngagatgggcgtcactactgctaccctcatttcacctgcgctgtggacactgagaacatccgccgtgtgtacaacgactgcngtgacaacattaagcgcatgcaccttcgtcagtncgagctgctctaagaagggaacccccaaatttaattaaagccttaagcacaattaattaaaagtgaaaggaaattgtacaagcagtnaatcacccaccanagggcatgattaanaaagcaacctttcccttcccccgagtnattttgcgaaacccctttttcccttcagcttgcttagatgttcnaatttagaaagcttaaggggg

SEQ ID NO: 601295 - DNA, 378 bp, Homo sapiens
  misc_feature (40)..(40): n is a, c, g, or t
  misc_feature (73)..(73): n is a, c, g, or t
  misc_feature (97)..(98): n is a, c, g, or t
  misc_feature (130)..(130): n is a, c, g, or t
  misc_feature (135)..(135): n is a, c, g, or t
  misc_feature (158)..(158): n is a, c, g, or t
  misc_feature (163)..(163): n is a, c, g, or t
  misc_feature (205)..(206): n is a, c, g, or t
ccatttggcgaggcagtctcgtgaggcctgtgagtgtctngttttgtcctgggtgcctgtggctgactgtggnagatttctggggaaggctggagannagctgggagacccaggagagtccctgaaggcnggggntgaagaggtgaaagaaatggggnatggntgcagtaaggtccgtgagtttgcagctgattccagggtgtgnnaagctgactccaggtgaaatctggagatggttggagagtagctgagagagacagaagagtccctgagggctgggggtgagaacatgagggagactggctagtaagtcagtgaaattcgtgagttcggtggtgactcgtgggtgcctggaactgactccagctgtaatctaga

SEQ ID NO: 601296 - DNA, 238 bp, Homo sapiens
actccttgctagtgtcaataggttccatgctcgtgtctgcgcagatgggctttgcgagcatatcgtggtcaaaaatgcctggactacggaacggtttggacggcatcagcctcttgaagccaggacaggcagagcaggggaaaagccaggagcagggacgtccatgagcactggagccattgccactaggtgagctgtccacaggaccctgagtggttcgagaagtgcgcgggtgggc

SEQ ID NO: 601297 - DNA, 208 bp, Homo sapiens
caagcgaacatggggcatgtataatttctccccttttttagttaaaaagagacaaaggaaagccacctgggctgaaaggaacactggtgtccatcaggcccccaggcctagactcacctcttcagcaacaccaagatactgggtaacatctcttcattctgagctccaaacttggccagagcgctcacagctcccgcatgtgcgctgg

SEQ ID NO: 601298 - DNA, 840 bp, Homo sapiens
taaaaccctccacctccagtggctgtaactggtcccagtgattatacgttatgggttgctgtgggtctgggcgggcctgaacccagggagggcagactttatttttttctctccttattgccaccccaggttggggaggggaggggagggtttcaagactcacagtttctccctttgccctttttaattccacaagcctccttggccccagatataagtgtgggagaactctctgcaagctttccgtgagtttcgtgcctataaaaatgtggcccccacagcactgtggtctgtggggaacaaggggccaaatgtgtgggtagaccacacagtctcatgtgccatagagacctgtggggccacaaaaagccggggacaacctctctgtggtctttcacgagggggggccccagtgtgggtgtgcccctctcccagagtgtgtgagagagaggagggccgggtgtgtattctcgggcctgtgtgtgtcccgttcagagtgttgcacagtgtcgcctgtgtgtcgccaagagagtgtgtgcgcggagagagtgtgagagattcctctcacaaaggagctgtctccctgtgggacggggggtgtcactcctctctctctctgctgtgacccctgtgtgtctcagtgaggctctcactatgtgatgctctcaccaaacggacataaggcgtgtgcatcgcacttattgtcaagagagatatctagagagagtgagatatccctctcgcacttatccccaatatattttacaaaggggtcacgtctatatatgtgtgcgccccttaagtgagaggctttgacatatgaggagaaaaacaaacaaa

SEQ ID NO: 601299 - DNA, 870 bp, Homo sapiens
  misc_feature (106)..(106): n is a, c, g, or t
  misc_feature (137)..(137): n is a, c, g, or t
  misc_feature (149)..(149): n is a, c, g, or t
  misc_feature (154)..(154): n is a, c, g, or t
  misc_feature (179)..(180): n is a, c, g, or t
  misc_feature (211)..(211): n is a, c, g, or t
  misc_feature (233)..(233): n is a, c, g, or t
  misc_feature (237)..(237): n is a, c, g, or t
  misc_feature (240)..(240): n is a, c, g, or t
  misc_feature (302)..(303): n is a, c, g, or t
  misc_feature (325)..(325): n is a, c, g, or t
gcatgatggcgcttgccgagtgattctcctcgaatacctcctgccggcgcggagacaccggggcgggggtcctgccgcaactacctcccttcctcctctcccccgnccccggagccttcatccttcccttccccccnccagctcgaggngcggncctggttcaccgggacaccatgtcnngactctgaggaggagagccaggaccggcaanctgaagaatcgtcgtgctgggngacnggnaccatccgggaagacctccttaactacgtgttttgctcaagaacacttttgggaacagtacnnaacaaactataggactggattncttttgagaaggataacattgccaggaaaacttagaattgttaccgcttcaaaattttggcgatatacggagggcagacaactagtgagagccaacaaactgttggataacaatatatctactggagcacagggagtcctcgttggtatatgatattacaaattatcaaagctttgagaatttaagaagattgggtaatacatgtggtgaaggaaagtgagcgaggagtcagaaaactcagccagtggttgccttggataaggcaataaaatagattgtggagcatattgcgactcaataaaaccctgagacacacacctatacggcgattggcaggaaaagtgggtgaaggtagccactttgtctcaaccaagacagggaaactcctggtcctccctgtgcattaccagagagttgctgcgtgaacatccttgggaatcaaattaacaaagcagaacatagcaacagtcgcagcgtattgtccgggccggacttagtgaatacccggaggaacgcaaacagatacccctctactcagaagtaaa

SEQ ID NO: 601300 - DNA, 666 bp, Homo sapiens
agcggcagcatcctgataccgaaacctggcaaagacacaacgtaaaagaagacttcagtccaataactttgatgaacatagatgcaaaaatactcaacaaaatactagcagaccaaatctagcagcacatagaaacaaacaaaacaaaaaggaattcaccactatcaagtaggctttatccctgggatgcaagattggttcaacatatacaaatcaataaatgtgattcaccacataaatggaattaaacacaaaaaccacatgattatttcagtggatacagaaaaggcttttgataaaattcaacatcacttcatattaaaaaccttcaataaacgaaacattgaaggaaaatacttcaaaattacgagagccatctatgacagccccacagccaatacgatactgaatgggcaaaagttaaatgcattcctcttgaaaaccagaaaacgacaaggatgccctctctcaccactattattcaaaataatactggaagtcttaaccagagcaatcaagaaagagaaagaaataaaagccatccaaataggaacagtgaaaatcaaactgttcctgtttagcagatgatgtgattctttacctagaaaaacacacagtctctggcccaaagctgcttataaacaacttcagcacacttttaggata

SEQ ID NO: 601301 - DNA, 412 bp, Homo sapiens
  misc_feature (62)..(62): n is a, c, g, or t
  misc_feature (75)..(75): n is a, c, g, or t
  misc_feature (174)..(174): n is a, c, g, or t
  misc_feature (202)..(202): n is a, c, g, or t
  misc_feature (340)..(340): n is a, c, g, or t
  misc_feature (347)..(347): n is a, c, g, or t
  misc_feature (390)..(390): n is a, c, g, or t
aagggaaagggccccacaaggccaagaaaacggcacaagggaaaaccggaacaaacaacagncaagggagggagncaggagagaaggcgaccacaaaagaggggagaaaaggcgacgaatcaggacacagagaacaagggaatcaagaggcagcagaagggaggagagacggcngcaaaggcagcagaagctgagctggagncaggggcagaaagccaacaggggaggaccagcccaggaaggccttccagagaggcccaccagagaatacattctcgataagtttaagaagagtttttgtaaaatgattttgcacaagtaggatatgaataagcagtanacaagtngacatatagactaataagaaataggtcgagcaaagacctctgnagtaaaatgtgaaaaagccccc

SEQ ID NO: 601302 - DNA, 275 bp, Homo sapiens
ggattggctgtccctcttgttcttgcctgtgatctgcaatgccgccctggctgctcgttccctcctgggtgcgagtcggaggggcatgagatggtgtacgaacgggatcacattctccaccaagctgtagcaccaacgttgatgaggtcgtgcgtcaggcgtcctcggactgcccatattctcttcctggccacaagctttccccaggcaggccccagctgtgacaatggcacgacactccgaatgcagtgtcttgctgccactcctccacgtgg

SEQ ID NO: 601303 - DNA, 499 bp, Homo sapiens
  misc_feature (4)..(4): n is a, c, g, or t
  misc_feature (15)..(16): n is a, c, g, or t
  misc_feature (20)..(21): n is a, c, g, or t
  misc_feature (23)..(23): n is a, c, g, or t
  misc_feature (32)..(32): n is a, c, g, or t
  misc_feature (36)..(36): n is a, c, g, or t
  misc_feature (38)..(38): n is a, c, g, or t
  misc_feature (47)..(47): n is a, c, g, or t
  misc_feature (54)..(54): n is a, c, g, or t
  misc_feature (59)..(59): n is a, c, g, or t
  misc_feature (84)..(84): n is a, c, g, or t
  misc_feature (104)..(104): n is a, c, g, or t
  misc_feature (108)..(108): n is a, c, g, or t
  misc_feature (112)..(114): n is a, c, g, or t
  misc_feature (117)..(117): n is a, c, g, or t
  misc_feature (120)..(123): n is a, c, g, or t
  misc_feature (128)..(128): n is a, c, g, or t
  misc_feature (131)..(131): n is a, c, g, or t
  misc_feature (136)..(136): n is a, c, g, or t
  misc_feature (141)..(141): n is a, c, g, or t
  misc_feature (150)..(150): n is a, c, g, or t
  misc_feature (152)..(152): n is a, c, g, or t
  misc_feature (154)..(155): n is a, c, g, or t
  misc_feature (161)..(164): n is a, c, g, or t
  misc_feature (168)..(168): n is a, c, g, or t
  misc_feature (171)..(171): n is a, c, g, or t
  misc_feature (184)..(184): n is a, c, g, or t
  misc_feature (189)..(189): n is a, c, g, or t
  misc_feature (194)..(194): n is a, c, g, or t
  misc_feature (197)..(197): n is a, c, g, or t
  misc_feature (201)..(201): n is a, c, g, or t
  misc_feature (227)..(227): n is a, c, g, or t
  misc_feature (229)..(229): n is a, c, g, or t
  misc_feature (252)..(252): n is a, c, g, or t
  misc_feature (256)..(256): n is a, c, g, or t
  misc_feature (260)..(261): n is a, c, g, or t
  misc_feature (264)..(265): n is a, c, g, or t
  misc_feature (270)..(271): n is a, c, g, or t
  misc_feature (273)..(273): n is a, c, g, or t
  misc_feature (278)..(278): n is a, c, g, or t
  misc_feature (282)..(282): n is a, c, g, or t
  misc_feature (285)..(285): n is a, c, g, or t
  misc_feature (295)..(295): n is a, c, g, or t
  misc_feature (300)..(300): n is a, c, g, or t
  misc_feature (308)..(308): n is a, c, g, or t
  misc_feature (311)..(312): n is a, c, g, or t
  misc_feature (319)..(319): n is a, c, g, or t
  misc_feature (351)..(351): n is a, c, g, or t
  misc_feature (357)..(357): n is a, c, g, or t
  misc_feature (363)..(363): n is a, c, g, or t
  misc_feature (368)..(368): n is a, c, g, or t
  misc_feature (377)..(377): n is a, c, g, or t
  misc_feature (381)..(381): n is a, c, g, or t
  misc_feature (390)..(391): n is a, c, g, or t
  misc_feature (396)..(396): n is a, c, g, or t
  misc_feature (398)..(398): n is a, c, g, or t
  misc_feature (403)..(403): n is a, c, g, or t
  misc_feature (407)..(409): n is a, c, g, or t
  misc_feature (415)..(415): n is a, c, g, or t
  misc_feature (419)..(419): n is a, c, g, or t
  misc_feature (433)..(433): n is a, c, g, or t
  misc_feature (486)..(486): n is a, c, g, or t
tacncctaatatttnntttnncntgttatccnaccncntccaaaacngcccccntggcncggtatggaatagagcagtgattcnggcacaggaaatggtccccnaaancccnnnacntcnnnnccccnccntgtcnagccntccattaantncnntgcccnnnnttanccngcctaccgccccnccccnccacngtnagcnatggatgggccagagagatgtcaaancnacatgggtaccgccatgcccctngganagcnnccnnccccnnanccganaccnccnttcccccccnttgcngtcttccnaannccccccngacaggccaatggctgattgtggacaaattcnccagantccggntccgnagccaccgnaganggccaagcnnccggntnccgancccnnnggcccngaancccgagcccgaggngacccccccagagccctgctcacagccacaatccccccaccccctgacaacgntccggggcacctc

SEQ ID NO: 601304 - DNA, 278 bp, Homo sapiens
tctggcagattgtagcggggcacgcagaggaggaggaatccgctgcctccgtggtagatggaacgcatacggatggacattcgcaaagtggacgccgtctttgtgggcactggggacctgtagctagccatagtcctggcgtggacacacagagcaccccaagtaacctcaaggtggcctgtagagaagacctgtgtctacctttgcaccagcgttctgcagagtgaccgatccatgtgtgcaaaatgcccatggccggggcaaggatgtgaggccca

SEQ ID NO: 601305 - DNA, 260 bp, Homo sapiens
  misc_feature (3)..(3): n is a, c, g, or t
acncccccccctggggggggtttgggccttttgcctgttatacccccttccccggggagggggaatggtttttatccacccgggaaaagttttcttgtttttgccccccttaaaagggaccccccccggggggtaaaaaaagttttttaattgaaaatttccccccgcctggggggtggtccaaaagttttcccaaaagaatttttgctttttgggggggatttttccccccccgccctttaaataaatttgccccccta

SEQ ID NO: 601306 - DNA, 185 bp, Homo sapiens
acaactgagctcgttacccctaattgctcttcgatgacgcagcctccagagtagctgggaccacagtcgcatgccaccacacccactaatttttgcgtttttatttttattttttttggcagagacagggtttcgtcatgtttgccaggctggtcttgaactcctgagctcaagcagtcctcacg

SEQ ID NO: 601307 - DNA, 344 bp, Homo sapiens
tctagaggatcccgagggttggttgtgggtagaggagatggggagttgtttaacgggaacagagtttcggttgggaagatgaaaaagttctggaggtggagagtatggtgatggctgcataacaatgtgaatatacccactgccactcaactgtgcacttacaaatgattaaggctgggtgcggtggctcacacctgtaattccagcactttggaaggccgaggcaggagtggatcgcctgagctcaggagttcgggaccagcctgggtaacatgatgaaaccccgtctccactaaaatacaaaaaattagccaggcatggtggtgcctacccacaaacacctg

SEQ ID NO: 601308 - DNA, 1773 bp, Homo sapiens
  misc_feature (1036)..(1036): n is a, c, g, or t
  misc_feature (1115)..(1115): n is a, c, g, or t
  misc_feature (1134)..(1134): n is a, c, g, or t
  misc_feature (1172)..(1172): n is a, c, g, or t
tggcacttcccatgagcctttttttttaattggaaacaagttgtggattcgataatttacaaaactttgtacaaaaatttcacagcgccgtgtgtgaggagcctttgggtgtggaacgtgggtgacacctgtggtgcctcttccggacgagaggaaggaagtcccaccccgctcttccagcagcagcagagccgtgtgtgtctcgtggacattctccctgtgttctccgctgtgctatccacacccttcagcgtgtgtggggcacgcagtctctttagggaaccattctcagcgtgttcaaaggcggtagaaaacccagcgcccaacaggcctgtggcgcacctcgccaggggcttatcagggaggcaccttgtgtgtgtggcagctgtggttaggctctcaggagcgctcttctctccccagggctctcccgaggccccatgtgtgggctgtgggaaagaggagaaacaggggtgcagagagaaaaacgaacacaatgtctctccacctttctgctaggaaagagagcgacacgttttatacaccaagacactctatatcaataaacagcgacgagatgtgtaaattcaaaataagtcgccccagaaaaactgcgggaaatctgcgtggagtccaccaagtgtgatctccgcggcgggggaatttgtgtgggcccgtgatgggagacccagcgagccatttgtggggacaggggcggacggtataagggggagcactactttctatcccccatttatcgtggggtgtataaaacaatttgtccaccagtttcgtggggcacacacacaggaagagcacacaaacacaaagtggtttgtgaccccctgtttctaacgacatcctacacaacctcgtggccatattaatttttaccaggagaagtgtaatcaacaacacaccggaaggaaggagggcaaaagaaactgtatggcaacccgcaggacagaccaacactgtggggggggcgcacatatacacaatgtccattctagcaaagtacatcgattgagtggcncgacgcattgtctttatgccagtacgccactatatagataacacgcaccaagtattttgttatggggaaccagcacgcnaggaatcaagacacgtcgngtgagtggggaagaaacaagaggccacgccgtgtgtgngtaataaacgcgagggccagagcccacaccacgagagaggatacagaagggactaccgcccccgcccgccactttgtatacttggagcagcaccaacaacgagcgagagttctattaacaagagaggaggaggcatatatcaacgccagaggagaacgcatcgcgcgatctatcgtcgggcagtacctataaggagggccctggcatctatgaagggaggccgaggaacagagagatccaccgcgggaggatgagccacggcgacactaagtaggagagttagtcccacgggaagcgccaacatatggtgagaggagcacggcgaccctatagtgacgagaaacaacttggaaggaaagggaccctccctagaaaaaagtgcgcagtaaagagggaaagcagggcgcacaccaagcaactacagacaatacaagaaaagggcgccccccactatatacttagagcggaaggagtacaccacacggagggatacaagaaggtcgacgatagcagaaacggagaaccacgaacggcgagacgagaaacaacgaagatgaagggaagccagcgtaagcgaacaaggtacgaccaaccaacgcga

SEQ ID NO: 601309 - DNA, 1183 bp, Homo sapiens
tttgccgccagaacacaggtgtcgtgaggataactacccctaaaagcctaggtaatgggaacatggaagaatggcaactcactagtcgaaacatatgtacgctcaattgggagcacggtagcattcgggacaagtccaccagcatagcgtggaccgatctgatctactaaactgcggttggcattcgacaataatgaaaccagttgatacaaagtttgaccaaaggagcgctgtctgtaagcatgggacatacgggctcctatcagagctatgtcctggggtctctgggactaaccagctgtagatacgtctgagccgtgaaccgatggatactcacgcaattgactactctccctctggtcgggaaaagtattgatgaaccagggcagatgctatcgttattgctagatctgatcaatatgcaatggctccccagggaacaccgagatgcatctgtgtaatacacaagagacgaatgattacagggggacagtctcccaggcatgacttcgttagcttggtcctgcattgtagtcttggctgctgcgcctgttggagctagcatagttatcgtaacgacatagggtcatcatcaccatagggatataggcgccgagaccctgaagtagcgattgtcccgtgtcttggacttacgacacctgtcgttgatgcaaaccaaaccgtgaagtccgatcgggtggttagacaatagatgggaattctcactggatcacaaccctattacatgatccaagacacggagcatcatcgtacggacacatttggttctcaacgggccaaattgtccacgcccacattcaccatctggcaacgactacatttggcggttatcgaaagccctcgtacatacatgtaaagcattgcttgatagcccaaatttcccatggggctttgcgtaaattgcggtggccgaaacacattgccgtgggtacgaccaatagtgcgcgtaaaccatttgacccttagggacttcccaattggggagttgcgacctatggtcaaccccccgtcttacgggaatgggccctatcgtccaagtctcgtaaaactccaccggcgggccatggaggggtatcctgcggaacctggctttcccttaccccacgccaaacccgcaatccaaaggtgaaacaaggccccttagacggcatggacatcttcc

SEQ ID NO: 601310 - DNA, 487 bp, Homo sapiens
  misc_feature (8)..(8): n is a, c, g, or t
  misc_feature (86)..(87): n is a, c, g, or t
  misc_feature (173)..(173): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (259)..(259): n is a, c, g, or t
gttcactntccaatggtttttttactcattgcctttcaattccttttttttgttattgctgggttggtactttaagttcttttttnnctgtttcttttggccttaaaccgtaccaactcttttgttcaaaaaaggccacaaccgttaagattgttttacttgttttttttttnccctgggtggtgggcggncnangttttccttattaaggttggcaattagcttcactcaatatttttgatattgcacattaaaaaanagtattcatcttacaaattcttctgcaatccaaacatacaatagcttggagaacatttagaaaacaaaagccaatgtaaaaagacagattaaaacaactagaacagtacaggttttatttatatggctcgaattttacagttttcttactgcatcatcaatgtcagaaatctgttccttcagctggctccattgttctggatttaaagaaataccttttcttcctggt

SEQ ID NO: 601311 - DNA, 302 bp, Homo sapiens
  misc_feature (6)..(6): n is a, c, g, or t
aactcntatgggaaacttaaatacttctctctaccccaggaattggcttattctgtaaattttctttttgagagtgttgccccaggctgcagtgcagtggtgcaattatggctcattgaagcctcaaccaatcctcccacctcagtttcctaagtagctgggactataggcacgtgccgccacagcccactaatttttaaatttttttgtagagacagggtctccctgcctaggctaatctcaaactcctcgcttcaaatggcccttccacctcaccctcccaaagtgctgggattacaggt

SEQ ID NO: 601312 - DNA, 168 bp, Homo sapiens
actagtccacggtgggctggttgatacatctcccaaaaacggagtgtgtggttcctgggttttcttgaagctggcacaaggtagctgaagaaaaacaagagattgtactctttttgtctttgtagagacagaagtctcgttatgttgctcaggctggactcaaactcc

SEQ ID NO: 601313 - DNA, 156 bp, Homo sapiens
ctctagaggatccgttgtggtggggctgaaattgtggccgaggctgtgaagaacctgactaaggttcctgatgagcgcttttatctgagctcatccccgcagtttgatttagtcatgggaatgataaaaatgaaaggtggtgtgactaatgagtga

SEQ ID NO: 601314 - DNA, 101 bp, Homo sapiens
ttagagcatgcgattagaccgaagacaataaaaaaactcagataattagacacagattaactgtaaacagttctctactctccatgtgaacaaacaagaat

SEQ ID NO: 601315 - DNA, 909 bp, Homo sapiens
agaagaaaagggagccgcgcagacgcctacggtgagttcggtcgcgcagcatgcgcggtacctggctaacctacgggctagtcgtctcaggggaatctctgatcgttgagtgccagaggctccagtccccgcgagtccacgatgcctgtccagcctccaagctaagacacagaagagatggaagccgtagggtttattctgctgctgagcatgaattggggaggaggaacggagatgtgagcgacggacgtcggacgctggcatgctcaagacagacgctctggaagcacgcgagagctccgagatggagtgatgaggactactgagcgatcgccgcagcgagtgtgtcacgtgagatgctggacctagagaagcagttctcggagctaaaggagacgttgttcagggaacgactgatgtcagctgcggttgcggcttggacggaagtgggggctgatgagagcccctgaatacacggcagccccttgggggtgctgcagtcggagcctcaacgttcgcgattcacggtggcagtggatctacatagtggcttctgtctggatgtgatcacggaataagtacgaatgtgagctgcagggagcctaaacatgcacctggagagtgagaagctgctgctctatgacacgctgcagggggagctgcaggagcggatccagaggctggagtgaggaccgactagagcctggacctcagctctgacatggtgggacgacaaatctggacgccagaggcaggtccaggtcttgggacttccctgtcgcccagcaagagggaagaaaggcaacctctggtttcttggcccatacatcgtgtacattgcttcgaagagatcgacatcctggagtgactgtacatgccatcgaaaaacggtaaggcagctgtgtccca

SEQ ID NO: 601316 - DNA, 391 bp, Homo sapiens
  misc_feature (155)..(155): n is a, c, g, or t
  misc_feature (388)..(388): n is a, c, g, or t
acatgcgtaatgtggggatctcaagaagcagactgtcctggaactctttccccttcctgtgcttctggtattgaaaaccattcatcacctgcctgaattcttaattagtcttcaaggaaaagtaaataaaatgttaaaaagcaagagattgattnggtaaagaactgaggagaggaagcacagagttcagcagtccacagcacactcaccatgtctccaaaggcgttcatggctgttgtgaagctgtgtttcccttggctgtgttcctgattgtgctgctcaatcatcttcatgttctcccacactgctctcctccatccttcttcattctaaagacaaacatgtaactgatgctctttatttctaattaaaacccagcctatgctancca

SEQ ID NO: 601317 - DNA, 448 bp, Homo sapiens
  misc_feature (2)..(2): n is a, c, g, or t
  misc_feature (17)..(17): n is a, c, g, or t
  misc_feature (34)..(34): n is a, c, g, or t
  misc_feature (56)..(56): n is a, c, g, or t
  misc_feature (444)..(444): n is a, c, g, or t
anatatgaaaatgtgangttaaaattaaaactcnaatttccttgagttcctagttncaaagtatccctactacttagtgacccctggtgcccttagtgaagagagaaagaaaagaagaaataatctctaatggcttctcaccccataagtaaaaaaggagtggctgggtgccgtggctcatgcctgtaatcacagcactttgggaggctgaggtgggtggatcgcctgaggtcaggagatcgagaccagcctggccaacatgatgaaaccccgtctttacaaaaaatacaaaaaattagctgggcgtggtgacaggcatctgtaatcccagctactcgggaggctgaagcaggagaatcacttgaacccaggaggtggaggttgcagtgagccgagatcatgccattgcactccagcctgggcaagaaaggtttctccatctcnaaaa

SEQ ID NO: 601318 - DNA, 835 bp, Homo sapiens
gatagttctccctgagtgagacttggctggctgcttctgggcgccctggtcctgtcctgtgcgtcctagctgtgggtgtgtcgtgtaggcatcgccgtgcgaggcgtccatgctcatggcatgttatctggaccagttgtactcactgcactgggtgcgtgatctctccgactgcgtttgggctggtgggactacgcaggagcgcacggttttcgtatgtgatgtactgcgtcatcggtctggagctgtctattctcgttcaaatgtggacgggagacgcggtgcggttcctggatcagatactgtctataaccaacgcggagtacgtgcgcttcgacgagcgacgtgaggggacgttccggggcggagaccggatgctgaggcgctggactgatcgacgcgagtacggtgaacagccacgaatggactatcctggcgaacgaccagtgcgtggcctgctggtggtacactcttactggcagacggcgaactacggggctggtcggagagcttcagcggtgcgagcggtgagtccatcctaaggtgactgctgtatccttcagaagaccccagtgccacatgtcggctaccgataagatgctcctggtctgttctgtgagatggctatctatcgcaggcagtccttgagagatccgggttggtcacgggaattgcccacggaatgagaacgcactggggatgtgtgtccagaagggccttgatcccacggatgggagacctggagctttcagaagcctggtggatgttggaacacagttacctcgagagtggacacggtatccatctggcggagtgggtgaacccaagggtgaca

SEQ ID NO: 601319 - DNA, 466 bp, Homo sapiens; identical to SEQ ID NO: 496277

SEQ ID NO: 601320 - DNA, 235 bp, Homo sapiens
agtcggagcttcctttaagcagctcccactccagtggagcgaaagagcaggacagagggagataactcaggctgtgaagagatttctgggagaatgacccttgcactaggtcttcggtgtgtttaggtcttcatgaagtggctttcacgtgaagttcacgctttctccagaaaaggttcaccatcgtcagggaagggcatacaagggcagaagcggccttgataggagctgggag

SEQ ID NO: 601321 - DNA, 378 bp, Homo sapiens
ctctttggaggctggggatagtagcatcaacattctcactgattaatgaagtggtgttcacattggatttgtgaacagacccatcatatgcagacttctggtctactgaggagcatgtgtctctacatgtttacagtggtggagtttccttgcccctctgccaataaccacaaaatgatcagtaatgagaaataattaagtatctagaggaagaaaacaaagacatgaatttcatgatactctcatgctttgtattatcagtgacttcattgtttctcttggcaaatttttaatgcatctgtgcttggcccaggggtgcatactagggtaaagaaaaattttgtaatagcaacagtggtttggattttcagggtccaa

SEQ ID NO: 601322 - DNA, 495 bp, Homo sapiens
aaaaaaaaaaaaaaaaaaaaaaaaaaaaaaaaaaaaaaaaaaaaaaaaaaaaaaaaaaaaaagggccccgctcgcgatttagaaccgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601323 - DNA, 133 bp, Homo sapiens
gtgtttgctgctctggtaattttgagtaaaaatgcagtattccagggatcagaaacggaaacacatgggaaccgcttttaaactttaaaatataccgaaaacataagggtccaaggttgtttgtggggcaccc

SEQ ID NO: 601324 - DNA, 213 bp, Homo sapiens
taccaagctgttacagaacatttcacgcatgaggcatgatcgggccatggagacgctcaagatcctctacaagtacgagcagaacaaggccaatgcgctcctgatcctgggagatgcaccgaggagcaaggtgaccacctttcgagcatcagtacgtcatgtgcatcaagaccctgtggcaggacccgggcatacaggaatgctacgaccgca

SEQ ID NO: 601325 - DNA, 751 bp, Homo sapiens
  misc_feature (42)..(42): n is a, c, g, or t
  misc_feature (68)..(68): n is a, c, g, or t
  misc_feature (84)..(84): n is a, c, g, or t
  misc_feature (86)..(86): n is a, c, g, or t
  misc_feature (111)..(111): n is a, c, g, or t
  misc_feature (115)..(115): n is a, c, g, or t
  misc_feature (174)..(174): n is a, c, g, or t
  misc_feature (198)..(198): n is a, c, g, or t
  misc_feature (201)..(201): n is a, c, g, or t
  misc_feature (212)..(212): n is a, c, g, or t
  misc_feature (223)..(223): n is a, c, g, or t
  misc_feature (227)..(227): n is a, c, g, or t
  misc_feature (260)..(260): n is a, c, g, or t
  misc_feature (268)..(268): n is a, c, g, or t
  misc_feature (278)..(278): n is a, c, g, or t
  misc_feature (296)..(296): n is a, c, g, or t
  misc_feature (299)..(299): n is a, c, g, or t
  misc_feature (319)..(319): n is a, c, g, or t
  misc_feature (323)..(323): n is a, c, g, or t
  misc_feature (331)..(331): n is a, c, g, or t
  misc_feature (340)..(342): n is a, c, g, or t
  misc_feature (364)..(364): n is a, c, g, or t
  misc_feature (373)..(373): n is a, c, g, or t
  misc_feature (381)..(382): n is a, c, g, or t
  misc_feature (394)..(394): n is a, c, g, or t
  misc_feature (416)..(416): n is a, c, g, or t
  misc_feature (430)..(430): n is a, c, g, or t
  misc_feature (439)..(439): n is a, c, g, or t
  misc_feature (444)..(444): n is a, c, g, or t
  misc_feature (451)..(451): n is a, c, g, or t
  misc_feature (500)..(500): n is a, c, g, or t
  misc_feature (541)..(541): n is a, c, g, or t
  misc_feature (556)..(556): n is a, c, g, or t
  misc_feature (729)..(729): n is a, c, g, or t
ttggcacgaaagtgttgaaacaaaattaaagttgcatacatnagtaacataactcaacatccttaatntggcatagacgtgacncnttttcttgccctcttgcgttctgcnaaancaccatacctaaactgctttataaaactgctacgctgaaatccacccctaccgtctccncctacgccccgccccccaacaaanccncccaaaagccncccctatcccngggnccatcccaccatcaatatcatccaagtatggancaccagcnccggataaanctgttccattttcttcanaanctggaaaaaaggcctctctngcgngtagtgcnggggattgnnnttggtaatccggatcaggggcngtgaaaggnacaccatnngatggataaaangttgggtcattcataaagtagntaggatcattttcnggtgtggcntctcnatatgtngaagttgcatggactctgccccagttacttgaccggagttctacaagcntcaagagcatctgttttacatctctactgcagtttgcatcnaggacaacgttttcnattctctgaataattgcctccatatccatctttcctttttccttccaagcatcttccaaaactgatcctgtcaactttaacaattttactgcacaaattaaattgtcatccataggattagaaaacagggcattcagcaattctcgaagaccaacctgaagaatatctgctcntgtaacctgtccatttgttccc

SEQ ID NO: 601326 - DNA, 317 bp, Homo sapiens
tagaaatggggtctcactgttgcccaggctggagtacagtggctactcacagacacaatcccactactgatcagcactggagttttgacctgctccatttctgacctgggcaagttcaccccttcttaggcaacctatggtcccctgctcctgggaggtgggaggtcactatattgattcagaattcagcgtggagacccaatcagcatagagcactatagcccagaactactggactatttctgtgtttatttgtggccgagtgtaacaaccatataataaatcacctcttccgctgttttagctgaagaattaaa

SEQ ID NO: 601327 - DNA, 1029 bp, Homo sapiens
caaacagacagctcgactttgggcacatgctgtatgctggagcaccagctttctagctccagaatacaccaacaaaaatagaaaacctatgtgctatgggcttcgactaggaactgcacgtaatagtggccttgtcttcaaaatcatgggcactgtacgcagactgcaacagaattgcttctgagtaactgaggcactagagagctgctgatatagtcaagcttgcctcttcttgaggagcaccaacatctgcttactctccaggatctctgcatagatttctctttaaacctggcattcttgcctaactgatgtctatctaggcaccattggcagactgaacaacacaaaaactcccgtgcctctgtaccctaaagctaattaaacgtctgtgctaaccttcaccaccggggaacatacctttaacttttctcttcctcaatagctgtccaaatcccctgagctacagctaaacaccatggcacacaaacccagtggctacctttagctgctcacccacgtgtacccaagacactagccaaagaacttgcggctccccggcatcccggccggacaccacatctcacgcatacactacttcccgagctgtcgtcaggggccccaatcccaaacatcgctcgcgtgctgcacttcccaaggtttacgctttaaacactggctattttaaaccagtggcatccctcctggtgcccttgtgaaactttacacctcggccgtgcccttgtacccttggacctttctataagggcaatggcgatcagcttgcacaaaagcaaccacccattttatcaacgcccaacttctgcagcaaattctcttctaccactattgccccactctctactcccagcgaattttcggccacgaaatggctggaccctaatttcgagcagcccccttatccgggccccttggctcacaccaggacagtggggacagtgtcacactcacacatactcccaccctgtctcgaacgaagcgcggcacgaggccggcaactgcgacaga

SEQ ID NO: 601328 - DNA, 449 bp, Homo sapiens
gcggccgcctactactactaaattcgcggccgcgtcgaccgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601329 - DNA, 726 bp, Homo sapiens
gctttgctcgctgctgcggtcctgcggccgtgacggcaccaatgtcgcagtggacgcaccatatcgcagtgcacccgcccgccgcgagcggccgcgcaatggaccctgctgctggcagcctgctgcactgccggaggagaaggctggcgggaccgtctgggtgtgctccgggctggcccaaacacctgtgtaccctgcaggttggtgggcagctgggtaagcctgtggaacttcgggggcgcctggtggcacttagcgttctttctcctgagtttcagacccggtaattctcttacaactgttggacgaacgggcgttccagagaactcattgcagggacgcaccaaggtttaccaggggtttgctcgcccttggaaccaaagcattattccctttgaacgcaccggaaaattgcaacttggaggtcctttaacgtgggtttcgggagacgggcgcccttattaaaacgggtttggcggacacgtttggaacttttccctttattaaccctctttttttcacgcacacggggtgacagaacaacctcgggtgggaccttttcccccgaaaggagacttgcttggttaagcttatttaccttgggcaaccctttccgaacgtaaatcttgggccagacacatatttaacgctttcgggaaaagcgccaaacttcccaaaaggagagttaatttttatttcccgtgggggtctccgcgaattttggga

SEQ ID NO: 601330 - DNA, 468 bp, Homo sapiens
  misc_feature (41)..(41): n is a, c, g, or t
  misc_feature (45)..(45): n is a, c, g, or t
aattcgcggccgcgtcgactacgctgcgagaagagacagangggnctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601331 - DNA, 1023 bp, Homo sapiens
  misc_feature (16)..(16): n is a, c, g, or t
  misc_feature (67)..(67): n is a, c, g, or t
  misc_feature (80)..(80): n is a, c, g, or t
  misc_feature (140)..(140): n is a, c, g, or t
  misc_feature (217)..(217): n is a, c, g, or t
  misc_feature (277)..(277): n is a, c, g, or t
  misc_feature (289)..(289): n is a, c, g, or t
  misc_feature (320)..(320): n is a, c, g, or t
  misc_feature (322)..(322): n is a, c, g, or t
  misc_feature (329)..(329): n is a, c, g, or t
  misc_feature (331)..(331): n is a, c, g, or t
  misc_feature (336)..(336): n is a, c, g, or t
  misc_feature (410)..(410): n is a, c, g, or t
  misc_feature (415)..(415): n is a, c, g, or t
  misc_feature (424)..(424): n is a, c, g, or t
  misc_feature (427)..(427): n is a, c, g, or t
  misc_feature (450)..(450): n is a, c, g, or t
  misc_feature (470)..(470): n is a, c, g, or t
  misc_feature (491)..(491): n is a, c, g, or t
  misc_feature (527)..(527): n is a, c, g, or t
catttttattcctatntcaacctcaacattatcctttcctaccccaaccatatcttcctttttaccntccaatccttcanctactccattcctctttataccacctacacttacacttcttaccattccatctctccctncaattcccaatcattttacaataacttcatcacatcttattatcttcttatatatcttcccccctaccattcctatnacttcatctccctcatttctccataccatttcccttactcctttcccttttccctctacnacaattccttcnccacttccttttatttctatatctacctttnantccccananacctnacccaacaccccctacttcctccattattttccttttcatccccacattcccattcctccactctttatctatncaaancactctctncantcccccttttttttttttttttnaggcaggggctggggcaggntctctcctctctctcttgtgngtggccaggaggttcccccgaccaggttggggaganttggggccagcgcttctggtctggtaaatatgtatgatgtgtgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggcagcagagggcgccacaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggcctgctttatctgacatcgaattcctgcagcccgggggatccactagtactagagcggccgccaacgaggtggagctccaggttttgttcccc

SEQ ID NO: 601332 - DNA, 187 bp, Homo sapiens
ggtcaatttctacacagtaatcagatatgtcaacatcagtgtgtctgctgatataatgtattgagacatagatatctctggtatccttaacgtaaaaatcaacctaagatggagcaaatatcagatagactcaaatttaaggacattttacaaaataactggccagtattccctgaaagtattgagg

SEQ ID NO: 601333 - DNA, 271 bp, Homo sapiens
gaaacaactgtctaaaaatgagccccaaatgaggagcctttgctccagtgaatgagatttggcagttctgcaaaatgaggaaattcttccttgtgcggcatcttgaagggttgagtcatgaaacccacagcaaatattagtgggctggattcctgaaaggcatgccagatggacgcattctggttagttttactgtgtgatgttcccttctgtacttctgtcaattttagaagaaaagagtgtgaataaagatttgagaagtgaacttaaa

SEQ ID NO: 601334 - DNA, 434 bp, Homo sapiens
cggcacgagctggtagtaagcttgggaggtaggagttggcgagtagtagcgaggagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601335 - DNA, 750 bp, Homo sapiens
  misc_feature (197)..(197): n is a, c, g, or t
  misc_feature (218)..(218): n is a, c, g, or t
  misc_feature (254)..(254): n is a, c, g, or t
tcgactacaagtcttctccacggcgtcaggtgcctggagtgaccgtgttaggcccgagagacttgacgcaggctcccgacggctttaggaggggctgggcgcccaagtcccatcctccactctgtattatgaaagaccactctctgcgagtcctccggggctagtggtgggctgggcaggcaggggctggggcaggntctctcctctctctcttgtgngtggccaggaggttcccccgaccaggttggggaganttggggccagcgcttctggtctggtaaatatgtatgatgtgtgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggcagcagagggcgccacaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggcctgctttatctgacatcgaattcctgcagcccgggggatccactagtactagagcggccgccaacgaggtggagctccaggttttgttcccc

SEQ ID NO: 601336 - DNA, 339 bp, Homo sapiens
tcagggctgcccggccaggttggtttgctctggttacattttggccaagctgccccttcctgttgacctgcatgtgtattgttgtcaccttcagctttcagcacctgggcccccttgggcagtaaggaagggccctggaggcgaggttgggaaaaaggatagctaaaacaggatcctgcggggaacaagggtgtgggcagctttcacccggggctgcctcacttaaagcccccccgagtgggggtgggggtgtccaactttccagccccaaaccgcttcctccttgtttgcaggctgtgcaggtttggcctgtgagtaaacccatttatcagcaaccca

SEQ ID NO: 601337 - DNA, 494 bp, Homo sapiens
  misc_feature (13)..(13): n is a, c, g, or t
cctgcgttgggangccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601338 - DNA, 493 bp, Homo sapiens
gattttaatgggccccctcgagtccgcggcttaataagctgattcaagtggaccaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggcagcagagggcgccacaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggcctgctttatctgacatcgaattcctgcagcccgggggatccactagtactagagcggccgccaacgaggtggagctccaggttttgttcccc

SEQ ID NO: 601339 - DNA, 832 bp, Homo sapiens
  misc_feature (518)..(518): n is a, c, g, or t
  misc_feature (525)..(525): n is a, c, g, or t
  misc_feature (538)..(538): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagggggggggggcnaaaaaancccccgggggggnccattgggaacccgtttttggaaaagggggccccaaaagggggggacgcaatatgaggccaagagacagggggcagcatgtattcaacaagccttcgctgcaagcgggaaacaacttgtctgcggggaatctctgtggaaaggaaccccaactcgggggggcaaccaatctggggacaaactcccccggaaaattacacctccggggaaatacaaattgcgggtaagtgtgaaccacgcggtatattgccgctaaaattcctcacggatacatgtgaaaaatttacggcggaca

SEQ ID NO: 601340 - DNA, 391 bp, Homo sapiens
gacataagattgaaggcaagggcggggatagaatgttatagttgggtatttgtcctgccaaaatctgatgttgaaatgtaatccccaatgtggaaggtgagtcctggtgggaagtaattgggtcatggatgcagatccctcatgaatggcttagtgctgtcctcatgatatcacatgagttttatgagatctggtcatttaaagatgtgtggcatctcctccctctgttatttgctcctgcttccaccatgtgatgtgcttattcacgctttgccttccaccatgataaaaacctctctaagccttcaccagaagctgagaagatgccagtaccatgttccctgtaaagcctacagaactgtaagccaattaaacctctcttctttataaa

SEQ ID NO: 601341 - DNA, 613 bp, Homo sapiens
gaggatcccctcacacgccgaagatcatacatcaatgagatatggtgattggatttagtgagagagaaatagtacctactgtatacagttggtaagatagttgcatgacagaaagtggagaataaatccaaaaaaaactccagggccttctacctcagtgaaatttctagggcatattgagatactccttctatttgatattttttttgttgtttgcttttttttgagatggagtctcactcttgtcgcccaggctggagtgcagtggcacaatctaggctcactgcaacctctgcctctcgggttcaagtgattctcctgcctcagcctcccaagtagctggaactacaggtgcataccaccattgcccagataatttttgtatttttagtagagacagggtttcaccatattggtcaggctgatctcgaactcctgacctcaagtgatctgcctgcctcggcctcccaaagtgctgggattacaggcatgagccaccatgcccagcctgaatttttaatttttttgagacagagtctcagtctggacgttcggcgtgtgcatgcacacgccgaggcaccatacaaatcggtgtggacgaagttggggtacc

SEQ ID NO: 601342 - DNA, 398 bp, Homo sapiens
gcggccgcctactactactaaattcgcggccgcgtcgaccgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 601343 - DNA, 491 bp, Homo sapiens
  misc_feature (83)..(83): n is a, c, g, or t
  misc_feature (119)..(119): n is a, c, g, or t
  misc_feature (125)..(125): n is a, c, g, or t
  misc_feature (133)..(133): n is a, c, g, or t
  misc_feature (143)..(143): n is a, c, g, or t
  misc_feature (186)..(186): n is a, c, g, or t
  misc_feature (458)..(458): n is a, c, g, or t
  misc_feature (472)..(472): n is a, c, g, or t
ttcggcacgaggtaatgtttaaagatcactacggaaaccatgttaggttagaacaggctttgcaaatgcaaatgtgaaagggncaagcacacagacagcagtgagtgaggtagcatggnggaaangggagganaggtttggcnagcagggctcttggagagcagctactcctcagccccacccagntagtgccaggccaggcgggaatgtgggcccagggcggtcacatcttccaactttttgcgtgaaatctcctgattttgaaattttggcaaactcttagattcgtggtaaatattctgtgtgctgaaccaagttggccttggttggcagctctgccttggaggaactagccagggaggtgattcaccagccttgctgcccctccgtgggccaccctcacaaagaagcaagccaaggctgctctgcctatggagtactggttcttttgtttcttnactttcttaataancttgctttcattttaaaaa

SEQ ID NO: 601344 - DNA, 252 bp, Homo sapiens
aactccagagatgagtgtctggagcgcacagttcagctttaaaggcaggacgggcacacgtggctggcggcctcgtttcacgtggcggcacgtccttgggcgtctctaatgtctgcagctcaagggctggcacttttttaaatataaaaatgggtgtatttttatttttttttgtaaagtgattttgggccttctgttgacattcggggtgatcctgttcttggctgtttacaattgtgagatcggtgcgtt

SEQ ID NO: 601345 - DNA, 748 bp, Homo sapiens
  misc_feature (578)..(578): n is a, c, g, or t
actagttctagatcgcgagcggcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaatttgtgacccttttgtcccaatnttttttaaacttagaaaaattttaatttggcgcccaattgggctattttggcaaatccccctattgggggggtttaaacaataaggggccctgtttttaaaagtgtggtattgaaaaaaccctgggtgtacccatttaaaacgccttggaaacccctttttgggtggggc

SEQ ID NO: 601346 - DNA, 210 bp, Homo sapiens
  misc_feature (85)..(85): n is a, c, g, or t
  misc_feature (121)..(121): n is a, c, g, or t
  misc_feature (133)..(133): n is a, c, g, or t
  misc_feature (163)..(163): n is a, c, g, or t
  misc_feature (165)..(165): n is a, c, g, or t
ggagtatggaagtgaaaagttaaaactgaacacatacattctacttacttgttatgttactccatcaacatagcaagactccatntatacaaaaaatagggccaggagcagtggctcatgnctataatcccantactttgggaggctgaggtgggtggttcancngaggttaggagttcgaaaccagcctggccaacatggtgaaacccc

SEQ ID NO: 601347 - DNA, 281 bp, Homo sapiens
ctacatcagtggtgaccagttcgaaacctggggctggcgcctgccgttcctgctgtcgatcgtgctactggccatttccacctggatccgcatgagcatgcacgaatcgcctgcgttcgcgaaaatgaaggcccagggcaagatcagcaagtcgccgatccgtgagtcgttcacttcctggccaaacctgagagtggtgctcaccgcactgttcagcatcaacgccggccaagccgtgaccttttacacggcacagttctacgtgctgttcttcatgaccc

SEQ ID NO: 601348 - DNA, 885 bp, Homo sapiens
accaaaaaaaatagatgggggaaccctcctgggggaatccccttcgggcgtggctccgacgggccgctccaaattgggggcccccaaccgggaataagggaccagtggctggaatcctaaaaggggcgaacaaaaatgggccgcctcccccacgcgcgggaggaccaaagagttgctcccacaaagagggcttctcccaaagagagatagtagcgtctcgcgctcgaattctgggcgcgcgatatctctggctgcaatatataggcgagcgacacccgcccctcctgggtcgtgagaagtaaacgcgtacagacaatagggggcgacccatatatatgtgtgtgggccaaacactcacttccgtccccggtttggttggatatagcctgtagatcttttggtcgcctcaaacttctctgggagacgcctcacactccgggtgacccacgggtgtttccaaatatggtgcacgctcccgcagaatactccgcgccatttgtggagagatgtaaacacctttgttttcgatacaattggtggtatgcgctttgatatgaacacccacggagcctttattctattgctcctcacgggcgtatggatgaaccccatcatgggtgcaattaacaagggagttggtttcgcacccacgtggttctagaggtcgttaaggagagagaatgaaattgtttcagatggacgaagtgttatactccgcccgttcttgtactgaccagcgggttcgcatactccccaacatgtctaccgggggagttcatcatttcgtagagcacatcgacgaagatagccatggtccgccacacagcctcactattccccactttgtcccctgtggaacccaaaacaaaccttctaaacccgaca

SEQ ID NO: 601349 - DNA, 355 bp, Homo sapiens
atagcttcctagaaaatggtgacttccttgaactaagtcatatttgattcttagcacatgagtgacagctccgttgggctgcttgcctggactgttaattacctgctttttgctctatgagacataggaaattttgtgccccaccgtgttgaggttactcagaggatgtccgcactaccacgttcttctttgctcttttgagcaacttccacagattctttgagtcttggttatggagttcctaatagcactcctgcctgaggagacttttgagtattatacttactgagaaattcttgattgattcagacagggtgctactccagccttgggcgatagagtgagattccatctc

SEQ ID NO: 601350 - DNA, 839 bp, Homo sapiens
  misc_feature (702)..(702): n is a, c, g, or t
ggtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaagacacaacataacaacaaaaaaaccccttggcacaattttacaaaaattacccgggaaagaatttattttcccagggtggcccattttatattaggatatatcggccagaaagggcgactttacctctctggggtttcgcaccagagattcgccctctggggccaactggtttgagtagtcgctggcaagaacatattatcctataagggagcgccaactactacataacggagaataattcgcatcatagtgcaagaatttgtaagcacgagacacggggcgaatttaaacgcccgttgggggcatataatttctacacgccccttccaaatttgggggtcgaccaacaagggggcgtcctaangaaacgcacctattactactttattatgtaaatatttggccggcaccatcatattgtgtacggggagaagacatacggggggcacacaacaaccctcgctggttccacccacctggtggaatagagagcgacacaag

SEQ ID NO: 601351 - DNA, 995 bp, Homo sapiens
gaagaaagggaggccacaaaggccgggcgaggcagtatacaagccctgaggagatcgacgcgcagctgcaggctgagaagcagaaggccaggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagacagagattgagaagcagaaggcaaaagagcgttacatgaaaatgcacttggccgggaagacagagcaagccaaggctgacctggcccggctggcccatcatccggaacacagcgggacggacggctgcccggaacgacacggaacgagcgacaacggcacacgcaacaacgacgactgccacactcgtcacggaaaacgacactgcacgtcactctccctgactacgtaacctgcgacccgtggcacgcgccgatgcccggggactgcggccgcgctgccaaggacctctgcctgtgtctcgcccaccctgtgcccctggcgccgctgcacacgcccctccatggccaggagcccccccatggcctgcgggcgccctcctcttacctctcggcacaagaaactcgataggagcgaactgacgagagcacaccacgcacacacagcacgaaacagacacacaccgaccacgacaaacaactgccacacccccactcccatccccgaacaccctcccaacacgccacacgccgccacacacaccacaagaccccctacgctcagagacggacaacggacaacacccacacacaccgaacaccaccaccccgacaacaactcacaccacacgacgacgacgaccccgcgcgcacacggacaacatgacccccgg

SEQ ID NO: 601352 - DNA, 128 bp, Homo sapiens
aatcatgcgaacggactgatcccaacaccttttcaggacaagcttcgcaccctctcatgttcgctcacaatatataggactactaccatggggcactgcagaactcacgatcagtccgttcgcatctt

SEQ ID NO: 601353 - DNA, 495 bp, Homo sapiens
ggagagaactagtctcgagttttttttttttgtttgtggcactaccaaaacatgctttattgggataaaaagtgtgagtgtgttaaagggggttgagaacgaggggggcagggctagaaagggtgcaggtgtgtggaggtgtgggggcgggggttctacatagcgtgggcaccgtggcccgtggggggttggcacgtctttatcaggaacgggaggaaaacgagagaggctcagaaagttctccggagagggtgggcgagcccgcttgtggtataccgagacatccatgtgttgttttctccgaggggagtgtgcaagaagagaggcagccctcgcagaagacaccgtgaaagtatagagcagtggcgagcgcgcacagactgtgtcgtcccgcagtgtgacaccactctagagggggaaaaagccccagagagccccgcagagagaaagacagagacacagaggacacaccctctgtggggggcagcaccgaga

SEQ ID NO: 601354 - DNA, 391 bp, Homo sapiens
  misc_feature (32)..(32): n is a, c, g, or t
taggatccccggacgcatcaaaaagagatagngacctcagtgtcaaggtcacagccaaattctggaagatattcatgtgtgctgagtgagtgatggtgctcattgaaggtgtgctggccttgttgtggatgttccgatgggcttagtccgacatagagcaacagtgcattgatgagctggaggttgtagcgattcccaggttcattggataactgtaggttgctgcccagatcagacaggaaagggaatggtgatcgagttttaagataggaatccaaatcctttttgaactgaggtggcattactccagtgaaattggtgagaatccggggagcaatgttaatttcactcaacatgtccacctttagattaggagtgaatggtgtcgaag

SEQ ID NO: 601355 - DNA, 89 bp, Homo sapiens
aatgaactaggtaggaaggctacccggggcatttcatcacaggagctagggcaggggctttcagggggactaacgtctcttttctacaa

SEQ ID NO: 601356 - DNA, 392 bp, Homo sapiens
ccaagtgctttagttgggcaggacctgggagtcagcgaggaactggccccgagaacagagaaaaggttggcacggagaggagatgctgatggcatctggaaacaagtcttacagatggtctgcacccaaagggaataaggggagacatccccaactggaatgcgtcctggagcaactgcctgggaagaagtcctcgagtttcctcaaggtgggggacagaggtcaaggatgaggccgaactaaatggaaggtcgacagctacgcaagcgggctttaaggctggggattcttcatgctggcggctgtcagcaccactttcaggatccttggggcatggaggggatggagactcgtgaactgaaaggaccagatggacatgcttttcggcttca

SEQ ID NO: 601357 - DNA, 651 bp, Homo sapiens
ttaatccaaacaatacctaacgtaatcgcaactcttttaattgatctctcccttccggccaccaaaaggataacgacccgattacaccggttcactctaccttcaatacggcgaacttgatcacctttgatgacccatctgtaaagacagtcaagaaaacgatcgataaacgtcggcgggattcctagttatcatcatggctagatatatgcggtggagacaccgcacattgctcggacgcttcgaaaggcgtcaacacccccagtacgcgtgatgactttgatgatcattaagccgacggtagttactacttacttggtttttagggagaaggttgatactgagttccccctaaaaggcgcgcggacgtcggtaacttgatcgttatgcaccccgaagtctcgtgcgcctcaatgtacgaatgcgataccaagggagttactaattctccatgattctacgccttactataagtttacgtaatatccgtccgcgtgacatcccctacaaccgatggcaacgaccatacgggtgttacgccctcaaattcacctgaatgtaactaccacttgcctacgataaaagagacatggggacccgcgcgaagagccttccggaggacccaaagaagccctgtttcttacaacaaca

SEQ ID NO: 601358 - DNA, 333 bp, Homo sapiens
tttcacccaggaggcccaaatccgaggtgggatgtagaaagttgtaaaattaaaaaggggggttggggaaccgggtgttctttccccccctttggaagattgtcataaggtttttagcaggttccccctttttttcccccccccctttgttttttttttaatcaagagaaacttccaagttaatggggggggggggtttccccgggtgggaactcgttccccccccagcctttcttgaaaaagctggtttttttttttcctcccacctccccccctggtgtgaagggtttccccattctttccaaataaaaagtaatggctttggacctgcca

SEQ ID NO: 601359 - DNA, 175 bp, Homo sapiens
  misc_feature (168)..(168): n is a, c, g, or t
gtggcatgccacccatgcaatgtgcatccatttcattctttcttcaacgtctcagttctttggttcctccacaggttgtgtttgggcatgccagcaactcacgggcaacttcgcagcgtgcacatgttttcatcaaacagcaaggcagcacactcaggggcatcctcntcagcag

SEQ ID NO: 601360 - DNA, 842 bp, Homo sapiens
  misc_feature (438)..(438): n is a, c, g, or t
taacagtttgaaaaaaaaattttttctcaaaataatgcaaaaaacaaaggttgaggctactttgtggaaagtttccctccccttctttttcctcctttccctcctttttaaatgccggggaaaacaacagttaaaggaaggaaacttgcaatcccaaacaatgaacaatcttctaaagacaaaagggttggtgtccaaaagaactccaactattatttaatcccaatgactggtaaaaagtctccactgagtcagcgtattaaaaattattgcgattaatgtatgtggttcccacaggggggctccttcagtgccccaggggggcctgcttgagggaaatgaggactgaccgcatgtcgggaaacatttttgggcctgcttgtgccacaacgtgggggttaaatatcacacagccggggcccacccgttcccacctcnatgtgccttggggaccgatctcgtccaatggtcttttccaagggcgttctctcgtggtcgcccgtgattgttggcatttgtgttttctctggtagctgcttcgccactgtcttgcattaccattcttttagccccttagatggggcttgtgctttgcccctctgatgttctttggtttccccgagaatatgggagatcaagggcgtctccccaagagggtccccattgggttcttcaccaccaattaaggggaaataattcaggggctctgggctgaacgcgaccccctttgtgaaaactggctgcaataccttgtttgtgggaccccattctttccggggatgtattcccccttctattcgcccttcaaggcttctcgcccccccgggggtccccggccacac

SEQ ID NO: 601361 - DNA, 181 bp, Homo sapiens
gggcattacagttttactgggcctctcttttcacctcctaggagcctcggagttcttcggcttctccctccaccgtatccgacggcgtctgcggctccacctggccggcatccaccagcttccacggacttcacgtcattattggctcaactttcctcactatctgcttcgtccgagcgga

SEQ ID NO: 601362 - DNA, 706 bp, Homo sapiens
  misc_feature (607)..(608): n is a, c, g, or t
ataacctgcgagcgtcgaaaaaaatcagacattcttgattcttatgagtatgatgggatctacttttttaaaaactctcagatattatgatgtcacgagtcactagtatagactatctatctagtgagttgtattataagcgatgaaatactctaaaagctacccagtaactctcgggattaattttatgaaataaattctgagctgttgctcttgatatagtcagactcaagactgatccccagtggacaggcactagatatagaattctgggtagctaattgaactcttgtgacctgtgtaaaaacacatcaaatttattgagcacatgacacggcacacatactctcagaattgtatttcagttttgaagatttaaaaaaaatgtgtaaatatatattagaatcctctattttaaagtcaattgtgaaccagaagtactgtgattttggtgatttgatggctcacacctgtgatcccagtgctctgggaggctgaggtgggaagattctctgagcccaggagttcaaggctgcagtgaattctgatcgcaccactgaactccagcccgtatgacagagtgagaccctgtttctataacacacannacaacaacaaacaacgtgtcttactgactctggaatggagatcttatattagtggtgtatttttctgcacatgtgattagtactcgtgagacttctgt

SEQ ID NO: 601363 - DNA, 183 bp, Homo sapiens
agagaaaaacacgttcacacaaaatatagtacatgaatgtttatagcagcgttttaaaaagtagccagaaaagtggaaatgatccaaatgttcctcaactgaagagtgaatgtgttgtattcatacaatggaatattatttggccataagaaggaagtactaatatataccacaatatggata

SEQ ID NO: 601364 - DNA, 411 bp, Homo sapiens
agtctttgctccctgcatttcaccttttttgttgactttccttttttgttttcccccatttgtttgccaaaggggtgggactggcaacaaaacaaccgtggctgctttatttttcctttccacggggtattcaggcctgagtggtgactcacgggagcctggcccccttgcagctgtttgccccctcaacctttgaactggaactggtggctcccacaggggttttcgacaactgcagttgaatttcatggaaaagttggattcctttgccttacgcaaaaacccccgggctccatttgccaggggcttgcccctggtcctggcaaaaatgggggctgctgaaagtgcccttccaaatccttgggggcccttcagcgccccaggctttccaataaaaacccttttccccca

SEQ ID NO: 601365 - DNA, 210 bp, Homo sapiens
  misc_feature (6)..(6): n is a, c, g, or t
gctatnaattatccatgatgggaagtgggagtcgaacatgcctttcatacctccagcattaacatcaacacagaccttaaggctgataagaagcatttacaatctattctctctgaagtcttctacctggagacttcatctgcatgataaaactttggtctccacaacctcttacaacccaggcattcctttctatcgataatgtgatag

SEQ ID NO: 601366 - DNA, 292 bp, Homo sapiens
gtgtgtgtctgtctcccggtcagggccagctgataggtctagagctggtgtgtgtctgtctccaggtcaggaccagctgataggtctagagctggtgtgtgtctgtctcccggtcagggccagctgataggtctagagctggtgagtgtctgtctccaggtcagggccagctgataggtctagagctggtgtgtgtctgtctcccggtcagggccagttgataggtctagagctggtgtgtgtctgtctcccggtcaaggtcgacgcggccgcgaatttagtagtagtaggc

SEQ ID NO: 601367 - DNA, 109 bp, Homo sapiens
cagagtccaaacagtgcccagagtccaaacagtgccctgagtccgcgatggagagagaaaaggaacagttccgtaggctctttattgggggcttaagctttgaacccac

SEQ ID NO: 601368 - DNA, 1054 bp, Homo sapiens
cgcatgtacacagtgtggcctttcctcgagcgccagtcgcgaacgcggtgtctccgcctgttttctggttctatgttcgctgcctgggtaatttccgcagggtaccgcgctggattctgctttggagaggttcgcttcttagggcgatctccgcgggtttcagccatttagccgcgcacacatgacggtgggccagaccgagccagagtctccgcgcatttggattccagaattggggcgcttccgcaagtcggccggttctccatggcacttacagcgtttttgccaagcaacctggaatgtggtgtccgtctggtgactttgatgagttcaagaagatcaatgccagtactcccaacaaacagaaagggaagagaagcgagtcctcggtctggttcttctgcgaggggagaattctggtctccatgcacactagagggacctcctccccaagatactggtattgctcgagttccccttgctggagcttcccgggggccccgggtatccgcccgggcttcttggccagaggaatccccacttggggttccccatgcccccaggctcctgccaggacttgctgggcccagtccctggggttggcgggcccatccccaccaggtgatgacccccccaggaagaggtactgttccaacccctccaacttctgcccccagcccagtattccggggctcccaccccgttcccccctggccctgggggtcctcccccaccctattgggccgaggagcacccccctcccggcactgatgggcccccctccctggtattgagaccctccctattgggtccccccactggggatcccccctggaagagggactcccatgggcatgccccctccgggatgcggcctcctccccctgggatgcgagggccccctcccccgggaatgcgcccccccaggccctagactcatcttggccctcctcagctccctgcctgtttcccctaaggctcctacatagctccttttatctcccttgtggcctatgaaactggtttataataaacttcttaagagaaccattta

SEQ ID NO: 601369 - DNA, 1481 bp, Homo sapiens
  misc_feature (1480)..(1481): n is a, c, g, or t
tccagttcccaagtcattttatcccaaaattttgtggttggttccctgattcattaaatactatacaaaacaatgtaaaatattggtctaccatttttcttctcaccccgtgtttccccccactcgggggacaacccccggggcaacctcacttaaggggtaaaaggggttctccctaccagattgggtccagcaaagtgaggcgtgagtgtgacaatagtctccctttgatctcacttttcaaaggaccctcagctgtgagggtgaggaaagcctctctgtgggactcgggaggttacataggtaagggaaatgtggatatagggttattattattttattttgggggaaaaagaacccgggcccgcgggggggaagcccttaccccaaaagaaagagggggtgttctaaacagtgtggtccacgggggtccactttctttggagccctctaaacaaggggcgccacttttaattctcaaagaacataacaaagctgtgtgacaagatttgtgtctccaattcccactgtggagaccacccactatataccatatccccccccctatctgtagtgaggcgactcatctaaaagccgccccagagaaaagttattgagtaccccgctggagatcagaggaacaatgaagtactggacaagaacaagcgcaccccctctcaaaaaatagtgacgagggcacccaccgaaacacacaaattggagcgagggggggacaacatctacaccccaacaaagagggggaaggggcgcgggtacgccaacaaaaaagagctagcaactaccaatagtgagtctgcaccgcacgaaaaaaggagcctccccagcatggatgagtcaatacactaagcgccgagtgagagccaccccagggaggttataaacgacgcccgcagcaaccttcttttataaggggggcccaaacagccgaggacgaaccaacccgtatcaacagacagacatcatgtgcgggggagaaaaaatagaaatgaccacccccaggtagagtgggggagggaaagacgacgaccaaatagaaagctaggacaccaagaacacgcgtcggtgcgagacaaacaagacgacccactaggcgacacacaggcggcgcgagggagaataccacaacactcgatgaaagaccaccagcacagaagaccccgtagaaaaacaagccgctgggcgccctagggggcactactaccacaggagcagaggagtaagaaaaacgacaaaatatatatagtcggagagacaaccaccattcccgcggtgttaagaaacatcaatggcgaggagccggaccagacaacgaacagttgggacgccccccctcactagaataagaagatacagcaccacctttagaaaagacgacataacttgtctcaacacaggcatccacgatggttaatagactgtccattctattattactattcacttctgctcctcatatagnn

SEQ ID NO: 601370 - DNA, 93 bp, Homo sapiens
ggatttgctggtgcagtacaactaggcttaatagggctcgaattcgagctcgaattcgagagcaacagagcaagaccaagtcaccaaaaaaaa

SEQ ID NO: 601371 - DNA, 756 bp, Homo sapiens
ggtggttgctcttccgttggccccgtggcttcagctcatctttggcaggaaggcgaggcttccgcccggctacaggggatgtccagctcgccgctgtccaagaaacgtcgcgtgtccgggcctgatccaaagccgggttctaacgtgctcccctagccagtccgtgttgtcctgaagtgccctcggttgccaaccaacgagaatgggcaagaactggcagtgaagcagacatagacgagggcctttactcccggcagctgtatgtgtggggcatgaggcaatgaagcggctccagacatccagtgtcctggtatcaggcctgcgggggcctgggcgtggagatccgctaacgaacatcatccttggttgggggtcaagggcttgttacccctacatgaccatgggcaacttgcccagtggggcttgatctttcctcccagttctaacctggcgggcatggacggacatctggtaaaaaacccggggccgaggtatcacatgccccgcctcgctgaggctcaacaagctaattgtgccctgtccacgtgcgtacactggaccccctctgttgaggacttccttagtggtttccaggtggttggttgctcaccaaatcccccctggaggacccagctgcgagtgggtgagttcttgtgacaaccgttgggattcaagcttggtggtggcagacactgcggggcctgtagggcagctcttctgtgcacttgggaaggactgtcctccagattccatggt

SEQ ID NO: 601372 - DNA, 386 bp, Homo sapiens
gaaatatggggaaactgcaaattaacaggctacatacatctaatatgaacaggctgtaagatattcccttactttgggggacctggggattgcaacggaaagatttgttctggtattcaaccaaaatagacagaatcgggaattctatttttaggaagtaaatacttttttgaatctattggggagaaactgattcgttttcagatgaagactatatagatatatccctgtcagagctactgacttcatcttttattgagagccaaaccaggtcttatctaaatgacaaaaaatattacagctaacaaaagcaaacgggggtgtttttaccactggaaaccccaacttttaaggtgttgttgtggagaggctattccccgccggaa

SEQ ID NO: 601373 - DNA, 895 bp, Homo sapiens
  misc_feature (580)..(580): n is a, c, g, or t
ctgaccttcttgttctgaggccaggccaccaaagacatgccgacgacaaggactagatgagcagtaaagagccagctcctcagactatcgtgtccctgctgggagtaccaatcgaagccagttacctggctgaacgtgacgtccgcgaatcccctgccacgcatccaggtacccatccgtgcgtttgttagtccgggttgctttggacaccgaatgtgtgactagctcccgtccttggtggaccgatggcgtggctggagctgcagctagctagacagttgaaagtgcacatcctgacatccgtgagcaggactgtccgcgtgtcgtgctccgatgcccagctgtgtgaaagttgccacatgagacacggcaatgtcgtgggtcgcgaccaagagcaacctagtcagtcgatgctggcagagaggaccggaggatggattactgcactagatcgaggccgccaagagagtgtggcacaacacctggagacaaaggagacttccatgtcaagttcacaggcgatccaatgatatccttacaagacctccagtgcagtgctcaacagggctagaaagtccangaacatgtatggtgggacgcccagaagcatccacatgccaagctcgcgcacaatccttcgcatgcgtactctgtgtgttcgggcatcatacccttggttccccccaaaacacacaccaagagggtagtgggtgaagctagggtcagctagacttgcatcaacttacagattgccgtctacgctagtagtgggcgagaacccggctgcaggagtatctagtctctcggaaagcttgtctgtggacgctggggtccctaggggtggaacttggatgcatcccactcgagcctcgtatagcgcggtcagcaatgtaga

SEQ ID NO: 601374 - DNA, 267 bp, Homo sapiens
  misc_feature (40)..(40): n is a, c, g, or t
  misc_feature (251)..(251): n is a, c, g, or t
gtataagctgcacgatgtctcagctatttgggtaccaagntgggagaattgcttgagcctgggaggtcaaggctgcagtgagttgtgactgccccactacactccagcctgggtgacagagcaataacctgtctcagaaaaaggaggtacattttatgggtatgtcaaacacactctgaataaacactagtatttaaagcaaacaaaaaacctttgggaaaattacaattcagttattattacctcttagntttggccaacaattga

SEQ ID NO: 601375 - DNA, 235 bp, Homo sapiens
  misc_feature (221)..(221): n is a, c, g, or t
aaagaagggaaaagagagttatctcttttgcaggagcacatttcaatcacttatcactctgggttagcataaatcagataaactatcctgtgggttgtgcaaaaagcaaaacaaaacaaaaaaacacaacttgtaaaaaaaacagagcaagataactgaagtagacaaactctgcacagaagtaactaatgggcagggaggagaaaaattattactgtgtnttaatttttgtatt

SEQ ID NO: 601376 - DNA, 863 bp, Homo sapiens
gacctccagcctgtggaagctttctttccgctcctcagcccctgacttgtaaactgtgatgccatgcagtctggagccgtcgggggacgcgactcggtctcatagcggaaaacgaacttggttccagtcgtgtggtttctcccataccctgaccaaggtccacctctgccaggatcgcaggatgattggtgcgaagacccatcgtcttatgcattgaccattgaccatcagcaaagcctggtggtcttgttctcatagtcactcgagaagaatatttatgtcatggaacggtacgattttttaaacaaagggattggaatcatgtctttgtaggaatgtgtgtgtgtgaagtcctcagctgtaaggtgctattcgagtcctgtgaccccttattgtggaatgtcttcattactgtgctctgtctcgtgacttcctgtaggtaaaccgtctacttggtgtggtgtcaccttgagctgtgcacataggacaccagttttgattaacgtaacaggcagtgtttatctctagctttttcaagccaggtattgagcagtctcttggcaacgggctgagaaaacaactgtcctgtcaggggtggctatggcataagggagaagtatccatgtacctattcttaactgctaggagtgtcttgggtccctggggcccctattttccccaagcaacaactggagggagagggttctcaccaaggccgggagagggccgggggggtcagctggacaaaacacagaaaccatcggggggggacaccacgctaagaataacaaaacctaacaaaagatacagactagcgcataaaaaacccttctctcgtcatcattatctagcgttactcacca

SEQ ID NO: 601377 - DNA, 106 bp, Homo sapiens
tggagtataaaaacaaaataatagctaagtactcctagggatttggattcagttattatgcagtgcaaccggggcatggtgatttttctatcttcggggtcttggc

SEQ ID NO: 601378 - DNA, 217 bp, Homo sapiens
agaaattccagcagcatcagccgttgctggtaagtctggagtcgctgggccgtcataccatccagatgctgcacgacgtgctggacgcgttcgcgcggatggacattgacgaagcggtacgtatttatcgtgaagataaaaaagtcgatcaggaatacgaaggtattgttcgtcaactgatgacctacatgatggaagattcgcgtaccattccgag

SEQ ID NO: 601379 - DNA, 317 bp, Homo sapiens
gtgtttgtcttgtgtgatggggtggcagaatgattgtagccgcctacagtcgtatctttctgcagcatccgttctcagctcctcacatggggcaggtagcgcactccgaggtcaactccatgtcagaggtgagggcactcaaactagccctcctgctgagtgttcagcaaccttcaccattatatccaaactgcatcaatgaatctcaagtgcggggggacatcggcaggtcaatggtaattgctgcaggtcgttgggagtcacacagataaacttggtctatcaggtattgcatcagcgcaggggatccctctaga

SEQ ID NO: 601380 - DNA, 148 bp, Homo sapiens
ctgagtgatctacagatctattctgcaccacagcaggtgcactgctacatccgtctgtgagtaggtgagagcagggaagtagactttgactcaacgggacggtgctcacagtggactctagcacaggctttgcattagcagcccaaaa

SEQ ID NO: 601381 - DNA, 1086 bp, Homo sapiens
ggagagagagagagagagagagagagagagagagagagaggtccggctattagcctactgtggctagtcacccccgtgtgtcccggccttctcgtggctgggagcccgccgacaccgcgggagagacggggagggtcgcgcctagtggctgtctctgctgtggagtgacgcctggacctctaacgacaagggtagttagtgtgaatactacaaatagtgtattttcctggtatgattcaagcgaagcagcaatgtggaaggactatcacctattgtgatcttctttctacgacgggcagctataacaatcatcgctcgtgcatcatgcttttcacctagtctgtcgatgacctctaagtgtactttcgggcctttttcaccaggaggtagtcgatcgtcgtgtttccaagaaagaacatactactcgtaggaagagagctactccctccctcgtgtttagtctctctctcttcgtccttctttttattctatcgatggtggatgcttacgtcctctctcccccgatagtgtgctcctgcttcattcctcagacctctctactccgagctcttttagtcggcagaacgtgagctgttggtggcgatcttcatggtgctgtctctaactttctcgttgtgcccctggatacttccatatctccttctcctgatactttacgacgctaggtgcttacatactcttcttatagtggtatttgggtctacgtactccaatactcttcgtatagcgccaacaaggagaaaagcagtaatgttcatgaggaatggtagctgcgttgtagacatcgtgcccagtgttgactcaccgtgtaggacgagcgattcatcagcccacttttgactattgtggtgcagtgtggacatctcgtgggggcgtggcgccatgaagcgcgctttggctggactcccggtagttttacgggctccttctgcgttgcaccaactcagttatttaccctggggaagtctgatgtgactctctttccttcagtggcattcttcttccccaattttggccgcgtgcctggggggcatccaaggtcctctgctggaaccttccttgttt

SEQ ID NO: 601382 - DNA, 237 bp, Homo sapiens
  misc_feature (80)..(80): n is a, c, g, or t
  misc_feature (199)..(199): n is a, c, g, or t
gagcaccccagcccataacacagaactcgtccccctacccccctcagcaagccggagaggctagcccaagtaatcataanaacagccgcccgagagcagccccagtagcagccccatggccgggcggaacacctacatcgacaacctcatgacagacgagacctgccaggacgcagccattgcgggctgcaaggcctcncccttcgtctgggccgccgtccccggagaaacgctcgt

SEQ ID NO: 601383 - DNA, 871 bp, Homo sapiens
  misc_feature (148)..(148): n is a, c, g, or t
catttttcaacaaattcagttttaagatctctggtttagcgggagagattttatttctagctgaaccagttctatagaaattattttattaggaaatttgtctttggaacaaagtggcagctataaaattcactttttgtctaagccntcagaagatatgaggaaagccgtgtaaaactctagtgggggcagatagtttaacttggtagacctatatgctctcgtaagactatgtcatttaaacgtgttggtttattcacgctgtgtcttcagttctctaagaatgattttcgtttctaccagtgattgcaccgagcttatgagcatgggtgctgacacatttctatagacacgtggttcatgcagcgaggtttgaaataaatcgctctatacaaggtgtctagaatcaatttgaaaagcgtaaaaagtggaaatttccttttatgtagaccgtaggaaccaggaacttatatgcatttttgactaagtagtaattttacagctgaattgtaaatgtttcttacagtgagttttattacatgagaatgcttcaccttgaattgggaaacaataatagtctggactaaggtcttggtgactaaaggcattggctataagttatgtttagaagaaacgaacagatgaaaacctcagagaaggcatgtggacttagtaaggatattgtctagtaacaaatcgtacttgagatactgttcaaatagtctaatttctcatttaggggggtgatattttttcatgtctacgatggtgtctcacgctatctgccaggtctggagtgcagtggcgcgaactcgagtcactgcagagctccggctcctgggttcaagcaatgctccttcctcaggctccc

SEQ ID NO: 601384 - DNA, 472 bp, Homo sapiens
ccacattgtactagagtttgacaaacatagggcaactcaggtgagactaaaatagcacttctactggcttccactccatatctcattcatgaatagcaaaagtagtactacaggcacattagttctgttcgggcagatttggagcacctctacaaccttaccttaacataggtaattaatcgcaggtaaggtagagtctcaccttcaataccccacactccagataaaactaccagagaggagggaatggttaggccgttacaaccaataagcaccaaaaataatgataatataaagatatcataggacaatacatctatatgataaataactgtgctttaaaaactgtcatcacagggaaagcaattacaagatcatattcacatcagaaagtaaacattgtatatccccaaaaacacctcccatatctaaggacgcaacttggctaccgttcggctagatcaaccaaagt

SEQ ID NO: 601385 - DNA, 212 bp, Homo sapiens
gtatgttatagaccccgcctattcctaactcactgatggctgtagaagtgtacccaagattgatgtagaggactctatctcatttctgtgaagcaatctcactgcgtggatctcagaatatgacacttacctcccctgactacaagctcgtagaaataacagccttatacaaaaatggtcagggatgagtccatcatacgcccaggtatgca

SEQ ID NO: 601386 - DNA, 648 bp, Homo sapiens
cccgggccccccaaaggcccccccccccagggccggggcgcctgtgggccctattccagaaaaagcccctgtgtgtgggggggggccccccccccccccccccctcccccccctcggggggctgtttaaaaaaagtggcctttgcaagcgaggggggggtttacccctctccgtgtgcctctccttggcgcacgccccccccccacccggggccagggggccaaaaaaaagcgcccttcggggttggcccaccggccctcccccgtgccttaggtttcccttaattttgggtggggggggcccccctctttcccggacggggccgggccggggggtggggaaccccaccaaaagggtggggtggggccttcaatggggccccccctctgggcccccagggggacccccccccgggggggcaacccccccagccccgttttgttaggggccccccccttccccccccaaggccccccggggccattgggggggctggggggggttgggcccttcccccccccgggggggggtggggcccccccccccccccttttctcctttccccggggggtttttttccccatttttaaagtggtttttaaaaagggaaaaaaaggccttggggtttttttaaaaaaggggccccca

SEQ ID NO: 601387 - DNA, 160 bp, Homo sapiens
  misc_feature (86)..(86): n is a, c, g, or t
  misc_feature (125)..(125): n is a, c, g, or t
ccctctcacaaccaacacacacatgacctgtcccctggcacccccaaatttaagagtggattgcaaatcttttggagaccatggcnctgctacatgtagaaaaacctgttctgctattcctgggnccacaataaacccagaaattatgttttgagttact

SEQ ID NO: 601388 - DNA, 324 bp, Homo sapiens
atggaagctgataagaagttcagacgctacgtgttgcttatgttctgctttgttggcagcctgtctctttcagagttcctaaacacgatattcccatgggcttctaattcccagctgtagtgctccaaagccatgctgtgtatcagaatgccatcgggaataacttctgcactctaggactgaggttggttcaagcatctggatgatgtcgaaagtccacgttgtgtgttggcctaccctgaaggaccctatctagttctagcctttaaattccttctgtcaccaaatctagagttacatggcatctgtacaagctaggtagct

SEQ ID NO: 601389 - DNA, 504 bp, Homo sapiens
  misc_feature (278)..(278): n is a, c, g, or t
  misc_feature (284)..(284): n is a, c, g, or t
ggccattgttctgtgatggaataatagcaattggtgtagtcacgaggagtttgcttaattcagagtgtcaatcagtttcccatttatactaatttcgtgggctaatacatctgattagtggttgtgaggagtgcagaagtatggtaagcttaacctagaatttccttgttactgccagtaccaaagcgattttatacatagagcacaagtgactgcagtccattatctcaaattgcatgcttaagttcttataaattcattacagtgctaccccaaanttgtgnttcgcatctcagaaggatctcacttgttaacgtgctttgtcaacccacctggtgttacccattggttactccattgaggggagacagcgctagttatcattggactcaatcaacgtatggactgaacaagtatacggagataatttatacagggggtagtactgggtagggggtagggatgacatatttggacatcgtgtttcctgggatgaaatttaac

SEQ ID NO: 601390 - DNA, 328 bp, Homo sapiens
catctacgttgcacttggacgttatcgcgtgtgcggaaccattctctcctccaccgtatacctgattctccccacgttgactgactcctcgttgtcgttcaaatcttagcttgagatgatacttccccagaaggcttggtccccccgaacggggtaaggttctcctgatgtgtgtagcatactatagctcttttgtagcattcaacagatattggttcattctgtatttattgagtgactgctctgggctgggcactgggctagggctgagtatttcataaatgagagctgtggtccctggcgcccatggtacttaccagtctaagaa

SEQ ID NO: 601391 - DNA, 162 bp, Homo sapiens
atcttgcggcatgcggctgtatacctaccgcgatggcggggtatatggtgctgtatacctaccgcgaaggaggggtatatggctctgaactacctgccatgaaggacgggttatatggagctgaatacctaccatgaagagcggggtatactggtgctgtat

SEQ ID NO: 601392 - DNA, 172 bp, Homo sapiens
gcctgcgtgtgggcgtatgaactcctgggccaagcattccgctaggcctcagacactgcacccagacagatttagtcatatcttgccaattttcaacttcatcgcaactttctgcatgttgatgcccgaagaaaatttcactgccgaccatccattccttttctttattcgg

SEQ ID NO: 601393 - DNA, 290 bp, Homo sapiens
ctcctgggctcacgagcatcctcctccctctgcctcccaaggtcactgggattacaggcatgagccaatgtggctcagctccatgctatccacagtctaatatctgacagcttcttttctggtgggcttcttcagtcatttgagttatatttcacattcagtattaaaaatctcatgccatcagggttgaagcaggattcaaaatcaaataatcatcatgtcaccagtagtttcactcatcagtgccaaggcactcaagcaaggccccttctccagtcaggccagtctgg

SEQ ID NO: 601394 - DNA, 133 bp, Homo sapiens
tggggcagtagtttctgtgcgtctagacaaaaattccctgtaaatcaaagtggtgggacatcccataacacctacatcatttcccatccggtcatcggcccatcggtctacagatactttcattgaccaaaat

SEQ ID NO: 601395 - DNA, 338 bp, Homo sapiens
  misc_feature (71)..(71): n is a, c, g, or t
tgccaccgtacctaggtgttaccggacctcaagtgagtctaggtatgtccgggttcggcagtatcttctgngttaagttatttttttaaaattcttcttaaattttaatttaaaaaaatttctcatccaagcttaaaccaacagggaaaattgcaagggaatcatggtccgggtaaaatactaaacttacttaagtgaaaaggctcaaataaagataaagtttggtttgacaggcgtgagtcaccaggccgggccttaattttggtattttaagtagaaacccggtctctactaaaatacaaaaaatcagccaggcaggggggcatcgataaacaccg

SEQ ID NO: 601396 - DNA, 270 bp, Homo sapiens
cccagatcgttagcctctgatggtttacagctcgcatttcgtatgaaatcctccacgaacttgctcagttgtccataatacgtggtgtcctacagcctgcgcgtgattccagagccagtcctgtcctcagggacagtattgactttccatatcagtgcctggtacatgtcccccgcgtcacactccctgtcagtgagcactaggtctaaccgtaccccccaggcaaagtccctcacacacacatccagccttgatctaatgctcatggtg

SEQ ID NO: 601397 - DNA, 729 bp, Homo sapiens
agagccgtaagcacttggggtcgtggtattcccagtgtttgctgtgtcctagttgaccctttctaaacactgtcctttggaaagtttgaatatatccgcattctattgaagccttgaaacctaaaaattagagtcttatcgtcatctaagtgcttcatgctacatcttaatctcccaaaaagcagtatctaagtcacatacagtgatgtcttgggcatttgctgagccagtggagaacctcgtgaaacggaagaatcgcgtgctttgtctcaagcaagatcgggttctgggatgtctttaaggtctctcctgtgccttgctcctgatgctgggacccctttgatgatcagagggctctagaataatggatggtcttggatgcatggataaatagggacagggacgagttgaacttgggagcctttcttacaaccttgatgggattttttccccccaagtttccttctccaattgaatatgccacattaatgctggtgggatttcaatgaggtggccatgaccgagtgtagtggttcggtcgtcgtataatttgcgtaagcttccgcttgagaggactaaagtggtacatggatacgaactattttaccagggtcggggttctttgggcacacagtattaagttgcctggtaaatatgcttgtgaagggatcagttggagacgaataggggaaacaccttgtatggttggagccttccataagctaattg

SEQ ID NO: 601398 - DNA, 396 bp, Homo sapiens
agtgaattcagaatatttggtggaccatgtgtaaacagaagtgtgtcatctaggctttgctgttccatttacagagcataggcagggtagatttagcatggttgttagacgccctaagattttcagaatggtaaatgagcactggcttcaacttaagtcaccagtggcattagttcctaacaagagagtcagcctggcccaagctttggcactgatttctcctctgcagctgtaaaagtcagagatggtaacatcttctaatagatggttgtttcatccacattgaacctctgttgtttggtgtagccaccttcatcaatgtctcagctaagtcttctggacaccttgcggcagcttagcttctacacacagcattcggtgcttcaccttgcactt

SEQ ID NO: 601399 - DNA, 862 bp, Homo sapiens
  misc_feature (2)..(2): n is a, c, g, or t
  misc_feature (374)..(374): n is a, c, g, or t
  misc_feature (452)..(452): n is a, c, g, or t
  misc_feature (479)..(479): n is a, c, g, or t
  misc_feature (499)..(499): n is a, c, g, or t
  misc_feature (507)..(507): n is a, c, g, or t
  misc_feature (511)..(511): n is a, c, g, or t
  misc_feature (525)..(525): n is a, c, g, or t
  misc_feature (532)..(532): n is a, c, g, or t
  misc_feature (546)..(546): n is a, c, g, or t
  misc_feature (557)..(557): n is a, c, g, or t
  misc_feature (563)..(563): n is a, c, g, or t
  misc_feature (593)..(593): n is a, c, g, or t
  misc_feature (597)..(597): n is a, c, g, or t
  misc_feature (689)..(689): n is a, c, g, or t
  misc_feature (693)..(693): n is a, c, g, or t
  misc_feature (855)..(855): n is a, c, g, or t
tntatttatttattttttgagaagagttttgctctttcaccgaggctggagtgaagtggcgtgatctcggcttactgcaacctccatgccctcccccgcctgccgcttcccccgggttcaagccattctcctgcttcggcctcccgagtagctgggactataggcacctgccatcacacctgcctaatttctgtattttttgcagagacgaggtttcaccatgttggccaggctgttcttgaactcctgacctcaggtgacccactcgcctcggccacccaaagtgctgggattataggtgtgagccgccgtgcctggccttttttttttaaatgaagccttgctgtgtcgcccaggctggagtgcagcggtgnaacctccgacctcaggtgatgtgcccaccttggcctcccaaagtgctgggattacaggtgtgagccactccgcctggntgacattttccttttttttttttttgngagggggtttcattgttgtngttcaggngggngtgcaatggcacgntcttggntcaccacaacctcngtctcccgggntcaagnaatcctcctgcctgagcctcccaagtagcngggnttaaggcgatgcgccaccacacctggctaagtttgtatttttagtatttttgtatttttagtagagacagagtttctccatgttggtcaggntggnctcaaactcccgacctcaggtgatctgcccacctcggcctcccaaagtgctgggattacaggtgtgagccactgtgcccagctgagattttattaaaaggaaatttttttttctttttttataaacatgctgttgttattttctaacaggactgtcattccntttttat

SEQ ID NO: 601400 - DNA, 281 bp, Homo sapiens
  misc_feature (24)..(24): n is a, c, g, or t
  misc_feature (26)..(26): n is a, c, g, or t
  misc_feature (90)..(90): n is a, c, g, or t
  misc_feature (122)..(122): n is a, c, g, or t
  misc_feature (217)..(217): n is a, c, g, or t
cctatgcagggtgggccagtgagnanttgaaatatgggaggtctagccccttctcagggcagggctgtttctcaatctttggcccctagnctggagtgcatgattactggcatgattactgnagcctcaacctcccaggcttcaagcgatcctcccaacctaagccctccagaatagttggcactacaaggcaggaatcaccatgccaagctacctngtatatttttttgtagagatggggggtctcaactaatgttgcccaaggctgggttttcgaggtt

SEQ ID NO: 601401 - DNA, 94 bp, Homo sapiens
ggcaccatggcggcttaaatgtattctctggtaaatatactcctagtaatttaagattgtgtttttaaacggggaatacaagatggtatagtgc

SEQ ID NO: 601402 - DNA, 387 bp, Homo sapiens
  misc_feature (114)..(114): n is a, c, g, or t
ccccaaatttttttttaacaaaaaaaacaaaaccctttttttttttagaggggcccccctatgggccccccccccccaaagattttttacatggaacccgggctcagtgaaaantatttttcccccccaaaatttgtctttgggctgtctcaagggacaaaattattaaggaatcaagcgggttaaacagttcaaggctttttatgttgttaatgaccctccaaaaaacccgttaaaacatgaaatacaccagcaggttcccaatgcgaacaggtagttcgcatttatgtaaaccattcaaaaaataaagttttgaatttgttggaccattcaaaggacttgagagcatttttttgtaacttaaaaaaataaaaccccctgtcccta

SEQ ID NO: 601403 - DNA, 111 bp, Homo sapiens
acctaacatgatagaatcgagctctgtaccctatgagcctgatttttttttccaaatttttttcttttttcattctttttttttctggctattgaaacttctaaaactagg

SEQ ID NO: 601404 - DNA, 334 bp, Homo sapiens
ccccaactagcctgatcaaacgaggtaaagatgggaagtgcagccgtattttctcagcttttcaccatacaggagtttcacgctcttcccacttctctggtcactttttctgatagtcctttgtgtgacagctacaatgttttctatgatgtgctcgatttgcttgccaacgtgaccaatgacgttatgcactgccataaccacttttataaatgtttacagactgttccacctatacagtcattgatctctcttgatacattcttggacagaaggtttacagatactggaactttctttcttctgatagaaatgtctcccaatgagtgagggt

SEQ ID NO: 601405 - DNA, 376 bp, Homo sapiens
taccctcacactgggactcgtgtggcctgtgtggtgcacctgctggtggcctccctcgttttgaatggcttcctcagcacctgggacccaccagagaccagcttctagcagcggaggacggccgttcagctgtgacgaaggtcctgaagcacaggattaggactgaagcgatgatgtccccttccctacttccccttggggcatccactgtgctcaggtcacagacaaagatctgtgggtaggtctggcttgcggcgcgagagatcgtactctctggtcatagcccgaactcgtattggacaagtcccaaaggaggcttacaactcctgcatcacaagaaaaaggaagccactgccagctggggggatctgcagct

SEQ ID NO: 601406 - DNA, 277 bp, Homo sapiens
tgtacattcgtgtctttcgtacaggtacgaatttgaagtagatagaaaccgagctggattactccgtgtctgaactcagatcactgtacgactttatatcgttgcacaaacgaacctttaatagcggctgcaccatcgggatgtcctgatccatcatctaggtcgttaaccctattgttgatatggactctagaataggattgcagctgttatccctagggtaacttgtgccgttggatcggttattggatcaattgagtatatgctagttcgcttt

SEQ ID NO: 601407 - DNA, 210 bp, Homo sapiens
cggattgtcacgaacccgaggcgaaatgagtaccatgccggcgcagtggccggactctctgcggctgtgaggctggcgatggcgcctcccatggagtgtgccagaaggcagcaaggcagccccatgtagtctttctgcatggaatccacatgctgccacacatccctgacgaacacgtggacgtcagacactaccatcctctccccttcg

SEQ ID NO: 601408 - DNA, 670 bp, Homo sapiens
ggtgaagagaaaaaggcataggggggagggggaaaaaaaaggaaaaaaagggtaaagcggggtgaaaggaataaagaaagcaaaaaaaaaaaaaggggggtggaaataaaaaagagaaaagagggcaaaaaagaaggagagagatgggggggggagaagatcaaaagagaagagaatgagcgagaagagggaagcaaagaatgttaagaggaaaaaaaaaagggaagaagagagagaaagaggaaaaagcaatgaaagaagaaagaaggagttggagaaagaaacgagaagggagaaaggaaaatagaggggggggaaaggagaaagtgagaaagaggggaaaaaagaagaagaagaagaagagatggaggagaggggggaagaaaagaaaggaaggaggaagaaagaggagaagtaagagaagacatagaagaggaataagagaataaagaagaaaaaaggaagaaaagagaaagagaaaggatgagtgagtcaagagaaaaagagggaaggacaagagaggtaagagtaaaagaagagaaagaagagaagaaggggcggaaggagtagaaaaaacaaagaaaaggggggggaagagaagagatagaatgataaaaaggtctcagtatctctctctctctctctctctcacactctacactctctctac

SEQ ID NO: 601409 - DNA, 205 bp, Homo sapiens
  misc_feature (4)..(5): n is a, c, g, or t
  misc_feature (43)..(43): n is a, c, g, or t
gggnnacatgtcacacgctcacacaagccaggccgcagtgccntcggagagctagcaggttacattcaggcagtatggccctcttcccaccaaaacccagagaaccgcaaatatggcatcaccaggaaagacaggggaaagccaattcactgttgacccagggacagagaacctttggccccattgatgtcccaggccaccagca

SEQ ID NO: 601410 - DNA, 1679 bp, Homo sapiens
  misc_feature (1)..(1): n is a, c, g, or t
  misc_feature (1497)..(1497): n is a, c, g, or t
nctcgtccgagcaggctcgacgttgcgcggggggcactcgtgtggtgggctgccgtgctgggggggtagccgacagagtgggccgggccttagtgtgaggaggcagtgtcggtggtgttggtgcgaaccgctctggttgttgtgtctcggcggccgtcgctcgcagctagctcgtaggtcgtggtatctagcggtgtgtgtccgcgcgccggttgttgtggttcgagcgcgcacgagggtgtgttggctggccgcgcgcgagaggagaggcgtgggtcgcctgctgggaggagttgtggaagtgggggggccccccctgaaaaatgtgtttgaacacgcagtggccaccgaggaagtgttgcccgacgagacccacaacacactgaggggtggcccccgccttgaaagcccgctctggtcgatattccccccaatagtttgcacccccgtttgtgggggcccccccacaaaataatgtgggccccccgcctgggtcaaatatcattttgtcgctgggaggggaagaataatcccccttttctccgcccatggtgtgaccgcaaggccgtgtttttctgtgggttaacgccgacaggaagggtatgttcctccccccgcagacatagggccggcttgcgggcgttttggttggaagagaccgctcaagcccgcaacacaccacaaggaaattggggttgtaaaaaaaatgtggttggaggccgcccttgtgggccgccctttaggcggtatgaaaagaacacagatgggggcgtcgtgggcgtgcggccgcctgcgtgtgggggtgagccccccacttgtgggtggagaagacccgtgtggggttgtgtttccccccagaagagagattggtggcccaagatgtggccgtggggccgccacatgtgggggcgacgccacacgttcgcgtgtggagccgcccagagcgctcagagcactcccacgagtgttttgtggggaatttggggtgcccccccccactgggggctttatcaaagagagttgtgggcacgtgcacagactatgacgcacgcgcctcgtcccacactggtgtggggtgccccctgtgtgtggggagaacacctgtggccccacacaggtacacacagaagaaggcctgtgtgtggacacatgtcgtgagagcacacacacgccacacacagccacatttgtcttgagagcgaccctgggcggtctgcgcctggagccacacacaaggtgtgtgagaccgtgaagtgtaatggccacacagcggggccctgttggttcacctggtacaccgtgggtagaaggggaatgtgagaggaaagcgcgaagggtttcacagaaggccccgtgaaagaataatggcctgcccctttgaagaaaggagattaatagaaggagaggtgtggtggtggaattctgcttgaaaggaagaagggtgacaggaaagaaaggaagaaggaaatatctaaattaatccacttcctctttggnccctcgcacagcacatgtcacatgctcccacagaaatttcacagcttcacagcttaaactgaccacagaaccttataaactttctggttagaattgttttcaccttggtgactccagtcttttcccagtgtacccgtaaaaattttccctcatatctccaagtaaagtccattaaccatcca

SEQ ID NO: 601411 - DNA, 927 bp, Homo sapiens
gataagaaaataactaatacaataagctaatcgcacgacctatattccatatagctgatcagcatattcccaaagtacacaaccaggatgcattaaaatgccatatcgaatacgctgacaatgtatcataatgcaaagtacttttacatggtataagtactattgcagacactgtataatgaacaaaagatggcatttgcagtaactggagatttcatggccgcacttccacgcaatgtatctaacgggcgcttcatgagaatcagtagtgtgtatgtgtaggccaatggtgccgtggtctcagaccgtggatgtacggtatatactcccatgtccgatcataacttatgacttgagtgacgggtctggaaaacatacagatatagccgtagcaggatggtcctcttgctgtgtcccaattagttaactatgtcatcagtcaattgatggtgaatgacgagatatatgaagtctctataaagacatgcttatattccattgttacattcaaaagaaagatggctcggaaggtggagggtaacagaactctcatccaaatgtacaaatctcgcatttgataccattccacctgcagttatcacgtacactaccccaatcttacttgcaggagacacggaaaaccatctcgaagagaaaagtgcaacatgaatgaaagaaagtccatcaagtggtgacccggagtaccagcgatgacttcggcacttacactagcaatgacaagaaagcagaaaagacgcaaagagtacgtctacaagacacccaatccaacaactcaaacacagagaagaaaccaaacggaacaaaaggccaccgactcttagcagccagacatgtgaaaaaagttgacgaagaccctcagaagagaaggaaaagcgccacaaccacacaacacgaaagcagacaacg

SEQ ID NO: 601412 - DNA, 219 bp, Homo sapiens
ggagcacactgcaaacaactatagcaataacaatcacagcaatacccaaacatccaaactgtcaaggtattccttcctcaggtttaggatattctggataatttgagactggaggcttgtaagtacggcctaggacctgacggcactggacgcgtggagatatatgtagatgaacagaagtacgacacttataaggacacttatggacactgggtggat

SEQ ID NO: 601413 - DNA, 254 bp, Homo sapiens
gggctgtttacactccctgcggaaatcagcttcacaacagtcattttcagactgctccggattacacgatagtcggctacgaagttctctattatccaaagccagtgatctcacagcttgtagccaaacatggtgatcgttatacatcgagggctgagcagatgtgtctgtatagtccgggatggctgcgcacacctgccctccttggaacggatcttcagcaaggcaatgtcgttctgttgatgcaacgctgt

SEQ ID NO: 601414 - DNA, 724 bp, Homo sapiens
  misc_feature (64)..(64): n is a, c, g, or t
  misc_feature (99)..(99): n is a, c, g, or t
  misc_feature (102)..(102): n is a, c, g, or t
  misc_feature (104)..(104): n is a, c, g, or t
gacagagcccgggccacaggcagctccttgccagctctcctcctcgcacagccgctcgaaccgnctgctgagccccatggcccgcgccacgctctccgncgncnccagcaatccccggctcctgcgggtggcactgctgctcctgctcctgatggccgacagccgacgcgcaacaggagcatccccgagctctgtggtacccggttcagactcggccggcatgtgccccaccagtctaacagcaccagccatagcagcgctacccatatagcatcgatacagccttggaaacgctgttgctgtggactcaaggcggacactcacgatgaaatccagctgggccacattcacaacgtgacggagatttcagaggctcccatccgtgaacgctcccaggtactactcgataccctcatccatccagacagcaatcttcagatgaccgccagaaatggtctgttaatcaccgaggtcctgaagatcgccggtatagcgtagggacgatgttatatcgctgctccactctgagaccttcatgaaccacttcctggacaccgcataggccacgatcaagactatcgattactggaagatagggacgccaggtgaacctgtcgagttagaaatgagacctgccgtggccctgaattaagcccgggtgaatacaatctcctttaaagggaactcccaaggctcattgaagacacggacccggagacgggcc

SEQ ID NO: 601415 - DNA, 278 bp, Homo sapiens
  misc_feature (237)..(237): n is a, c, g, or t
gccatccccccgccccattgcggatatcgcaaccgtctagggccgcaagcctgaactcatagccaggaacagggtcacccacagactgggtgtgagtgtgaagatggtcctgatgggggggagatggacccgccaaatccagaggaggtgaaaacgcctgaagaaggtgaaaagcaatcacagtgttaaaagaagaacgttgaaatgatgcaggctgctcctatgttggaaatttgntcattaaaattctcccaataaagtttacagccttgtggggg

SEQ ID NO: 601416 - DNA, 711 bp, Homo sapiens
caatctgatatgtttgatcagaggttacagatcaagagttttaaaattgagttgatatatcctatggtggtgaaaatggattcaaccaagctagttgagttatctactgaagtcctctccaacgtgaactttcatctcaggagacagaagattattaggacgatcaccttgatgaaatccagccaggacacgggcaagctactgtcttggcgcgttcgaagatacactaaacggcttaggaagatgggagctgtatgaaattctaatagtctatgaaaatctggatatcatgagatatgttcttcattgccaaggcacagaagaggagaaaattctctatctaactccagagcaagaaacggataacactctcatttcacagactaagagaccggacatggaacatgagcttatctgagagcatgcccctgttggaagtggttcgctaagcaactataaaaacatttggatgctacgtttggaaactggtcacgagataacctcacaagaagggtctccagtttgtgaaccggactttgcgtcggaacttggaggtatgcttgcggtaccgagtagatttccagggaatgggaataccaaggaggaagacagatgaaatttttttgaccttgatgactactaggtagtcgaccatgggtcccggcaaaaacgtgctcaacctccaagattcaaaccaagggagcataccca

SEQ ID NO: 601417 - DNA, 653 bp, Homo sapiens
  misc_feature (31)..(31): n is a, c, g, or t
  misc_feature (296)..(296): n is a, c, g, or t
  misc_feature (312)..(312): n is a, c, g, or t
tcatcctatctcaccgcatagacaaccactncagacggcattatagacctaccccaggatgcatccttcccaggttctccatgctggaaagatcacgcaatatttctcctactgcacatccttcataggcttctgcagaaagaaaatatggctctatctgccgacccgcaggcatccgggtatactgatttcatatggtcaaacacacatgtttacaatccatttgtgcaatagtagtcctgaggtgaattccattctgagcttatgaagataacaggattaagagattaaagtanagataggcataagaanctataagagtgttaatggggaacgtgataaatgtccatgaaatcttcacaatttatgttcagagattgcagtaaagacaggcataagaaattataaaagtattaattttgggaagtgataaatatccatgaaatcttcacaatttatgttcttctgcctcagctctggccgatccctccattcagggtccctgacttcctgcaaaacaatcaatgccctcactttaacagtagatacttggcgaggctgtgcatggtgaggctgtgcatgcacctttcattgcaggtcagccactaacatgataagagcttatgtctatttttccacaatttcagttcttt

SEQ ID NO: 601418 - DNA, 323 bp, Homo sapiens
ccccttttcccgggggggggggggtttttttaaaagggggggcgggcgggttttccccctggaaaagggggcgggggggccccccaattttttttgggttgcccccccctttgggcccccccggttttccctttttgttttcgggttgttttttttgggggatttttagggggttccctttttcccccgggaacagttttttcccttttttcccccaggttgggttttaccccccccaaaggggaaaaaaaaggggggtcccccccgggggggggcccttttaaaaaaaggggtcccccccgggggggggaattgggccggga

SEQ ID NO: 601419 - DNA, 157 bp, Homo sapiens
aatatgctacaacgaataatgtcaaaatacttaggtttggaaaatccgaacctatgaccaatacataaagagaagggtaataacccctcttctgttcctctgtcccggggctaatattggactaatgcgggtctgccattctaatgtccatccattt

SEQ ID NO: 601420 - DNA, 122 bp, Homo sapiens
caggaggaatggcagcagctcctgagagtcatgctgctggtagcccaagaaattgagatgcaaaatggccaaccttgttctaagaagatgggcaggatcatcagagagagagggagtaagga

SEQ ID NO: 601421 - DNA, 113 bp, Homo sapiens
tagaggatccccacactgggtcgagtctgcttaagtgcattacattgaaatgaatctcattctcactataatatttttctctttaactttaatcaccagcggctggtcaactg

SEQ ID NO: 601422 - DNA, 80 bp, Homo sapiens
gggaaggtgttccagggctgcgtgattccgggagtgtgctttctctttcaggtgtggggaaagaaagaaaaaaactgcct

SEQ ID NO: 601423 - DNA, 258 bp, Homo sapiens
actcatatcatggcagagcactaccatcggggggttctagaacaagagtcagtgataaattcgatgcagtgtgtgaccatgtgagttattctatcttcatatgtaactgatagttgggctgcatagtttgtactgagtatgctattcttcatactgttgaagctggccgtcgtacaacactcatattgaaaaattggtatttcaacttaaagttactttaaattcgtatatcaaatgaaagtatctgatgtctaatag

SEQ ID NO: 601424 - DNA, 112 bp, Homo sapiens
atgtacacaataataatacgctcactgtatttcaatgtcaaaagtgagatacctaaagtccctacagacaaaactagagctatgccagtccaattttaaactaatttccatc

SEQ ID NO: 601425 - DNA, 109 bp, Homo sapiens
taagtgtgaaaccgtagcttgagattacggcgacagcgattactaggatagtcagtagaattagaattgtgacgatgatacagtgtagagggacggttaataggttgat

SEQ ID NO: 601426 - DNA, 311 bp, Homo sapiens
ttactgtgggctgtgggattaatttcaacgagaacgctatccataaggagggctgtgtggagaagattgggggctggctggggaaaaatgtgctggtggtagctgcagcagcccttgggattgcttttgtcgaggttttgggaattgtctttgcctgctgcctcgtgaagagtagcagaagtggctacgaggtgatgtaggggtctggtcgcgtcagcgtcctcatctgggggagtgggggagtatcctccggggtgttcgggtaaacggattgttgtgtcagggcgaaaagagaggcgcggacggggtct

SEQ ID NO: 601427 - DNA, 895 bp, Homo sapiens
  misc_feature (563)..(563): n is a, c, g, or t
atttaaacaaaatccgcccacatccgtgcctcccctgtaatcgccctttaagtgtaaccctggcccagaacatttaatgtcgagaaaaatatggtccaaccacctcataatattcttcaccccccccgtttatcccccacccaccacgggggcaccactgaaattgggcccctttagtcgcccttatcgctcctgtttaatttgccacatttcaaatggtaggaaagcttaagaacgtgttatttacaaacccccccttaggcgtggtcgaataaccacccgctggatcaaaatgccccctcatttctgggggtcagagaaacttaggttttcaaatattccaggggccgccaaaccttgatacagcgaaccacgttggtggaaggtacccccctctcctcctcttgttttttgactccagggtccgcgcaccatgtcctcttggaagaccctgggccctcgctttacttcaaggaaatgcacgcccagacccacagtcttagtaggaatggacctacaagtaattgtgaggggcatcaattagtagtgaggcaacccccgangaccagttcccgaagaattttttggggcgcttcggatagaaacttgttcttgggagagactattcaccgcatctttttcgtgcttgtccctccctttacattgccccccacagcagcaccttgtggcaatgctcccaccaccaaagacatgagacgtcccgaaagccacgcactagtattgacccccgcgggccctcggagacacttgcgtcttttaattattgcaaatcgggtaagcacgttgttctgcaaaaataaatactctgttaataaaaaaacagtatttagatgttcaaatactatttttcaaaaaaatctccttcttcataaca

SEQ ID NO: 601428 - DNA, 148 bp, Homo sapiens
gtttccagcatttttagtgatgtgtggccctcaccactctaaatccagctttattgcaatctgcaagtgatcttgcatcctcctcttctggcactaccacaataacacacccctaccaacgtccccccagcacgctagctactatcac

SEQ ID NO: 601429 - DNA, 436 bp, Homo sapiens
  misc_feature (112)..(112): n is a, c, g, or t
  misc_feature (436)..(436): n is a, c, g, or t
aaaccaccgccgcccacagaatgctggaccgtgatacttgtagctgccagtgagtgcatgagggtcagactgcaagcaccgggagctggctattcactcaacgtcgggaggncaccacaggcagttgcccacccagccgtgggctctcagtggctctccgggcctccgccaagacagtagctgcagggctgactgtcagcagaccccggaggccagggctgggaggcctctcatggccccctttcctgctcagccgaggactctcggagcgagcaccacttgggcgggactgtgggggctgtagggccagatggtagctggaggaacggtcaggtaccagcgtgggcacagaaggtcctggctcttgcccactgtgtgagtgactggcacagcttccacttgctgctgttgaagagagtggagagaaggcttgaan

SEQ ID NO: 601430 - DNA, 110 bp, Homo sapiens
cattccattcgattccactgcattccattgcactcctttccattccactccacaccatttaattccacttcactccatccatcctcattccaacacattccacatcatta

SEQ ID NO: 601431 - DNA, 102 bp, Homo sapiens
tctgcttcttccgtaggtcataacatgcattaatattcaaatcgcttatcaaatagaggctgatagagaacagcatacttcctttcaagaagcaggaactgg

SEQ ID NO: 601432 - DNA, 637 bp, Homo sapiens
  misc_feature (16)..(16): n is a, c, g, or t
  misc_feature (118)..(118): n is a, c, g, or t
  misc_feature (465)..(465): n is a, c, g, or t
  misc_feature (537)..(537): n is a, c, g, or t
  misc_feature (550)..(550): n is a, c, g, or t
  misc_feature (556)..(556): n is a, c, g, or t
  misc_feature (573)..(573): n is a, c, g, or t
  misc_feature (633)..(633): n is a, c, g, or t
gtggttttcgcctganagaccacagggccaatcaccacagcttcttgtagagaacatggagagtgctaagatcaccatcaggtgccgcttccttcctgtggctttccatcttccagtnagcctggtcttttgccttgaagggccccaaaacaacagccctggctatcatcttcatcccaaaagcggagaagatgggcaggcaagaacacggagggtgttacagagaggttcccatcaggttcaaagggcgcacgctgtacctcttggagatgttagcttcaatcagcttctgcagctccttggtcttctccagtagcaggtccagcttaggctccagagccgccctgctcctcaagtgccttctgcctgcttctgccacccatcagcctcctttcttcaaagcccagccagcctggcgcactgccttccagccttttgcctgcgcaggcaattccagtccactcngctcccacatacccttgcgtgcaggcccaggcatccataaaaccaggctgcttgccagcctgcaagcactgnctaagccttgccncaattnagcatccctcccagccnctgcacacccatggctaacccatccttcctccttatggctctggcccctgccaggcatgncctg

SEQ ID NO: 601433 - DNA, 366 bp, Homo sapiens
gtaaatatctgttcaaattcttggaattctctcccagctcacttcatgtagcctttcatcagggacttagatcttaatgctttcgccacctccttagtagtctgctagaaggcttccgtggcagcttattttcactgccaacagcaggattgcatcaaaagggcagtagaccataatatttaggaattcaggctctagtttggagtcagagaccggggttcacatgtcactccagctccttgggcaaattatttaacttctctaagcttcagtttccttatctgctgagtggaggtatagtattcaccctaaagttggctgtgaatattaaatgatattatgaatataaatgcattatatattgcc

SEQ ID NO: 601434 - DNA, 1288 bp, Homo sapiens
gttttcctgcgcagtgagccgcagcggccgtaggcagccatggcgcccagccggaatggcatggtcttgaaggccccacttccacaaggactggcagcggcgcgtggccacagtggttcaactcagtcgcggcgcctgtaagatcctgcagactgtaagtgcccggcaagccaaggcggcggctcggcatcgctcacctgaaccgccgcctgccggtcggaggtccccagtccagggcccaatctggtgctgcatgcaccctacggctatcggggtaacctacgacgacaagggtgctgctgccgtgtcgcggcgtgcttcacgccctaggacgagagctcatggggtgggctcgggcatttcaacaaaggaattggtggcgccggggagcccattcgggcatattctatgttgggactccgatgagacgagctggaaacaacgtccagccggtgaagtcacctgcataggcgcgaacgggttgcagtgcgggtgctggaaggtgaagtagccagcttcgcgaacaacctcaattcccgtcctttccacccaatggaaacgccgcttcgggggcccctcgccgaatgacagggggagtgaacacagttttccgtgcgtttgaacacggaaacgttgaagacgatctttggtggccgagcgcgacaattgtccttgaacgccgggaactccgggggatccaattggctctctgttgcccctggggaaaaacctggctgcttaattaacaagaacacgtgtgagggaaacagacttccgcgaagcgtccagtccaaccttggaaggggcacagcacggaaatgtcacgacttggtatccacaacaatgcgccgccgattatccagaccgataatgagattcttttcgcccggattaaattggtggccctcccccgtgattgaccccctataatacccggcactcacctgtgggccacgtcatactaccgggaggccataattaaacacagcggtgccccaatatcaaaagatacgtaatagacccccaacatgggtgtgacaaacgggcccctggcccgatggcgaaaagccaaggtggggacagttgggctcctggcaaaaaacagcaagtgcaacacccaagtgcaacagatttcgaccgataggccacccacgttcccaccttgagggagggcgcaaaccttggtgtgcggcacacaacttccgagagattgccgcgggacgcacagacttaacacgacccagaacccaggacgagaccgaagatgacgagacgagcgaacgtgcag

SEQ ID NO: 601435 - DNA, 177 bp, Homo sapiens
gccggacctggtcgtatttcactcgccataatggcactgggggtgagtccagctattgggagaaatttgaacgatgagaacttcatcctaaagcatacggggtcctggcaatctatgtacactggcaaatgctggatccaacacaaatagttcccatgtttttcatctagcactggc

SEQ ID NO: 601436 - DNA, 863 bp, Homo sapiens
gctgaccagcacctatggcggtaggcaagaacaagcgccttacgtcaaggcggtgattaagggagtccatagaagaagagtggttgatccattttctaagaaagatcggtatgatgtgaaagcacctgctatgtccaagtatcagaaatatcggaaagacgctcgtcaccaggacccaaggaaccaaaatggcatctgatggtctccacgggtcgtgtgtctgaatgtgagtcttgcgtgatgttgcgagaaatgcactgaatgttcgcaattatagaagaagttcaaagctgattactgagacgatgttcaggggtaaaaaactgccgtgacgtaacttccatggctatggatcttacccgtgacaaaatgtgttccatggtcaaaaacactggcagacaatgatggaacgctcacgtcgatgtcaagacctaccgatggttacttgccttcgtctgtcctcgagtaggttcttactaacaagaacgcaacaatcagataccggaagacctcttatgctcagcaccaacaggtccgccaaatccggaagacgatgactgccacatcatgacccgagaggtgcagacaaatgacttgacacacgaagtggtcactaaactcgattccagacagcatcgcgaaaagacactagaccaggcttgccaatctatatatccctctccatgatgtcttcgctcagcaaccacgtcacaatgctgaagaaagcccaagtcgactcgggaaagctcatggcagccttcatggtgaacggccagtagttctgcaaaagccactggggacgaagacaggtgccacagttgaacgacctgatcgcctctgcacaccaccagttccaggaatcg

SEQ ID NO: 601437 - DNA, 188 bp, Homo sapiens
cccccccccccccccccccccaaatgggggggaccccctcacggcacaggtttttccaaaggttttaggggccctttttttttttaaagccctggcccctttaaaggttttttttttggttttattttttggttttggccgtttattggggaagggaaagccaaaaaaggcccttttttaatggggga

SEQ ID NO: 601438 - DNA, 176 bp, Homo sapiens
caagattcttgtgctgaagcagtctatatactgtttgttatgttggcataaaggatacatagaaacattgcagcatctaggcagataaagtgtcaaaaggagaacttaacttatggtatttcatcattgaaagtagtgggaggggtagggaataggaaaacactagaatggtactg

SEQ ID NO: 601439 - DNA, 183 bp, Homo sapiens
  misc_feature (142)..(142): n is a, c, g, or t
acagcatttgccctgaggagcaggacagcgggcagctgaactctaggaaagaattcccttctaccactttcagagcctcacccaccagtgcgcgtaaaacgccagggccatcttcttacttaagccacatcctgaaccaggnagcttctctgcagagttactgagctaagacattgcttcacg

SEQ ID NO: 601440 - DNA, 525 bp, Homo sapiens
tggcccggctataacttctgccaactttaacccatttttttacccgaaaaaatacccgggggccattcacatagtcttggcacatcccgacacatgactgtattcccaaccccgtggacctgccaggctgtttcccgcctctacgttaacttattccgggaattttatccccatggggtttgcaaagggggaccctttgtgcctggttcatccgaattgtagcatttgtaaggccttcatttgtttttacggctgaataaaattgctttgtatgggtagactccccccccactttttttttttttttttttttttttttgtagagacagggtctcaccatctagcccaggttggtcttgaactcctggcctcaaatgatcctctcatcttggcctcccaaagtattgtgatttcaggcatgagcctgaatctgaaaaagcaaaattcatttagtaagacaaagacacccaaacatgtcagtaaattaaatggactaaactcaccagcttaaaaccttacgtaata

SEQ ID NO: 601441 - DNA, 105 bp, Homo sapiens
tctcgacttccgttgtaacgttgactggagcaaagagtgaccaccataccgggtgtgtgagaacaccagtctctcactcggccaacaggaacagtaccaatacca

SEQ ID NO: 601442 - DNA, 190 bp, Homo sapiens
cgtggttgcatccatctgtaatcagtctcaacagcgtatacctttctgctagttatcctcccgtgttccacgagccttatccatcagatcctcctcgaaagttacttcctggtcctggtccgaaatttccaccgcaaccgagtgggaggccacaaccaagtgggagtccgcaaacaagtggtgaggccag

SEQ ID NO: 601443 - DNA, 630 bp, Homo sapiens
  misc_feature (154)..(154): n is a, c, g, or t
  misc_feature (414)..(414): n is a, c, g, or t
cccactgtgcacatgggggccacgtcccgctgtggagagtaacaaccgtgaaagagcacacacacgagggggggtcgtgccgtccggagcgctgtcacttgcaactggtgcgactcccaaccgtcgcactactcccaccactgtttggaacgangctgcggcgactgtgcgccaacatgcacacagtccagtcgtgcccaacacgtggagtcaaagtcatctagtgtgttaccgtggttggttgagcaaaaacgtggagtgttgcgtagacagtccactcaactcgacctaggtgcgtccattcagatgagcaaccagcctgtgtgctcgctctcataagaacgtctatgacactcacgtggacccacctaagtacacaccctgccacacgaaaggcacccagtggttatagtnaaagcaggatcgccgtctcgtctgacagtggaggaaggtctccgtggcacgactccgtcttagtctccccaccgccccacgtgaagttgtctcccgtccgtccccgtctggcaatgttgaacactcccttaagaagagaggtaggggtccctcgaggaaaccgaccaccgtgtcgtctacgggacacagtccagattaggtaccccggtggctcca

SEQ ID NO: 601444 - DNA, 81 bp, Homo sapiens
cccgaagacacggctatttattactgtgcaagatcggaccccccgacccatccccatgcttttgatgtctggggccaaggg

SEQ ID NO: 601445 - DNA, 394 bp, Homo sapiens
tgcagtgtaactctggatctgtctgttagacttcctacatgatgtacccatagacctcttgtcaacaatggccttattggatagacgagggatcgagcaggaaccattgtagtggtgaaaaactctctggtctttctcggggattattctgctgaagctttggctaagttactcaaaagactcccatgataagcacgttaccattcttgggccctacagaaagtcaacaagcaaaatgccttgagcattcaaaagctgttgccatgacctttgctctcaaccagtcctcttgtgctttaactgaactacttatcttggaaaccactgcttggtgtatggtcttcaggattgcgctggtaaagccatgtttcatctcctgatttccaccttgcca

SEQ ID NO: 601446 - DNA, 170 bp, Homo sapiens
  misc_feature (18)..(18): n is a, c, g, or t
  misc_feature (97)..(97): n is a, c, g, or t
ggggctgggtgcggctcntctttgcctgacgggttagtgctctcgctatacgcgctgcacgtgaaggcggcccgccccgggaccggattaccgcgcntctgcacgtgggcaccgcatcagctgttcgcgcgtcttctcctccaggtggggcaggggtttcgggctggtgg

SEQ ID NO: 601447 - DNA, 143 bp, Homo sapiens
tgcctcgcattaacctgtcacccatacatgatattaataggattcacattatacgtgactaagaaaatcaagttaactcacttgccatttctccggacaacagcaaaccgcgaccctcctatagactaatgcaatggatgaat

SEQ ID NO: 601448 - DNA, 647 bp, Homo sapiens
gccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaataaaaaacaaaccaaatcgaaacatcgccgtgctatagttcctatctctgagcttatcattccttcagcactctgcatctttctcggctgtgcctaatcaatttaccaactcagttctacaccctttgtctcctcttcacactactcttatttttgccaaacctgtacttggccggctcatccctactcagcccacacgtcctaacattctccgcttcctttaaccgtcctcacatcttaactctctgacgcccttctgctccacctctccttctttcactcaacttcaccgcactattttttctcatctcatctccagtaccccctcaaacattcctactcgttccactctccttttggctctcttatctccctttaacagagatctcggttcctacctctctatctcccc

SEQ ID NO: 601449 - DNA, 446 bp, Homo sapiens
caggaaagagctagtgacttgtggtttcatagtcgtgaagtacttgatcactttgcatgactaatggcacaggataaacctattcgtaagtttacaatacaagtatagaggggtcttcagcgtaacttagtgatacataaatgctgaaaagattatcttgagctgggccttgggagaagaatttggccttcagaactgccatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatactt

SEQ ID NO: 601450 - DNA, 170 bp, Homo sapiens
gaaacggggggaaagtaaccccggggttgttttgggatttgggggcccccccctttgggggggcttttttgcaaatttgtttgggggcccccttcccaggtgggccaactgaagctttgggggttcccaagaaggttttttttttggctggaattaaaccttggccccca

SEQ ID NO: 601451 - DNA, 408 bp, Homo sapiens
taagggctacctataggattatggatttggatggtgctgtagcctctttgctttggccaatttctcccatttggaatgggtatatatactcaatgcctctatcccactgtatctaggaagtaactaacttgcttttgattttaccaggctgataggtggaagggactttccttgtctcaaatgagactttggacttggactttttggttaatgatggaatgagctcagactctgggggactcctggaaaggcatgattgtgttttgaaatgtgaggacatgagatttgggaggggccagggcagaatgatacggtttggctgtgtacccacccaaatctcaccttgaattgtggttcccataatccttacttgtcataggagggacccagtaggaggtaactgaatca

SEQ ID NO: 601452 - DNA, 268 bp, Homo sapiens
tgagagcttgtttggaggttctagcaggggagcgcagctactcgtatacccttgaccgaagaccggtcctcctctatcggggatggtcgtcctcttcgaccgagcgcgcagcttcgggagggacgcacatggagcggtgagggaggaaggggacacccgcctagccagccagatcagccgaatcaaccctggcgatcaatggggtgacagatgtcgcagccagatcgcccgtcgacgcggccgcgaatttatagtagtagtagtaggc

SEQ ID NO: 601453 - DNA, 325 bp, Homo sapiens
attatattattagcaggaaaaaataggtatgattataaaatttggcagatcactgtgtcatgtccaagaaatgttatgctaaacaattatactaaacaatgtatactatgttatactaaacattatactaaatttcacaattgcttcaaagagaataaaatacctaggaatccaacttacaagggatgtgaaggacctcttcgaggagaactacaaaccactgctcaaggaaataaaataggatacaaacaaatggaagaacattccatgctcatgtgtaggaagaatcaatatcgtgaagatggccatactgcccaaggtaatt

SEQ ID NO: 601454 - DNA, 480 bp, Homo sapiens
  misc_feature (24)..(24): n is a, c, g, or t
  misc_feature (81)..(81): n is a, c, g, or t
  misc_feature (103)..(103): n is a, c, g, or t
  misc_feature (438)..(438): n is a, c, g, or t
tcaaagcacagcagaaatccatgnccccctctcccatgaaattggaaccttggtacaggttaaagtatccccctaatcctnaaatctgaaacaacttgtggtncccaagcattttggataaggcaaaattcaactttcagtctcttttctgggggaaaaaaataataaaccctagcctagcccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcaggacgttgcaagtgagccgagcattgtccattgcactccancctgggcgacaagagcaaaactcttcaaaaaacaaaaaaaaa

SEQ ID NO: 601455 - DNA, 204 bp, Homo sapiens
attaagatccttactgtggtgacgtgtacgaatcgactagacataggtggggttcggttctgcctttcagtggttacgatcgggttgctgactgtggtgtaggttgcagagggtcggatccgcgttgtgtggtctggtgtagccggtggtacagctccgatttgaaccctagcctgggaacctcacggtaatacccacagtacg

SEQ ID NO: 601456 - DNA, 131 bp, Homo sapiens
cttttcttgttacatttatataatttaaaaaagcagagacgacgtctcacgatgttgcccagagtggtctacgaactcctagagctcaagttgatcctatccgtcttcggctgcccaaagtgctggggact

SEQ ID NO: 601457 - DNA, 593 bp, Homo sapiens
aataagctgctacctggactgtgatctgtagtcatctagctcaagggaaagctaagaaacaaaacaatccgtgtcttttaaaaaggttggggaaaagcaggtatagacggggccacagagcacccttaaatgttgaactataatgacacctaagtcatccctgtatttggcaagtttccatgaaagggtggttcaaaatgactcttaattatgtttttgggttttttctagaaggccatctcagaagttttttttttttttttttttagttggagagcagccggtccaacatgtggtgaaacctcatctctactaaaaacacacaaaaaattaaccaggctgtggaggtgcacacctgcaatcccagctactgtgggaggctgaaccaggagaatcgcttgaacccgggaggaggaggctgcagtgagccagggtggtgccacggcattccagacggggcgacagggaaaaattccctctccaaataaaaaagctctaagtaatcaaataaccaagttattaattacccaaagtcagtcagcaaatgagtcagaattcaagccacaatagctattattcacactagtcactcc

SEQ ID NO: 601458 - DNA, 299 bp, Homo sapiens
  misc_feature (215)..(215): n is a, c, g, or t
ctcgggtgctggcccggctcctgattcccccggcgccgtctgtgcctctgctgtggtcctcatttttcgcccagcgctaggcagtgctccttaagcgctaggttctctcgtagcatctcctctgtgcggccctccagctcgtccagcttttgccaacagccgcccaggttctcgtgcacggcccgggatgcttgggtcccgaagagcttctatcntcgtctgcgccgcttgcgggcgctccgagtccaggatagcagcagaggtccgcatttcacggttctctgcttgcagacgcctgt

SEQ ID NO: 601459 - DNA, 271 bp, Homo sapiens
tccactagtgtaggctgacttgttcctgatttccatggtaagacaccccctccccatctccctaaagagccaagagcctgctatgagctctgctccaccacttctggttcctctgctgatggtggccagtaagtacctctatgatgaaggggaggaggaggatgtcttcaacgacgaatggggagctgctgggggtgtggccgtgcccactctcaatgccttggagaggggcttcctgagtgccatggattggcatctctacactgaccct

SEQ ID NO: 601460 - DNA, 162 bp, Homo sapiens
ggtgcggtcgtgctgggctgaattccctgctgacccaatgttgaaccggagggttgggccgtgcttccaccaggtgaatgagaagcctccacagtgtggtagctggagccacagagagtcgtggtagagggccaacacacaacagccgtgctgcggatgctg

SEQ ID NO: 601461 - DNA, 366 bp, Homo sapiens
  misc_feature (36)..(36): n is a, c, g, or t
  misc_feature (38)..(38): n is a, c, g, or t
  misc_feature (101)..(101): n is a, c, g, or t
  misc_feature (213)..(213): n is a, c, g, or t
  misc_feature (230)..(230): n is a, c, g, or t
  misc_feature (239)..(240): n is a, c, g, or t
  misc_feature (250)..(250): n is a, c, g, or t
gcctagagagctaagacacaaagacctccacatctntngctgagagtcaagaacctgaacagagtttccatgaaggttgtccaagcactagaagggagagngtctaaacaatggttgaaaagcaaaggaaatataaaacagacacctctttccatttcctaaggtttctctctttattaagggtggacttagtaataaaatattaatattctngcttgcttatgcagctngacattgtnngccctccctnaaaggcaaccaagtagcctttattttcccacagtggaaaggaaaacggctggcctattcagtttacatttacaaaaggcagattttcaagagggattgagtaagtaagttggatgg

SEQ ID NO: 601462 - DNA, 961 bp, Homo sapiens
gaatcataaattaggatgcaggctgggtatggtggctcatgcctgtaatcccagcactttgggaggaggccgagctgggcggatcgcttgaggagagttcgtgatcagcctggccaacgtggagaaaccctgtccctactaaaaatacaaaaattaggtggacatggtggcgagcacctgtaatcccagcttctcgggaggctgaggcaggagaatcacttgaaccagggaggcagaggttgcagtgagcccagattgtgccactgcactctagcctcggtgacagagtaagattccatctcaaagaaaaaaaaaaaaaggtgaaaatggccatgggctggggttatggacaatacgagtggaaacgtctggtcggtcttagatatacaattccatagtggacgaatgttagaacaactctgggagactgggccttggacacttgggactctggcctaggctggtgtcagaacaacctacttacctccaaggccttataatttcccaattgggcagtgggagctaacctcattcacaaaatccaggagtccactggggtcctggaacttctaaggggaaacgggtctcccctgggacgcaggagcttcaagagttggatcgagagggcaaaaggcaaggtagagtcgattgggccagtgggcagggggtccccctgagggacaactgggcatgagtttgtgccggggaagcgaacttttaacccatttggtcgatcacgaaggtgacaataagcaggacaaacacagtgtgggaactcccacttgtggggtcaaggtaggttcgccacccacaagtgtaatatatggacaggcggtacgcacctaatggttataatacgggtggctattgagcagcattagatgtgtatgagggcaaaacccccctgtgtgccccaggggatgcgctaacaacagggggagatactaccagtggccccgtg

SEQ ID NO: 601463 - DNA, 336 bp, Homo sapiens
tcgtgcctataactagcatagagcatttgataaagagatggactaggttcagagttccaatagaactaagctctcgaatttctgtgtcacagtacagttcctaactaactgaaatagtaccgtgataagaaactaaagctatttgacacaacaggtaagtcgatggccatgctggagatagacggtgtgatggctgcacagcaatgtgaatgtgcttaatgccacagacttgtacacttaaaaatgattaaaatggtaaattttatgttatgaatgttccaccacaataaaaaaaatagtggatagcctgaatattaatttctgtgcccatttcaa

SEQ ID NO: 601464 - DNA, 165 bp, Homo sapiens
ggaaaggaaaagactcatatcaaacatagtcgtacagtggagcgacgatagcattcggtgcagagtcgcatcactacgtggtgcatctgatctataaatgcggtggcatcgacaaataggaaccatggaagaatttggcaaggaggctggctgagatgggacaca

SEQ ID NO: 601465 - DNA, 417 bp, Homo sapiens
tttttggacagcgtcttctcatctagatccgcaaaagagtttcattgtctcactacgctataaggctcggagattgcgccttcaacgcttacgcaccgattttcggctcctcgataaggaaagcacgcttgatcttgtcacgaacacattaagctcacatgtatccacacataggccgtgcagacatgtttctttgtttcgcacaatctcataagacctataggtctcacagcacgagcccgtggaagtgtgcgtgggcacacaccacacgcagattttggtgcttcaccacctttcttggaataaaggtacacatttctaagctcagtggttcgggcacaccatagttatgttagactctgtattgtagtacagcctacgtcggtatgacagcccttgccccattgtgagcgcctg

SEQ ID NO: 601466 - DNA, 132 bp, Homo sapiens
atatgatttattcttcacggattatgctcccaaatatcctctcatgcatccatggaaatttaacgatcctggaatagcgtctaccatgtggaacatcttaaaagatagtctttagcctatcagtgagttaca

SEQ ID NO: 601467 - DNA, 580 bp, Homo sapiens
agtaaccctggttatccgagaatccctgctcgtgacgtaataaaagggtctttagagcaccctaaaataggtggtctaggtgtgctacctaccgatgtaaccgtatggaacgtattaggtgctttgtcctcggtagtgcatgcgttattaaaatgacggagcttttatctgaattattgaataactgtacaactttggatttaaaaccatttccaacataagaggtgaaagttatttctgtcctcaattttagtcttcttcaagggggccatataacctaggttgagtttgtgactttgccttgagaaatgaggtaacacagcatggaacagtctatcttttccagaccttgaatgaggaaggcaaatgatctagacatttcttagaactagacgaaaaatagtcatagcgatgactaggagtagttttatctgtagttaggcgaatgcggcttctttacattattggtgcgatgaaagtatgggaaagtctcaacagaacagactggacatttgagagacttccatttttcaaaaatttcagaatcctcgcggcaggtgtttgaaacaagggatgtgga

SEQ ID NO: 601468 - DNA, 102 bp, Homo sapiens
tgtgacagctccgaggctgggggccagatcccccagcaaggactaccacttcacaggagctcacatttatggaatggatgaatcaataaattaattcacttt

SEQ ID NO: 601469 - DNA, 277 bp, Homo sapiens
gaccgagacaacaacggctaggtacgaggctgggtgtcgccttaagctcaggagttcgagacagaaagccaatggtcctcccttctcaagaaaacaagagttggccaggtgcaatggctgacatctgtaattccagtatttgggaggccaaggtgagaggatcacttaagctcaggagttcgagaccagccaggtcaacatagcaagactccatctttacaaagaaaaaaaaagaggctgggcgcgggtaactgtatgcgactggaccgaggcggac

SEQ ID NO: 601470 - DNA, 634 bp, Homo sapiens
  misc_feature (291)..(291): n is a, c, g, or t
cacgaacctgcgggtaatggtgtccatgatgagttagcattacctgactataccttacttcctctacgaggagctgagctgcacaggggtggagctgaagtacacaggcacagccagagcactattcatgctccctgatcatagacaagatggaggatgtggaagccatgctgctaccagagaccctgaatcggtggagagactctatcaagctaacagagataagtgagctctacctaccaaagatttccatatcgagggacatatacacgaacgacatactgttgcaangtgggcatggctgaagtctccagcagtaacgctgacctgtcaggaatcacatgcagacacgaacctagcatgatacatgatgctcataaggctgcgctagatgcatcagaagactggacatgagcatctgctgtcacagatgtgaatatcagtctgctgtctgcattagctgagacacggaccactgcgcgtttgcacatggcctaactgatgaacattgtccctacagtcatcaataacaatgtagttatcatggaatatgaacctgggcgatgatgacttggtacatgggacatcactgcacatattaccgagtgccatggcattcatcccctttttgttt

SEQ ID NO: 601471 - DNA, 292 bp, Homo sapiens
ggctcatctttgcatgcaagcagctggaagatgggctcactctttcttgactacgacatccagaaagagtcgagcctgcacctggtcctgcgcctgaggggtggctgttgattcttcagtcatggcattcggagtgcccagtgatggcgattactctgcactatagaccatgtgctcccaacttatagtttagaagattgatcatgttctcagtaatgagctgataccgtgtatcaagacactgtttaagtaacaggtttcggttgcatgggcttcaggaaaaaacatataa

SEQ ID NO: 601472 - DNA, 275 bp, Homo sapiens
cttttttttaaccagccccccccataattccgaaggccccgtttcatctttcctgggtccccccagtgaagtattaccgttggcccgttccccgtctggcccgggcttgctcggataaacctttggatggattttgtagggcctagattctatattggaatgaggtcctatcccaaaagaaaaattaacgaaatgggaaattttattgttttaacggggaggcctgtttagggccgtttcccttttgaaataaaatttatgattcctttttttta

SEQ ID NO: 601473 - DNA, 125 bp, Homo sapiens
ttctacgctggcctgacgtttggtggttccaggacggcggaatcaagaataaatcgcctgcaacaccacaggccacgcctgatggtttcattgccacggctgctgataaagaggaacgattaata

SEQ ID NO: 601474 - DNA, 230 bp, Homo sapiens
  misc_feature (43)..(43): n is a, c, g, or t
tcggacccgcggttatgtcttacgagttgggaacagatgaaanctgtcacctcacgaatacgaggggttctcagtgaagataatctcacaatgcaagtaaaaagtaaatctgatgaccccagtgagacactaaaattttaaaaaggcaatgaaaaaaaaggagagcagcggagaggaacataatagctatgaaaaagtttttctaagtaacccgtaagacataaccgcgg

SEQ ID NO: 601475 - DNA, 389 bp, Homo sapiens
attttgacaatttcaatcctgtatatagtatgctaggatcatgctttcttttcccctccctcctcctgctccacttttcacacaaacatcaacaatagagttttccaaataagttttcttaatagacttatctgtctcgtttacttgagtcaaagtctttctttgttgtccaggctgcctcggcttctccagtaactaggactgcaggcattcactgcctggctctgggctttattttggggactgttgactgaagagtgaggaaatggacgcccctcccctccctcagatccacttattatcattagctgaagcccagaaccctagtgttccctgcttgtgctggacattccgtgtcgacgcggccgcgaatttagtagtagtggcgg

SEQ ID NO: 601476 - DNA, 982 bp, Homo sapiens
  misc_feature (280)..(280): n is a, c, g, or t
ccgcagggccgtacgcagccatgggcgcccagccggaatgtgcatggtcttgaagccccagcttccacaaggactggcagtggcgcgtggccacgtggttcaagcatgccggccgctgtaagatcgcgcagacgataaggcccggcaagccaaggctgcgccgggatcgacccgcgccctcgcgtcggggtcccatccagtgcaccatacgttgcggctgccccaagggattcgagtacgcacacagaagtgttgcgcgcctgggccgcagtgtttcatnggcatggacggtagcgtcagagggctgtggctggtcagtttcatcgagaggaaggtgttggccctcgggaatcgcattctgcgctagttctccttgtgcgagtcccgcacggagcgctgtgaacaaagatcccactgggagctcccttgcaaggatccaagctgtgacatgacgtgactgacacgtgacgtactctggatccatagactccattctcctcgttccaccatggaaaagcgccgtcgggcacccgcaaggcaagggcgagatcagctatcatggctgacagtaacttgtaaaacctggtccatcgctcagtcgttgaccgtgacctggtcgatgcctcagtcccggcaagcgctcgtattacagagaggtgagaacacgcttccgagctcgatcgacatcgatgcgaagacagaagagagttatccaatagcgctttcgcctaagatcgtcacgataatgggtccccggtgtccaaagcggtccgcggcctcgtttcggcgaataccggggacagaaagagagaccaagggacatgccgcagaagcagggatgttggaaagctgaacttgacttggaaagcgcctctctggggaactttggaaatcgaggtcggtcgagtcaagagaaagaggaaacagaattctgcggggggattcaaaggtcaggtagtgcggaagaaagggggtaattgca

SEQ ID NO: 601477 - DNA, 166 bp, Homo sapiens
gccggaggatcacccgagcgcaggaggtcgaggcttcagagagccataattgcaccactgcactcgggtctggttaacagagcgagacagaaggtttgacttttaaatagattttgcgggtcacttgaaaaaatggacagcatgttgcatatgaaaagtcttaaaa

SEQ ID NO: 601478 - DNA, 329 bp, Homo sapiens
  misc_feature (10)..(10): n is a, c, g, or t
  misc_feature (19)..(19): n is a, c, g, or t
  misc_feature (111)..(111): n is a, c, g, or t
  misc_feature (131)..(131): n is a, c, g, or t
  misc_feature (232)..(232): n is a, c, g, or t
  misc_feature (256)..(256): n is a, c, g, or t
  misc_feature (304)..(304): n is a, c, g, or t
ggagttcaanggtgtaaantccagtctgagtccacaggccgaagagcgaggagtgctgatgtacaagggcaggagaagatggatgtcacagctcaagaagcgagaacaaanttgcccttctatctttttgntctattcaggtcctcaatgaattggatgatgtccatgcacattagggagggctgcctcttcattactcggtctaccaattcaaatgctaatctcttccggnaacatccccacagacacacccagnaataatgttttcccatctatctcagtaccccatgatccagtcaagtgnacatataaaattggctgtcacatct

SEQ ID NO: 601479 - DNA, 202 bp, Homo sapiens
cgtggctctgaccggttgatggccttgtagtcgagatgaaatcatgaaattgagtcaaagtcaatttgacattgaaatgacaagaggaaactcttataatacattaaaacaagctctcatttgcctatggataagatactggtcttataaaattaagactgagacctacgatgttctgagcactagcaacaaggtcgtctca

SEQ ID NO: 601480 - DNA, 742 bp, Homo sapiens
gggcatcgggtgctacagcgactccaagcaagagaatgtgcgtatgctgggcttgactttgacgcattcctggtgcagactggcagttctccagataagacctcacgtgcccattggtggtcatgccccgcggggggccccattcatccttagtcactgcctggatgctgttcccagtggcatgctttgcaagatgggactttcgcggtacgtacgtagatgaagctatcgtgtgctccagcgggcttttggccaggacagcatcctctccctcccaggcaatgtgggccaccaggatgtgcaaggatgtccagctctcgccatgggaactaggtgctccgaggcatggaacactctgatgcagagccatgtggcccgttatgggtaggttcccgatggtgcgcttcatttccgtgccactatgattaggtcagtacgccagagacactacagggccgtgcggtggcaccggaaccccggtgatcaagatcgggctccatgttgggctccacttgacatccctgactggtgcgtgcgtggaggctggcttgtcctttcagcaggtgtactggctgaccaggacctcagcgttgtgggctgacgatgctggagcaaatcgcccatcagatacattccctcaggttgaagacaccactgtcactgatgttgggccaggaggatcggcgtgtgcccttcaagcaagggcatggagtattagccgtgccctcaagatccggaatgc

SEQ ID NO: 601481 - DNA, 476 bp, Homo sapiens
  misc_feature (16)..(16): n is a, c, g, or t
  misc_feature (58)..(58): n is a, c, g, or t
  misc_feature (168)..(168): n is a, c, g, or t
ccagtgcctcaagtgnctgtaatttgcattgcatggagaaagttctaattgggcagtnccacatcttaaaggccgaatgatccactttttctttacttttaaattttctttctttatatttttagagacagggtcttgctctgtagctgaagctggagtgcagtggcnctatcttagctcactgcagcctaaacctcctaagctcaagctgtcctcccgcatcagcctcctgagtggctgggactgcaggcacatgctaccacacccagctattttttttgttttttttgtagagatggggtctcactatgttgcccaggctggtcttgaactcccaggctcaagcagtcctcccacctcagctactcgggaggctgaggcaggagaatggcgtgaacctgggggggcggagcttgcagtgagccgagatcacgccactgcactccagcctgggcgacagagcaagactccgtctc

SEQ ID NO: 601482 - DNA, 308 bp, Homo sapiens
tgaacacttatatgtacacaattctccgcgtcactgcggtggcggggccaagccgtttccggggtactcggacctcccgttcgagcagtcggggcactgggtgcagcaagcggtcccccgttcaaggctcaaccacaggattcagccaactatttgcccacattccatcacccggccaagcaacccctgctccttggattcaagtctgctttctctccgtatcagaccccagtggcccatttccctccaccccgggaaggagccaccgcacaaagcgcatggggtacggagctcggaattcggtaaca

SEQ ID NO: 601483 - DNA, 240 bp, Homo sapiens
acacggaacagccgcacatctctgaaagaatatgatggactactgtatttggaaaactatcctaagttgaaattaaaacacatacattggccgggagcagtggctcaggcctgtaatcccagcacttcgggaggccgaggcgggcagatcacgaggacaggaatcgagaccatcctggctaccacggtgaaaccctgtctgtactacaaatacaaaaaattagccgagcgcaacaccggg

SEQ ID NO: 601484 - DNA, 966 bp, Homo sapiens
atgacccaaaacgcaaaactgaccccctaatacaataaataaaccgacatcattcatctgaccttgccccatcacgcgatcatacactagtctccggcatgatggaaacttcggctcacctccttggagccgtgccgtgagtcctccagaagtcgatcccatgaggcactattccgtatgcgcagtgcatgtagtcaccagaaggcctctaatccgccagtgtatcatcaagtcgacccacgatcattcgatgacgtaacattactggtgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccaccagtaattacaaacttactatccgccatcccatacattgggacagacctagttcaatgaatctgaggaggctactcagtagacagtcccacctcaacgattctttacctttcacttcatcttgccttcattattgcagccctagcagcatccaactcctattctgcacgaaaaggcatcaaaaaacccctaggaatcactccattccgataaaatcaccttccaccttactaaacaatcaaagacgcctcgggttacttctcttccttctctctttatgacattaccatatttcaacagagcatctagggagcagacatattacctagcaaccttaagacctcccaattaaggcggaggatatactattcgcctaacagtctcggatcgtccttaaaaataggagggtcctgcctattatacaatcctaatctaaatatccatctcatatccgaaaaggttatattcgcctaagcatcattttgagtctagggaa

SEQ ID NO: 601485 - DNA, 1281 bp, Homo sapiens
  misc_feature (874)..(874): n is a, c, g, or t
ggagcagaggcagcagccggacgagcagcggatgcggtcgggagcgatggtgaagattgcgtgcgtgcggggcggcggaggcggcggtgtgccgctactacgtgtggcggcagtgagggcgtgccgggcccctaagcggctcaagacttgacaacgcctgtgctgaccaagcacaggagtgcgtgctgtgctggtggctgggtggaggagcctggggctgtgcgggctggctggcgtgcggctggggagaactacggatgaccctgaacaaaacccctgcctccccagttgtccacatcaggggcctagattgacggtgctggtgcaagcagacctttgtggaggccttgcaggagtttggacccatcagctatgtggtggaaaatgccctaaacaacgagacaagcactggttggaagtttcgaacgactgtgtagggggggggcttgcaacacgcagcatgaaacaaacagcaaaacccgaagaaaaggcataggtattacgaatttggcatgggtccaagcaccaaacgtataacagaaacgagattacatatataaccagaccaggaaaagactctacaaccggagccatggggcgacctaccggaaatagaacataccacgggaaagcgttgcaaaccacgatgcagcaacaacgtcattattagcacaagtcacttggaaagccacgaaattataaatttacgaaaatagcaacacaacagggacttgtatacactattcaagaagacctaaatccgttggtaagattcccctatagatggagcaccctaagtcccccagccaaaaacttaggcacacatcagttaccacggaacagcgaacctggcgaagataccacagccgcgacnatagggatcggcacaccatatagcaaccatccacagatctacaacatcagtcgaccacaaggcaggacacacacagcactatactcgaccaaagacgtcgaggcacgaacaaaatccatcactttacattggggaactggcagcgctcagcactcagtgaaaggaaaactgggaagataactgaccaaaaacccacactaacgacgggcgatttaaacaatgtgcgtctataccactcgaaagtagaatcgaagagaaatcaaccattgcaagcacacatacgagaacaaacacccccgaagaacaatcaaatgtgagacacaaaggctgaaacgccacctggacagacacaaaaccacgactaaacaagaccacaatccgacgcacaacaacatcactaggtacga

SEQ ID NO: 601486 - DNA, 538 bp, Homo sapiens
ccagtgttgcccagcgggtctccaactctggggctcaagcaatcctcccaccttggcctccccaaaggctggggattacaggtatgagccaccgcaccgggcctctacggtcaataggccctagtataggagaggatgacccggggctggaagacttgagggtcaggatatctcctctaccacccaggccaagaatcaaccttcggggaaggatctccggctgaagctccttccatggccagacagacagatggcagagatgggagggaaagatgtcgtgtgatgccgggtgccctctgtgcgggggggttgggtcagcagctgccccattacgccagcctcgggcagtagctcccaggcggagggtgctagcagaccggaagtaaaccggttataaaacatctcttttcggttaatttccaagtggcatgtatggcagaaggacaaaagcctaaattggctttatgtacctcaggttgtggaaaataactcggtgaccacctgcggggtatgtgacagagatggcgttctatgcaca

SEQ ID NO: 601487 - DNA, 313 bp, Homo sapiens
  misc_feature (13)..(13): n is a, c, g, or t
  misc_feature (29)..(29): n is a, c, g, or t
  misc_feature (214)..(214): n is a, c, g, or t
gccccattatggnccatatccacagtgcnggcagagattttgtttaatgggcccagttttgggggcccagtttatggcccagattttggggggcttgctccccaacagtcaattagcccctaaaaaggtgctcaacattagggaaatacaaatcaaaaccactgtcagataccactccacacctatttaggatggctattattaaaaaaaaaantgttggtaaggatgtgaagacattggaactcttttgcattgctggtgggaatgtaaaatggtgcagctgctatgaaaacaacatgaagcacctcaaaaa

SEQ ID NO: 601488 - DNA, 107 bp, Homo sapiens
aaagatggaaacatatacaaactagaaacatgcaaccatcatcttccacagtcaagtcacaatgtttccatctttgtgataagatgatttaataaatctctttaaat

SEQ ID NO: 601489 - DNA, 324 bp, Homo sapiens
  misc_feature (37)..(37): n is a, c, g, or t
  misc_feature (58)..(58): n is a, c, g, or t
  misc_feature (279)..(279): n is a, c, g, or t
  misc_feature (314)..(314): n is a, c, g, or t
acaagctaaagtcccatgattggctgtctgcaaggtnaggtgcaaggaagccagtggnggatcagtccaagtcccaaaacctcaaaaatagggaagccgacagtgtagccttccatctgtgggcaaaggccaaggaggcctggcaaaccactggtgtaagtctaagagtccgaaagctgaagaactgggaggctgatgttcaagggcaggaagcatccagtacggcagaaagatgaaggccagaagactcagcaagtctgctttattctagccgctctngtatccgatttagattgggggccacccaagatttnatggtgggtc

SEQ ID NO: 601490 - DNA, 259 bp, Homo sapiens
ccggtaatcagacgcctgaacacactgcagtattacagggtgccagatggagcagctgtggccctctgccgctgcctcaccaagcaggtgctccgggacaaccaggattatgtgcctggagagcggaccccaatgctggaggatgtatgatgaaggaggctgtcccgccctggcacctgctgaagccaagtgaagagccggagccgaccatgcctgggaggggcaccctccgaggcggggagcgatagcgcgccaaggc

SEQ ID NO: 601491 - DNA, 1524 bp, Homo sapiens
ggtaatttcctgctgcgcgtgtgcgttcacccatcgtctcccgctctgatggctaccaggggcacgatggggtattagggcgcagcatctgcctgcgagaaccagttcggctcttctgcagacgcgccgggagacggcagcaaccgaggggtctggcaggcggaaactccgccgacgatggccttaacgactcatgtgctgctctctctagcgtgcattacaagcaagcgagacagtatgcatgttaagtccgacaccattaccgacactctctacgacaatgtcacactgcagcgatttcctacggacttgcgcaagacaggaggcgagccagtaagagaatagaccggggagacatgggaggccttgcggctcggaagccaagcggagggtcttgtccggttgcagggtgcgacctttgggaatagtgcccgctccgtgtacgagcgacctgcacgagattgtaagccgcgaggcctggacacggagacacgacacctaagcgtttcatgcatgtaccgcattcgagtttgacccgtagcgcaagggctggggcacaaagacgacaaacattctcaaaagagtggcttgccatttgcggggaatgtactcccctgggccacgacaacaccaagggcataaaaaggcgtccgcgaggcggtacccaagtgccacgaaaccacgttgaggcgtgttggtgcccagttgagttgcgcaattgggacgaaaatcttgtggggtcagaagaaaagggggaccgttgcccaacacggaacggcgggccacgaggggccacaaatgtccgtacggggccaaattggccacggttttttccctttcccccgggggaaggcagcccacagcggaacttctccggcggaatgttgacttctcgcagaatgtccacacattgaactgcgggcacctcttcgtcgcaaaacaccggtgacacgctttcgggggacaaggtgaaaggccaactaggcttcccccttttgttctttggggggatcaaccttctgggcagatccgaacgcctctgtggttggacacttacaccccagactttttgcccccaagatgcgaactgggggaacccacccattctgtacgtataggcaccctacaacactagcgctatacgggggcacttccgacacgcacaccgcgctctgggggatcgtaaacatcttcgctgtcgatatttttattgtggcccccaccccccgccagcgtctataacacgtcatctgccaccaaaagtagtggctaaaagcctacaccccatctagacaccttttacgacagcgacgcaacaaggcctatccacagccccacagcaacacgcaaacctgcggcgtttggcagacacacctccgacacaacaccgatcaggacgacgtgagtcacaaggttacgtttgcgccccagaagggcgaacacacacgcgccttcctcgtaatcgtcgcgacaaactacagctagacacgcaccgcagggacatcaccaatcgagggctgctag

SEQ ID NO: 601492 - DNA, 742 bp, Homo sapiens
agacagatgaggcgagaggaggaggaggaggaggagaaggctctgggctcctctgcaaaaataaaaataaaaaaataaataaaattttaaaaataataaaaattcactatatacacatataaagaaataaaaagaagtctcagtttgcagctattgtgtcaaaattaatatccatttcttttatatatacggtgaatattgcgcaattatagatctgggattttgaaccacttaatgaagcggcaacaccaggtggttgaggtgtggcattcttcgctgatttggctgtccccaatgtttacattatttaatcttgcaaaaaatggttctgtgcacttggatgtgaaatgctgtccagttttatttttttctatggtgtatcctgttggatgtacaaaaaatttcagaaaatgatctctgtagatatctggtaattgggtcatctttagaagttatcaggaactgtgtttaacaacaagaagagaacttttctaaggaatgatacatagaacaagatttcatttcacacatgagtggtaaagctgtgtgttccttggtgagctgcaaggttaatctgcccaagttaatgcaacatggaccacattttttatgtcagaaaaaacaccacacaaacacacacagaaaagagcaaacgcgaaaatcacacgcagcaacaaacaaaacctttgggggccccgccccgaaaaggttcaacacacttgtggggcgggccccatagata

SEQ ID NO: 601493 - DNA, 504 bp, Homo sapiens
  misc_feature (40)..(40): n is a, c, g, or t
  misc_feature (130)..(130): n is a, c, g, or t
  misc_feature (153)..(153): n is a, c, g, or t
  misc_feature (155)..(155): n is a, c, g, or t
  misc_feature (163)..(163): n is a, c, g, or t
  misc_feature (167)..(167): n is a, c, g, or t
  misc_feature (174)..(174): n is a, c, g, or t
  misc_feature (187)..(187): n is a, c, g, or t
  misc_feature (213)..(213): n is a, c, g, or t
  misc_feature (220)..(220): n is a, c, g, or t
  misc_feature (224)..(224): n is a, c, g, or t
  misc_feature (226)..(226): n is a, c, g, or t
  misc_feature (249)..(249): n is a, c, g, or t
  misc_feature (289)..(289): n is a, c, g, or t
  misc_feature (305)..(307): n is a, c, g, or t
  misc_feature (317)..(317): n is a, c, g, or t
  misc_feature (398)..(398): n is a, c, g, or t
  misc_feature (451)..(451): n is a, c, g, or t
ccaccccagggtgggctgtcacgggggcctcacgccaggnaccccgcccctcagggactgctcgtgtccagatcttggccagcatggaaaactccagatagtgggggcaggggtccaggtcatctttatnacgccccaggtcaagggttcttngnacaaaaanaggnctccgtntgccagcaggggnccgccagcagctctaagtgaatgtgnagaaaanggantncgcggggcccggtagaaaagccncgccccgccggaaaaagctccaaggggtggggccccccgncccacggcaggcgagnnncgggggggtngggtcggcgtgcggtaggtaagccgtccagcccggaggggtgccagccccaagcccggtgccaccgcggcaatgggcaggnggggccggacgaacgaggcggcggcggcggggcggtgggggggtggggggggncccggcgcgcgggggcggagcgcgggccggggccaccgggcggtggcgccctg

SEQ ID NO: 601494 - DNA, 1616 bp, Homo sapiens
  misc_feature (398)..(398): n is a, c, g, or t
  misc_feature (400)..(400): n is a, c, g, or t
  misc_feature (499)..(499): n is a, c, g, or t
  misc_feature (515)..(515): n is a, c, g, or t
  misc_feature (637)..(637): n is a, c, g, or t
  misc_feature (831)..(831): n is a, c, g, or t
  misc_feature (833)..(833): n is a, c, g, or t
  misc_feature (835)..(835): n is a, c, g, or t
  misc_feature (849)..(849): n is a, c, g, or t
catctgggcaagagatctacccgtagattgacgcgcgttgcaccaagatctcccgtggggacttccggtagcctcgcgcaatgatgcacgaactcgctgcagagcccaggacttcagcatagtgtccaggcgatgaagcccaagctgtctcggacacggtcggattgacatgctcggccatacgcacttcgtcgcggctgatcggtgatggctgcggcaggagtgagtcccttgatgccttgcccagagttggtcatacggcgcggcgcctcttgactggactcatgaatcgggccgttcgggtactggctcaccgtgcgatgggtggccggctgagggcatctgactgacgttggagtgggtgagttgcggcaatggatcaacgcccacctacaacnanatcttctacacgctgtcccctgtcaacggcaagatcacgggcgccaacgccaagaaggagatggtgaagtccaagctccccaacaccgtgctagggaanatctggaagctggccnacgtggacaaggacgggctgctggacgacgaggagttcgcgctggccaaccacctcatcaaggtcaagctggagggccacgagctgcccgccgacctgcccccgcacctggtgccgccctcncaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcggggaggnangntgagggatggaatngtgtgcacaagaactgtggctattttaatatataacgttagaggctgcgttctttgtcgccgcctcccctgatgtgccaagccctgtgtgcacggactctgacccacctggactttgctgtggcttggagctggacatgtgcagcgactgcgacctgtgggggagccaggtacgacctttttggccagctgctaggctgaggctgcatggacaggaacaccaggcaccctcacgtgtgcttctgagctgagagtagcttcacgtggaccgtggcttccttcctcacctgggctctgccttccccacgtgcatctcaggagcgaagatggagtacttgtggccttacacactccacgaggacccagtagtcaccgtgacgcggagccttgacccattacatccacgcgacacaaccgggttccgagcgctgcaacaccgaactcaagcaaggatacatagaaaggcacgcggcccaggccagcatgggaccattagaaggggacgatccagggacaggacaccggagagaacagggtatacacataaaaaaacataccaacacgaactaaataaccgcgtcagtggaaacaagacgaaccttacacacaacttgtacccaaatgaacccacaccaaatatcccaacgcagcagggacacacacggacgggtgcatatgggccaccgactacaacaccgcccacagagggagacacccgcccggcggggcaacaatgagagcgaaccgtgagaccacgccgcgtccacg

SEQ ID NO: 601495 - DNA, 1334 bp, Homo sapiens
  misc_feature (49)..(49): n is a, c, g, or t
  misc_feature (64)..(64): n is a, c, g, or t
  misc_feature (78)..(78): n is a, c, g, or t
  misc_feature (84)..(84): n is a, c, g, or t
  misc_feature (89)..(89): n is a, c, g, or t
  misc_feature (116)..(116): n is a, c, g, or t
  misc_feature (118)..(118): n is a, c, g, or t
  misc_feature (217)..(217): n is a, c, g, or t
  misc_feature (233)..(233): n is a, c, g, or t
  misc_feature (355)..(355): n is a, c, g, or t
  misc_feature (549)..(549): n is a, c, g, or t
  misc_feature (551)..(551): n is a, c, g, or t
  misc_feature (553)..(553): n is a, c, g, or t
  misc_feature (567)..(567): n is a, c, g, or t
gcgcctttcaccccaccatcaacccccccttcaaacacaaactacaacnaaaaaaccaacaagngcatcgacgacgtngagtgngtcgntgaacaaaaacaaacccacctacaacnanatcttctacacgctgtcccctgtcaacggcaagatcacgggcgccaacgccaagaaggagatggtgaagtccaagctccccaacaccgtgctagggaanatctggaagctggccnacgtggacaaggacgggctgctggacgacgaggagttcgcgctggccaaccacctcatcaaggtcaagctggagggccacgagctgcccgccgacctgcccccgcacctggtgccgccctcncaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcggggaggnangntgagggatggaatngtgtgcacaagaactgtggctattttaatatataacgttagaggctgcgttctttgtcgccgcctcccctgatgtgccaagccctgtgtgcacggactctgacccacctggactttgctgtggcttggagctggacatgtgcagcgactgcgacctgtgggggagccaggtacgacctttttggccagctgctaggctgaggctgcatggacaggaacaccaggcaccctcacgtgtgcttctgagctgagagtagcttcacgtggaccgtggcttccttcctcacctgggctctgccttccccacgtgcatctcaggagcgaagatggagtacttgtggccttacacactccacgaggacccagtagtcaccgtgacgcggagccttgacccattacatccacgcgacacaaccgggttccgagcgctgcaacaccgaactcaagcaaggatacatagaaaggcacgcggcccaggccagcatgggaccattagaaggggacgatccagggacaggacaccggagagaacagggtatacacataaaaaaacataccaacacgaactaaataaccgcgtcagtggaaacaagacgaaccttacacacaacttgtacccaaatgaacccacaccaaatatcccaacgcagcagggacacacacggacgggtgcatatgggccaccgactacaacaccgcccacagagggagacacccgcccggcggggcaacaatgagagcgaaccgtgagaccacgccgcgtccacg

SEQ ID NO: 601496 - DNA, 186 bp, Homo sapiens
gttccaaccaactatcccgtgagacacgactccctgagagagatattgtagacgaggcttcattaaggcacctggatcctaaagatcaaaataatacagctgggatacttctgccttagctttctatatggatgctccaagtcatcagtatgggtgacactcatgaatcacagtagctatggcagt

SEQ ID NO: 601497 - DNA, 388 bp, Homo sapiens
  misc_feature (10)..(10): n is a, c, g, or t
  misc_feature (73)..(73): n is a, c, g, or t
  misc_feature (99)..(99): n is a, c, g, or t
  misc_feature (135)..(135): n is a, c, g, or t
  misc_feature (238)..(238): n is a, c, g, or t
  misc_feature (328)..(328): n is a, c, g, or t
  misc_feature (365)..(365): n is a, c, g, or t
aagttttaanttccaacaggttttgggaaacaggtggtgtttggttacatgaataaggtctttagtggtgatntctgagactttggtgcaccccatcancccaagcagtgtacactgtactcaatgtgtagtctnttatacctcataccactttcaccctttccccaagtccccaaagtccattgtatcagtcttacacctttacatcctcacaaatttagctcccacttatgagtgnggatatatgacgtttggttttccattccagagttatttcagttagaataagtctccagttccatccaggttgctgcgaatgacattaagnaataatgactttaaacctctgttctctgtttagtagnaactataaacctttagatgatgg

SEQ ID NO: 601498 - DNA, 320 bp, Homo sapiens
tcccagtccatccctcccacaccccacccatccccaagagagacctttcctaagacagtctaaggcccaggcacggtggctcatgcctgtaatcccaacactttggaaggtggaggatcacttgaggccaagaattcaagatcagcctggacaacatagcgagaccctgtctctgtaaaaatttttaaaataatttaaaaattagccaggcatggtggcatgtgcctgtagtcctagctactcaggaggctgaggcaagagtttgaggctgcagtgagctgcagtcacactactgcactccagcctgggtgacagagcga

SEQ ID NO: 601499 - DNA, 245 bp, Homo sapiens
gcccacggcgtcggcaaacccttttccacggggatggataaagaaaatactcctgtaaagaattacacaggtattgcagccttataagtggagtctgtggctcagactcactgactgacataaagtcgagatctacagaaaagaacttaatatttgagcctgtggatgtaaagatgtgctgtcaaatcagtgaatgtgaataacaagaagtccagtcatgaccaagttgagatgaatcatgtttt

SEQ ID NO: 601500 - DNA, 2519 bp, Homo sapiens
  misc_feature (237)..(237): n is a, c, g, or t
gtcagcctcgggccgtcttgcggggctgcggcagccccgcaagaggcttccctcttctttcctcctccttccctcccttcctttcttccttccatctgtccttgttttcctcccttcccttcctccctgcctctttccttccctccttctcttccttccttccgtctgtccttgttttcctccctgcctctttccttccctccttctcttccttccttccttccgtctgtccttgtnttcctcccttcccttcctccctgcctccttccttgtttaagaatttgaaaataaagtttcccaggagtttgaattggagtcgagatttaagtggctgaagttttgcatttcactaggaaaccaacagctttaatcatgaaatgaaagcacagctgggcattgggccagtcacagagtgtcttttgctctgagcacttcacaaacccattgtggaggggaggaaagaaaaagaaagccatctttaattatcttagctgttcctaatgtctttggctgcaaagagctagctgtttccttcaaccttggtggttgcacgggtagtgtcctcagcagtgagagggcaggtctgccctgtggtcaggattgcccttgtgaggggcagagctctccaaccatgcagggctccgtgtcggcatggtgtggactcgggtgctctgatcatcccctgtgtttgcgtctgaccctgtgtggttgcattcccttgatggagtgggaagtatgtaatttgtagtgctgaggacattcgtctgtttgattttctggtgttttcaatgacatgcatgttcagcagagaaagatgaataaacactgtccaattcttctctccacatagaagcctcaagaagaggtgaggagatgccccgatttccttatttcagagcagtacatgcgttcgtctcacgaaagctcttacaactaaaacaacagcaccaacaaaccaggatcaaaataatcgtgcattttccaggattccatgttggacttctcagtgctttggagatcaggaaataatcatgctgttgcagcagtatggttttgtgtctggattttattcatacaggcatgtgtttacaggcatgagaattctgtattgaaaagaaagtccttgtttttttctaacgtatctttctgttccatcaactgttaaaaccaaattgttaagaacattgagcttcttaggagagattacatgcagctacttaggaccacctcagcaaaatggagttgcctgggtagatagcagcagcagctcaccagccccacgctgccaggctgctggctgctgtccaccaggcagctgtggaacctccatgttctgcctaggtgttgtggcaagaacagcagggaaacaggcggccgcctccaggccacaggtggacccagggaccttcagttacgccgcttcaattgaattcgtggtggtttctctgctacagcagaagtggaagaagctcttgtcttgtttggcatttgtcccattttttggctaataattggctttgaatttctctgtgccctgcttaccaattatagctttctggattggctgttcttagcagtgcaaatgtcaatgcaaagaagcaagcaggcggctactttctgggaagaagcatagtccgtgctcacactggatataaatctgcaagatttgggggtttggcaaaataggggtggagggaaagctgccatggctgtcagaaattggggctttttgaagaaaagcttgtgtaggcatcagccactggctggccagaattccatgaatggaagcaggtgcccgagtgatctggggctttacatgtggatataaatagaagccgggagcctgaggctttgctttaggaaaatcatgagccagaaaacagaggaggtgattgtcagtagtcacctcacgccgctagtgttttctaatactctctcgaattgtcaaagcaaaggaccttataacagcaacacgtgtgtgactcgaagcagcgagcttcccttgggaaaaggagcctcttctcagcagagggtcccagcctttctgtccttccccatcggaatgccaggctctgtgagtttggatgttggacattgccacctgaattccaggaggccggggagctccagtgatggacttgtccccaaaagagtggtgctgttctcagagccataaatgttccactgaaagtgtctgtcccctggctcacgctggctgcacttgcttgaaggaggctgatttaagggttctaataggaagacaaatgaaactgtcaaattttatctttaagcatgtgagtaagtttgctcattcgcttttactattgatgtatagttttaaaattcttaatttaaaaattattttaatagtaaatttttcacaagtgaacactttttatctttaaattaaaattctgaagctccctagttagttagatccaattgctggttacattttgggaagctctcattttagtgctatgtagtttcattgaataaacatgttttaatgaaaataa

SEQ ID NO: 601501 - DNA, 164 bp, Homo sapiens
agcggacctcagacagacacgtcgggggctgccgggatcggcatataggggggcctctggcctcttcggccggtctgtctaggcatggtaggcatcatgacgtccagcaggacccttcttctggcgtatttcattctgatgtttatagtatatgccttggaagt

SEQ ID NO: 601502 - DNA, 135 bp, Homo sapiens
ctatacggtcattcaagtatacctctagaataggactgatactgtgtctttgcactgtggagcacaggccaggtgctcgatggactctgctgtcatctctgttgggcgcagctgcactatcaggcacatccttca

SEQ ID NO: 601503 - DNA, 112 bp, Homo sapiens
cagaaagtcacaagggataagcggatgaggtattgtcatagatagctcttattattgtgagatacgcccctcatccgcttatctcaaaataataagagctatctatgacaaa

SEQ ID NO: 601504 - DNA, 815 bp, Homo sapiens
  misc_feature (766)..(767): n is a, c, g, or t
aactgtgatcctccacgcacgccagactatacctgtctactcagcgatatgaagattaactatactacgatcttcatacaccatgcctggcatgattcagtgagtggcaagaaatatcctgtctttaatcctgcacctgaggaggagctctgccaggtagaacaaggagataccgaggatgtcgaccaggcagtgaccgccgcaagacaggcttttcagactaggatccccgtggcgtactatggatgcttccgagagggggcgactattatacaagttggctgatttaatcgacagagatcgtctgctgctggcgacaatggagtcaatgaatggtggctctattccaatgcatatctgaatgatatagcaggctgcatcaacacatagcgctactgtgcaggttgggctgaccagatccagtgccgtacaaataccaatagatggaaatttttttacatatacaagacatgaacctattggtgtatgtggccaaatcataccttggaatttcccgttggttatgctcatatggaagatatggcctgaactgagctgtggaaacacagtggttgtcaaacagctgagtaactactctcactggtatcacgtggcatcttaatacaagaggcaggtatcctccggagtagtgatatgttctggttatggctaagaggggagcattctttccatggttgacagtacttccggaccgagtgcagtgtaaactcggtcctgacattgggtgttatcttaattgtgagcnntcaacagcaccccacgcactaccaattaacccggcaccacatcggcgc

SEQ ID NO: 601505 - DNA, 479 bp, Homo sapiens
tccgacaagtggaaattgtaaatcatatgccgagttccagaagatgattggcgatgcatataaatcacaggcatatatatctcataaccaaatacatgcctaaatatggaaatatatgcttttatatgcatgtccggagtcatcctcgtaaagttgaccgtatggtcatataagaagtgatgcagtatcgtatgcgtaataaccatgtcgaacgtggataaatatataatatgcatatatatcatatacagtagtccatcacctcacatagttaccagtttacttatagttctctctctcttacttccttcctttctttcccttcttttaaatatttcggtggttgagaacacttaagatccaccctcttagcaaatttcaagtatataatatagtgttgctaattgtagtcacatcgtagtagaatacatctccagaattcattcatttggataactgaatttctgtgcccatttcaa

SEQ ID NO: 601506 - DNA, 286 bp, Homo sapiens
accgtttattagatgtgtactattaaacattttattctatgagacaggactttgctctctcacctaggctggagtgctgtggtgtaaacacggacatcactgcaacctctgtctcccgggtttaagcgattctcctgcctcttactctgtcactcaggctggagtgcagtggcgcgatctcggcacgctgcaacctccacctcctgggttcaagtgatgatcctgcctcagtctcccttttagctgggattacaagtgcatgccaccacgcccggctaagtttagt

SEQ ID NO: 601507 - DNA, 435 bp, Homo sapiens
acattaccacatcaccattgaacagatcaactgcagaaaaccaacaaagacacatggacttaatccgcactacagaccacatggaactaatagatatttatagaacatgtcatccaatggctgtagattaaacattcttctcctcagcaaatgaatgattctcaaggacagaccatatgttaggccacaaaacaagtcttaaaacataccaaaaaactgaaaccatatcacatatcttttctgaccacaatgggataaaaccagaaatcaataacaagaggaatttcggaaactatgtaatacacgaaaataaaccaatacactcctgaatgaccagtgggtcaatggacagatgcagaacaaaatcgaccaattccttcacagaaattataacggaaacacaacataccaaaaaacttgggatacggggaaagc

SEQ ID NO: 601508 - DNA, 545 bp, Homo sapiens
ttttcacagaatcacaatgccaattgataggctcaagtgtctaaaaagagggcatgaacatgacttgacaaaataggtaaacttaatttcaggactataataggagggaccaattcaaactctcaccattggattcacacccacaagaaccactttaagggcattaacgagctctgaaaactgatcaggtttgcgcaagtaacccatgtatcttttaagaagacttgtgcacttgcccaggctcaaggatattaaaagctagcacatacagcccataactggaggtggaaatacaggcgatatactattacggtatcatccatcaattacagtttggaatgtctctgtatcaaccaaatggattatcacatgttggcacatcttatgtcttactgagcaaagtgcattgctacagtaatcagtgctgctattcagcctatgtacgtactacagcctatgattactgacagacagaaggttcttgcatagactgcctctcgttgagaacttatgatgtatacaatgactgccgctatgaactactt

SEQ ID NO: 601509 - DNA, 713 bp, Homo sapiens
tgtaccgcccggataaggatcgcgagctgtggccaggtgccgcacggtcagccctgcttcagcccgcgtaggcagcgcgcctcgcctcgggcgttctaccgcgccccgccaggccttgcgcacgccggggccagggccgagggccgcagcgccggggccggtcgatgagcgcgaggagccggcatgagcgcagacagcagcctctcgtgggggcagcccaccggttatgggaccctgacgatagggacatcaatagatcccctcagctcctcagtttctccgtgaggctcagcggctactgtggcagtccatggagggtcatcggctatcacgtcgtggtctggatgatggctgggatccctttgctgctcttccgttggaaggcccctgttgggggggtgccggctgcggctccggccctgcaaacctggcccaagccgaaaacactcgttcatcgaaataggagacacaagaggatagttcctggcagctcttcactgtccaggtgcagactgaggcccatcggcgagggcacgctggcagacgtccccaccagtcccaggcagaggatggccggagccaggcgcgggcgttggggcgggtaccagagggtgcctggaaggatacggccatctcaccaagcagcgaggacggcgaagcgggtgctgcggtaatacctcttccaaggccagcgctatactctggatcgagac

SEQ ID NO: 601510 - DNA, 883 bp, Homo sapiens
  misc_feature (43)..(43): n is a, c, g, or t
  misc_feature (186)..(186): n is a, c, g, or t
  misc_feature (188)..(188): n is a, c, g, or t
  misc_feature (202)..(202): n is a, c, g, or t
  misc_feature (204)..(204): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (217)..(221): n is a, c, g, or t
  misc_feature (224)..(224): n is a, c, g, or t
  misc_feature (227)..(227): n is a, c, g, or t
  misc_feature (243)..(243): n is a, c, g, or t
  misc_feature (260)..(260): n is a, c, g, or t
  misc_feature (267)..(267): n is a, c, g, or t
  misc_feature (284)..(284): n is a, c, g, or t
  misc_feature (301)..(301): n is a, c, g, or t
  misc_feature (303)..(304): n is a, c, g, or t
  misc_feature (312)..(312): n is a, c, g, or t
  misc_feature (331)..(331): n is a, c, g, or t
  misc_feature (339)..(339): n is a, c, g, or t
  misc_feature (392)..(392): n is a, c, g, or t
  misc_feature (400)..(400): n is a, c, g, or t
  misc_feature (410)..(410): n is a, c, g, or t
  misc_feature (425)..(425): n is a, c, g, or t
  misc_feature (437)..(437): n is a, c, g, or t
  misc_feature (439)..(443): n is a, c, g, or t
  misc_feature (445)..(447): n is a, c, g, or t
  misc_feature (463)..(464): n is a, c, g, or t
  misc_feature (471)..(471): n is a, c, g, or t
  misc_feature (475)..(477): n is a, c, g, or t
  misc_feature (532)..(532): n is a, c, g, or t
  misc_feature (534)..(535): n is a, c, g, or t
  misc_feature (537)..(537): n is a, c, g, or t
  misc_feature (540)..(540): n is a, c, g, or t
  misc_feature (542)..(542): n is a, c, g, or t
  misc_feature (545)..(548): n is a, c, g, or t
  misc_feature (552)..(552): n is a, c, g, or t
  misc_feature (556)..(557): n is a, c, g, or t
  misc_feature (560)..(560): n is a, c, g, or t
  misc_feature (570)..(570): n is a, c, g, or t
  misc_feature (593)..(593): n is a, c, g, or t
  misc_feature (610)..(610): n is a, c, g, or t
  misc_feature (619)..(619): n is a, c, g, or t
  misc_feature (659)..(660): n is a, c, g, or t
  misc_feature (666)..(666): n is a, c, g, or t
  misc_feature (679)..(680): n is a, c, g, or t
  misc_feature (719)..(719): n is a, c, g, or t
  misc_feature (728)..(728): n is a, c, g, or t
  misc_feature (735)..(736): n is a, c, g, or t
  misc_feature (746)..(747): n is a, c, g, or t
  misc_feature (749)..(749): n is a, c, g, or t
  misc_feature (751)..(751): n is a, c, g, or t
  misc_feature (765)..(765): n is a, c, g, or t
  misc_feature (770)..(770): n is a, c, g, or t
  misc_feature (780)..(780): n is a, c, g, or t
  misc_feature (784)..(784): n is a, c, g, or t
  misc_feature (788)..(788): n is a, c, g, or t
  misc_feature (807)..(807): n is a, c, g, or t
  misc_feature (817)..(817): n is a, c, g, or t
  misc_feature (822)..(822): n is a, c, g, or t
  misc_feature (859)..(859): n is a, c, g, or t
gaggtataaagcccgatacctgccccgcgcccggtccgcgganccgctgcagctcccgctcgctccggacgcggaatcgggcagcagcgggaggcggcccggagagccgagggacccactgaagctccagcaactccagaaccaaatccgactggagcaggaggccggcgctcggcagcctccgcnanccccgcgcagcgcngnccctntnancccnnnnngcngcngcccgccttccccganctcgcggcctgcacgcngcccgcntccccggagcccatgancgcgctggcctcccgcncnncccccgcnatgcagtcctccggctccntcaactangcgcgccccaagcagttcatcgccgcgcagaacctcgggcccgcgtcgggcanggcacgcnggcctccaanccagctcgtccagcntcccatcgcccntnnnnntnnngccgaggcagttcggnngaaaaancgtnnngcccttcgcgcccccttcggcgctgagccgaggccccgtgggctcctcctcgccntnncnccncnaannnnaaancggnnttnagcccagggnccttcccgtgcccacgtgttccnctgccgcgccaccaccncgctccgancccggacaggcgtccactgctcgtcgctgccaccgcttcnnccacgnccagacgcccgcnncctcctcagcgctctgctgccctcgcaccgccgccgggncgttcaacnccctggnnctgcccaatnntntnaccccgcagatttncaaanaaggcaatanaatnctanatagctccgatgaggaatnaaggcaaaangatgntgttatcaagactggacgaaactcgctcaagaggacntctgacatggcagcgagttacata

SEQ ID NO: 601511 - DNA, 296 bp, Homo sapiens
gtatatgcatctggagctatggcagcttcttgcacccatgagcaactctatgtgcaagagcaggtagctagaacgagcctgcagtcctgggcttatatcctgcttcccagggagcttaaagatagcaacaaccacagacatttgcatcaaatgccaggaaattcttaggctgggattgtcgggatcgtttgaatggttgcgcgtgaaagcattgttataatgggcttgtcgaatacggggaaagatgagctggcttttagctgactccactccccgtgtcccatgctcaatagatg

SEQ ID NO: 601512 - DNA, 733 bp, Homo sapiens
  misc_feature (249)..(249): n is a, c, g, or t
  misc_feature (269)..(269): n is a, c, g, or t
tggctagtatcccagctcaggccaccaacgaacatttttcccgggtcctcctcgttctgtgcgggcgtttgatctggtcgccctcggggccgttctgattcccgctcgggggcgccggggtcgcgccttccagcccccggccgggggtgcccgtgtgcacagcccgcggccggcagatttcgccctttcggggacggcctcatgtgtcgcgttctcgggtgggcgccgcgtgcgtcctcacatgtgggncgtgcttccttgcgcccgtntttccagaacatgtgccatatggcgccaggaagagggccgcgcggggggaggagatactcactctcgtgcgcggcgcgaatgtgatagcgcccgcggggggggccccgtctcttcggtttctcccacacccgccggacgagggggatagaagggcgtcccgaaagaggtctactcggggccggccaaactctccagaggcctcgcgcgccgtgtgctagaaaagggccttcgagcccccagagatgtcagagcccccagggagagacggtgtctctcccaagcgtggggtgtctctccctctcctctccctgtgggggccggcgcgtccgaaagcggggaaaaccccaaacgcgagaaccaaaaagaggccaagagaactctcgcgtgtcccccgcgcggggggaaacccccattttctcaaccttttatactataacgcgaggaaaaaactcttataaaccaa

SEQ ID NO: 601513 - DNA, 474 bp, Homo sapiens
cacgaatgtatagactggactgtaggaatggactgcactggaatggaatggaatgcatggaatgggatcaacccgagtgaagtggaatggaatcgaaaggaatggaatagaatggaatggtttcaacccgaatggaatggaaaggaatggaatcaacccgagtggaatggaatggaatggaatggaatggaatgggttcaacatcgaattgaatggaaaggcaatggaatcaacccgcagtggaatggcatgttaatagcaatggcaatggcacatgcaatggaatggcatggaatggaatgcaatggcatgcattcaacccgaatggaatggcaaggcagtggattaaacccagagtggaaatggcatgaaatggagtggacatggaattgactggaatggaaaggtacggaatagaatgggaatggaacgacatggaatggaatgtacatccggtgctcacgggtaccgagc

SEQ ID NO: 601514 - DNA, 237 bp, Homo sapiens
  misc_feature (23)..(23): n is a, c, g, or t
cattttagagtaactatctcggncttcggagagttcctgggtatgaaggtttggctttaattaaagtctcagcacagtgttaaatgccattttattttaggtcatcattggcgctaatgaaatgagtggattccttagtgctctcattttgagaaagtgaacagcaacatctgagcttggtggtttccattttcgcttttccccctcccatgctctgttcaattaaaagttttgaga

SEQ ID NO: 601515 - DNA, 83 bp, Homo sapiens
gaccctgctgcttcacaggctgctgcttccttccctttgctcaagaagacaacttgcaggagacaggtctttacttccgccat

SEQ ID NO: 601516 - DNA, 217 bp, Homo sapiens
agtaaaagaggctctgatgagttcattaaaaaataagcacccccacctcatgcactttgatacagcaggatctagtaatctaggcgcctcaggtaagcgtggatagctcttagcacataggacaggtcagcgttcacacatcaacactataactatgcggcggaactagctccccgctagccgtcaatgtactcaggagactacctgtgagatcctg

SEQ ID NO: 601517 - DNA, 688 bp, Homo sapiens
ctatatctggagcgagtgctgtgaggtgctactccgccgcgccttattcgacacggtgtcagggctgtgagactaggatgtcggacacgtgtagctctatccaggcccacaagacagcagctggactctctgctggacaggctgcagcggaggcgtgaatctggattcgtgggcacttgcgcatctacgagaatccagaggcggctcttgtctccaaccttccgtagtgacagcccatgtagcctacttgcacccacctctggtggccctatagcccagaatcaagcttcgagcagttcctgacattagttacatgatcctgagttaccagaagaatgttcgttacaggcacactctctgatctggccttaacattggcccactgatgctggtgtccatctgtcttgccgatctccatgccagatgctcgctgccactcaaggatggggtaagcaaagcctcctgcaggcaacttttgcagtctcatgcgagttgacttgaggtaaagcgatggtcatcctatcacattgtagtgatgcagcagtcctactcttgtaacctatgtctgtaccacttccaagctctctgtccatgatgggtgctgtggcatgaaaagaacgggctcctggggaggtaggcagggactgtcccagggcacaagcgggtgtgcactaacaggactcgatta

SEQ ID NO: 601518 - DNA, 180 bp, Homo sapiens
ccttggtgtatcctttgcatggttgcggctgagggattcggtgtcgaaatggctttcaccgaaggcgttgctgatcggctttgtcgcagtcatggctggttgtggcattgttgatcacccgtccaccgttcagtgcagaactccaagcggtgttgcgcccggtttcgactgggctaaaaa

SEQ ID NO: 601519 - DNA, 464 bp, Homo sapiens
gttgcgctactaccatagattatacatgaagttgcgagcaccttggacgcctcgtaacattttgatgtcattttcaggagaatcacgctagtagatcttatgcgtccaccgaagcctcatttttgaaccccctagctcatagttctggccaggatcagcttcttcttgcaatcctgtatcatccaggaaaagtaaagaatatgcatgtatgtgtacactgtatgtgcatatgagagtgtgtacatatgtgtattgtggatgtgaacatgagagcatgtgtgcatatgtgtgtgtatatgtgcaagagtagcacgtgtgcatgcgtgtgtgtgtagcaggagtgggtgggtggagtttggccatgctgagcatctcagcacaactgcacttacactgtgacctcctccacttttctgccatccctggttctggattctatcctcttccttccccatcttccattg

SEQ ID NO: 601520 - DNA, 1116 bp, Homo sapiens
ggcgcggacacgcttctggaaggaacgccgcgatggctgcgcagagaagatgccccgaggtccagttcaaacttgtatgggttggtgatggtcggtgactggtagtaaaccgagccttcgtgcaagaacgtcagttctgaccttgtgtgacatttctcgacgacatgaacgtacctgtagcctagccgttgaggtgttggacggttcactcccctaggtgttccatcatcaacagagtgacctacttcaaggttgcaactcgttatgggacacaagccggccagggagaaacttctggtaggactagagaggatgggctattattagtctcaaaggcccatgtgtgctcatcagtaaggtgttcgatgtaaactatcagaaggatgttacgttacgaaagaagtgtgcctaaactggctagtacgacgatctgggtacagagtcgtgttagatacatatccatttccggcattagtctgctagtagtaggctaatcggatagtaggcaatcattcaacgggcacgaggggaaacgttgcatatgggtccgtaaaattccctatggggcctttgccgacccggggactaggaacgaagtcgtctacaaagggactctacgttagcctttttcgtgtgcccgataacacgttccaagcattagcaagaccgttctcatgtagacacacggcgccgcctatgccctgctggggtcgtgtggactaaggaggaaataggggcgtccaagttgtggcaatgaagccccgggagaccatgtaggccacaattgtgaaggtatgccccactagatgcgttggtgttccttcgaggccccctaaaccaaggaaaaggtttggtcccatagaaggaggccgcatgccttttgtgggcaccagacgaccaagcttagttgaggtcaaccaggaaacgttttgagaatgaggattagcttccaggaactcaagtcgttgcgtcccttcccccggggaattggaaggggatttggattggagacctggtgggatcaatcttggaacggactcgcggagggccccccaggcaggtgccaggacaacgttcctaaggtattttagtacacgagcagctgtggttcccttg

SEQ ID NO: 601521 - DNA, 138 bp, Homo sapiens
  misc_feature (37)..(37): n is a, c, g, or t
gcgactaagcgggtaagtagagagcggaaaagggatnaggaggtagcatcattgagcttattcttgactcatctcagaccaaacatactctgtcaatcgttgctcttaaaatctgcatattaaaagctcagcatcaac

SEQ ID NO: 601522 - DNA, 346 bp, Homo sapiens
tagatagtgttaaagaaaaaaattattcagtgacacttattaaagaacaataaggtgagccaggtgcagtggctcatgcctgtaatcccagcactttgggaggctgaagcgggtggatcacctgaggtcaagagttcaagaccagcttggctaacatggcaaaaccctttctggactaaaagttcaaaaattagctgagcatggtggcacatgcctgtaatcccaactacttgggaggctgagacaggagaattgcttgaacctgggaaggcgaaggttgcagtgagccgagatggtgccactgcattccatcctgggtgacagagcaagactctgtctcaaaaaa

SEQ ID NO: 601523 - DNA, 441 bp, Homo sapiens
  misc_feature (416)..(416): n is a, c, g, or t
  misc_feature (424)..(424): n is a, c, g, or t
ttttgagacagattctcattctattgcccaggctggagtgcagtggcagtcccggagccctggaactccgggatcaaatgatccacctcaacctctcaaagtgttgagattacaggcgtacacccatgcccagcctcttctcttagtgttgactgtgttaacgttgagccccatgcttgtttaatgaggctcataagatgaatagtgttcagtcatttcctggcgtgtcatgtactagttatttacatctgcacgtcaacagtgtgtcaaggcacagtatgagtttctgtcgactaaatgtaggagaactgaggacctcaagagatgaacttatgtgaacagtagagtactgttgtgcagagtatttctgagtcagttcagtaaggcaagagtttataaagtgctcttatacaggngttctacnaggaagatcaacctggc

SEQ ID NO: 601524 - DNA, 449 bp, Homo sapiens
aagtagaacaaaaagtctagataataggtaggaattatacagtgacagaaaagctcaggtttatctagattaggttgaaaaagctagctcagaaattaaatcctactgtgtacataaaaaacaaggaacccagccctgaagcaaagaactacatacagggaagttgtcctctcttccaagtctaatgatttcaaatgaccttaaagtggtcatctttacagtcagagaagcatatgtgtagtaggggaggagaaaaaagaaggacctgaggcagactttagaattataacctaggaaagaactgtaatagtagggtaataaactagatccaatacataaataacatggtttccacgtaactactatggcaaaggtacaaaaagcctaattgtgagaaaaacaaattaaggttaaaatatcctcaagcatcccaaattgcactaatcagt

SEQ ID NO: 601525 - DNA, 210 bp, Homo sapiens
aaaaaaacaacagtttccccctttttccccgggggaacagtgggttttttaaaacaaaccccccgtgggttttttaaaccccaaataataaaaaaccttttaaaaactgtttttttttttggaaaaaaaccttttttttagttttttaatttgggccctttaaaaattttccccaaaaatttataattaaattttagggtttttttttta

SEQ ID NO: 601526 - DNA, 395 bp, Homo sapiens
cccatttgacacggataatatatagaaagcagattcagataccagagataatgacatcatactcaaatgcacagcatcatctccatcaactagagtcagacacctgaaagaccaatgcatcttcacctatcttctgcaaaaagtaggaagagggtaccctttcctttggctccaacatggacaatccttaaaaaatgttatagagattggataaaactaacctggcccaagattctttgtgtaagtaaccaaatcttccatagtctccaccacctctgccactgtaagatattccaaaattcctttgcaaactctaataattttacggacctgaaaaaatatttcagagtattcaatcacatgggtggacaactagcaaacacggtaacacagat

SEQ ID NO: 601527 - DNA, 113 bp, Homo sapiens
ttagaggatcctgtggagatgggtctcagcaggcttggtgttgcacgggttcatgggcctgaaggtgtgcattgtcagtggcttggactctccactgcttggatcagggtctc

SEQ ID NO: 601528 - DNA, 135 bp, Homo sapiens
agggctcttatgtgtctctcacagcttgaaaggcctgagacagctgtctctgtgagggactgacgatgcaggatttcttcactcctcccctttgtgacttcaagagcctctggcatctcttatctgcaaagggca

SEQ ID NO: 601529 - DNA, 1183 bp, Homo sapiens
gttggtaacccgtagagggctgttgcgtagaggatgagactgggtcacatgcgggatcgagataggccgtaacgctgcgtgggggcgcgggcgaggtgtgggatggcggaaggcgggacagggagtgccgccagtgattgacgcgcgagtggactatgagcgggcaggccgcagtgacttcggtcgcaattgatcgcccagagaaccctgctggagctaggagctcgggacgtaaacggcggcagcggtattgtgaccagttatgcatgctgctagggtgtcgctcgtgagacgtccgggcaaccatgcgaccatcgtccacattccacgagtgtagctcactcatccgtcatcgatgtagtattgtgctaactcgtcgtaggcatggtaatcgcccgtcagaaaccagagcagggtagcccttacaggtcgacgaagcagtgcacaagtccattcctatggctcaagttgtcgacacactccagtgggctatcgcgtcgtatgatcctgaatctctgatgcactgcatgacccgcgtcccacggatgtctgcgacacagagagacgcaaggcgccgatgcttgagtttcctcggcgatcctcggctcctctttgtcaattcggacccagaatgagtgacgactacacaggacgttgggccatctcactctcggtagttgaatctcactttgttacccagggcagatacaattcacgggcacgcgcctccattgcggccttgaacgccacactatggggcatgcctgcctaggccgaccctcttagcaatcttctgtggccccgactctacacaatggccggcacagataacacaaagtcgctccaaccagcaaccttcgagtagccctgcaccttaccaatacacctgtgtaacaccagcacacccttgtggaactgccggcttcatcttgcccacccacgaacggttggaactgtaaacaagtttcccaacgcaaacgcagctacagagctcagatagaacattcgttagccctaccgtgaggatgcccctagcggtaacacacggactacacaccgcggcggccactcccagtcgcgcaaaacaaccgcgttgcctttcgccacgccgtttacgcacgacgcacacccttaccatcgttgcaaaggaaattccatattgacatgcgtccgcgatgcgtcc

SEQ ID NO: 601530 - DNA, 106 bp, Homo sapiens
tgtagaggatccccgtcatgggagatgtatgttattatattggttgatcatggagaacaaactgataaagggggattggttattatctgaaagaaggggtactgag

SEQ ID NO: 601531 - DNA, 151 bp, Homo sapiens
atcacagactatactagttccacaaaaggaagatcaacaaagcttttcaaaaataacatcatctttttaataactaaagtgttcacactgaagggtgaatggaagaaaggagtaagtttttggataaataagaattgtgggtgagcaggcc

SEQ ID NO: 601532 - DNA, 273 bp, Homo sapiens
tgggcccccccctgggtttcatgggctccttggggcctgaccttccccaagggtcctggagcatcccaatggaaaggggcaattccctgggggggttgggcagcctgctttgggcgggcctcccccttttcccatgctccccgccccaaaaactatgggttcgttttcgtgggccccggggaaaaaaacatgggcctgcccttcctgctataaaatgggggcccgcctgggtgttttttaacagagttttaacatgattttttttagcttcca

SEQ ID NO: 601533 - DNA, 280 bp, Homo sapiens
accggggccaatggacagaggcgatgtaaacacgtggtattctctctggcaaaggaaaggtggcccaggggcccaaagggggggctgccttgattgataaccggaaggctagggggggggggaggaagggggggtcaacaaaccgcccgtgttaataacaagggggggggtggtgtgtgggtgagggccgcttcttcttggtcgccaccaggacaaggcaaaacccacggggccaaagcagggaaaacaacgtcgctggcttaacaaaaactaagatttc

SEQ ID NO: 601534 - DNA, 145 bp, Homo sapiens
  misc_feature (78)..(78): n is a, c, g, or t
  misc_feature (99)..(99): n is a, c, g, or t
ggaggtgatatagaaaccactggatatctctcctttccttagacaactctggcagctgagctagaagccaacctcggnctcattgaagaaatttcaggntatctaaaatccgccgatcctacgctctggtgtcactttccttctt

SEQ ID NO: 601535 - DNA, 607 bp, Homo sapiens
ggctgtattcgtcttccctaggctatttccgccgggacgctccgcagaagatgcatgctcaatgccgatggagatcaagcccgaagatgctgaacaaaagtggctggtaaccggggctggcggagggctcggaccgggggcccaaggtgtgggaccggctttccgggagtggagaaccgttggcatgtggggagcggcttgggcaaaacgaaagcgggaaggatcttctggggaggcattccgggttggcccaaagtctgcctctgtgcccatttggaccgacccgacctgtggacttctggcatatgtcggcactggtgtcagttattttacacccccccttttcacaaatcgggtggcaccccacccataagggccgacaagtttggcaagtaaacactcgtttctaccagaggggatcaaacaaagaatgtccagagcacacttggggacgctgtaagccctttggagacgcgggtggcacccaatacggtacgccgctgactaaacggctccctcttataacaggtgtggttacctttctcaagcttgcaaggtgctgaagaaaacccaaagtgggggggacgaaaaatctttcccccgttcg

SEQ ID NO: 601536 - DNA, 156 bp, Homo sapiens
cacttcgaaagtgctaggattacaggcgtgagccaccatgcccaacgaaaagatccttttaatcggaaaatacatacacggtactgcatttcgggggcaatttaataaattatatattagtttcttcctctccatgtatctccggggcatggaaca

SEQ ID NO: 601537 - DNA, 89 bp, Homo sapiens
gcgtatctcagcttcgtgagaggtcatagcatattcatgacagggttaggagtaccctgcataatttatacaaatgtaaagtgtatatt

SEQ ID NO: 601538 - DNA, 1885 bp, Homo sapiens
ctccctcttcacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctcagggagccacggcccgtctagtcgactgtgacatgcacctccggccgtgtgtgcatcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaactacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttctgaaaacaacacaatacaaaa

SEQ ID NO: 601539 - DNA, 922 bp, Homo sapiens
cagatccaagatatcggtgagcaactcttgataatccatatcgagtcaaatggtaggcgtacctatcgaccgtgtggccaattcagcaggtgaagcaccatcaacgatctccagtttaagcttagaagccggattccaataggagtaagaattgtgcaatggaccacagagttgaattggccgaaaaggtgctatgggagtccatcaatggatctaatatagacgagtctcaactttagtcgcccaggccgggtagtgccggggggtcgtagatcatccagaataaggtgtacccagttgtgcctcccggggttcaaagcagaattctcccattgcctcgaggattcccctaagttcagcgtggggcatttacaaagtgtccaactgtgcaccaaatgcaccggggtgtaaataactagggtgacatctgcaacgtaggcagcaccagtgtataccaccaagggtttgcccggaggctcggggttgcagaaatcttcgtgtggcaccatcagtcttgcagtccaaaccctggccagtacggaccatgcccccaaaacgtgttgcttgggagtagtccaccagggcatttgtagccgcccacggagccggaaggcacattcagaaagaatggctcatacatagtgttccctggacattagttgtttgggaaatcaccctctgtgtcacccaatttctaaggacacacgtcgcccgctggtgtgggacacagcgcaaaagcttgcggcgcaaactctccgagagatgtactgaccggcgcagacaaatggctaagggggagttcccacacacgtggtcaaactacacgcatatggcgcaacagtggcatgcacgtggccacgctaacttagcgcactttcacattcgaacagactctttagatacctccatgcggctatctacc

SEQ ID NO: 601540 - DNA, 325 bp, Homo sapiens
ctgggcaacaaagtgagactccatgtcaaaaaaagaaaagaggccaggagcagtggctcatgcctataattccatcactttgggaggccgaggtgggtagatcacctgaggtcaggagttctagaccagcctggccaacatggtgaaaccccgtctctgctagagatacagaaaattagccaggtgtggtgttgtgtgcctgtaatcccagctgcacaggaggctgaggcaggagaattgcttgaacccgggatgcagaggctgcagtgagccgagatcgtgccattgcacgcccgcctgggctacaagagcaaagctccgtctc

SEQ ID NO: 601541 - DNA, 810 bp, Homo sapiens
  misc_feature (32)..(32): n is a, c, g, or t
  misc_feature (144)..(144): n is a, c, g, or t
  misc_feature (173)..(173): n is a, c, g, or t
  misc_feature (306)..(306): n is a, c, g, or t
  misc_feature (327)..(327): n is a, c, g, or t
  misc_feature (367)..(367): n is a, c, g, or t
  misc_feature (448)..(448): n is a, c, g, or t
  misc_feature (574)..(574): n is a, c, g, or t
  misc_feature (641)..(641): n is a, c, g, or t
  misc_feature (643)..(643): n is a, c, g, or t
  misc_feature (645)..(645): n is a, c, g, or t
  misc_feature (648)..(648): n is a, c, g, or t
  misc_feature (652)..(652): n is a, c, g, or t
  misc_feature (657)..(657): n is a, c, g, or t
  misc_feature (663)..(663): n is a, c, g, or t
  misc_feature (666)..(666): n is a, c, g, or t
  misc_feature (668)..(670): n is a, c, g, or t
  misc_feature (675)..(675): n is a, c, g, or t
  misc_feature (681)..(681): n is a, c, g, or t
  misc_feature (691)..(691): n is a, c, g, or t
  misc_feature (705)..(705): n is a, c, g, or t
  misc_feature (707)..(707): n is a, c, g, or t
  misc_feature (721)..(721): n is a, c, g, or t
  misc_feature (724)..(724): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (751)..(751): n is a, c, g, or t
  misc_feature (754)..(754): n is a, c, g, or t
  misc_feature (783)..(783): n is a, c, g, or t
gtaggaagtttttcataggaggtgtatgagtnggcgtagcggaacgggggtatgctgtcgaatcataagaacagggaggttagaagtagggcttggtgacaaaatatgttgtgtagagtcaggggagagtcgtcatatgttgtncctaggaagattgtagtggtgagggtgtntattataataatgtttgtgtatgcggctatgaagaatagggcgaaggggcctgcggcgtattcgatgttgaagcctgaaactagttcggactccccttcggcaaggtcgaagggggttcggttggtctctgcnagtgtggagataaatcatatnatggccaagggtcatgatggcaggagtaatcagaggtgtncttgtgtggtgataagggtggagaggttaaaggagccacttattagtaatgttgaaagtagaatgatggctagggtgactncatatgagactgtctgggctactgctcgcagtccgccgatcagggcgtagtttgagtttgatgctcaccctgatcagaggattgagttaacggctaggctagaggtggctagaataaataggaggnctaggttgaggttgactagggggttgggtatggggaggggggttcatagtagaagagcgatggtganancnaangtcngggcngtgatntanannnttatngtagangttgcgggtnttaggggctctttngntgaagagttttatngcnttaccaatttnttnttgttngcccgtntgngccttacaacgtttggggcctttgcgtantttgtatatagcctagaatttttcgtt

SEQ ID NO: 601542 - DNA, 990 bp, Homo sapiens
cttggtctctccagcctacacttcggaagtcggcgcaccgattagtgactacgcgatgattttaaagagcaaaataataggttttcccgtgcctgtcccacaggccctccagctcgaataatggacgaactgtcaatgcactccgagagctggtggcccattgctacgcccgctgatggcgaggcaggcgtactgggaggatcagcctggggctccttgccctctgatcccatcattcccaacatacacacgctgcaacagacgcgcctcctcgttcttctgcgtcagcttaaatggtgtaaacggaacacgcattaatatagactcgaatagagcaacaacgcatagacgtaagaagagaaaacctttcctagtgtaccatgatttctacacatcgctaactcctccactacacgttcagagagtcagggcgcagggtcggaaggggccaagaacgtgcctagccagagtcggaagaagaggggaggactatgcgtgcgtatggggaccgtgtaggacaccgccggcgcaaaaacgaagggaccgcaaggggcgacgctcggcaagtatcccaccctgaatcaatgcagttaggcaggcgctaagtggtccaacctcggtgagggcgcccatcgacgtgagcattggcccccgaggtcttctctgcccccgggcttcacagccccgaacacccatctgggcgacaccccgttgatgaacccggttgcccgcgttcagtttgaggggcccaactccgtatgaaaacaacggcaaggaccttacggtggtccccaaaatttgtcccctgtgcgaccttacgattgccaaagctctatgggctgaggagatgggacacaccttactaagcctagaataaaagggctcggatgggaacttattaaattgcaacataacttagggcccctaataggagtgaaaaccttgaattttaacctacccgctgaaacccaaacaaatttattaaaccag

SEQ ID NO: 601543 - DNA, 192 bp, Homo sapiens
ataactgtcctgacttagacttccctcccaaattctatgagcatgcaaggctctgtgggaggatgatggagtgctgtgcctgctacgaactgctccaacgagtaccagctgattgacttgtgcccatgtacttacctggcacaatgatctgactagtgactcaatgcattgcttgactcatgttgcctgagc

SEQ ID NO: 601544 - DNA, 263 bp, Homo sapiens
  misc_feature (35)..(35): n is a, c, g, or t
ataaaacacctcatgaaagaaattgagggaagacncccaaaaaatggaaagatatttcacgttcatgaactaaaagaatcaatattgtgaaaatgttcatattgcccaaagcagtctgtagattcaacgtaatccctatcaaaataccaatgacatttttcacagagatagaaaaaacaggctgggcaaggtggctcatgcctataatcccagtactttaagaagccaaggtaggtggactgtctgagcccaagaggtttcaa

SEQ ID NO: 601545 - DNA, 462 bp, Homo sapiens
ggggtcgatctgtctggagcataacccaacaggcgatttttcgtgccactcccatccctgcatgcactgatccgcagttcctataccctacccctgacctattgagcagcctctgaagatccatatgggcccccacctttactcacaccctgagaattctgggagccagtctgccatgaccaggagtcacgtggacatgttcatcctagaatcctgtcacactacagtcatttcttttcctctctctggcccttgggtcctgggaatagctcgcttgccttcaaccccacgagcgctaatgaactggcagccgttctcctaacatgttgagagatagattcgtttcttgggcctggccatacatcgggcagcattgatggcaatcctaggaaaggggttaaatctccattctgtgagatgttggtggggaagggaagggtaaatagattgtactaaacaata

SEQ ID NO: 601546 - DNA, 550 bp, Homo sapiens
cggtacgacgaagcgtagaacacaatccactaggttacggggactcagatttaagagtagccagtttactacttgaggtggccctccaggacacccacagagctaaaagcccaacaggaaccacgactgaccctgatttatgacaggagtaacatatcctttctttagatagtcgacagagtctggggctctaccttcccattctgggatataaagggtgtcattactgcgggaatgagacaggggtactttgagtccagtcatcttctgaaccacctcttcactggtcatgtcccccaagtggttcatagccagttcatatgtatggacaccaagagaagcctcaaggttatggatggaaatatacttcaagttttttttcccaaattaaacgccgagagatttcatccaccttgttgttatatggcttcctgtgggtcttcttccatagctcccagtgggtgtccagtatctcctcagggtacagagcaaagctcaccacaggtagcagcagaaccttgagcccccaaatcctgctgatggaaatctg

SEQ ID NO: 601547 - DNA, 464 bp, Homo sapiens
caggcagaaagagattcatcggaccagtcgtcctcatcaaatacagaggagtcatcttctgagtcactgttctcaaccagcaatgcgactagacaagatggtggccacgtcatgtgctgggcgctgtgtgtgtggacccatgttgaccttgagcgttgtcggtggaggaatcgtgcctgttggcattgagtggatggaggcagaagtggccatctgtgcatgggtaggggtgatgactgtgtgagtacttggagtcaccaaagaggtggagaaaggtggaacgtgagtgggaagtgtggtctgagggtgtgatggggttggataggtagtggtggtctggaaggatgttgcagtcataggacctgtggaagagaagggactgctccctgtaggtgaggagtgtgtggtgaagggtgtggttagcctgctgctggtggctgaggtggtctgggccagtactgggt

SEQ ID NO: 601548 - DNA, 422 bp, Homo sapiens
  misc_feature (1)..(1): n is a, c, g, or t
  misc_feature (40)..(40): n is a, c, g, or t
  misc_feature (89)..(89): n is a, c, g, or t
  misc_feature (160)..(161): n is a, c, g, or t
  misc_feature (269)..(269): n is a, c, g, or t
  misc_feature (345)..(345): n is a, c, g, or t
  misc_feature (351)..(351): n is a, c, g, or t
  misc_feature (399)..(399): n is a, c, g, or t
  misc_feature (420)..(420): n is a, c, g, or t
ntggagagataccatttaagttgagatttcagtggggacncagccaaaccatatcattctacccctggcacctccaaatctcatgtccncacatttcaaaaccaatcatgccttcccaacagtcccccaaagtcttaactcatttcagcattaacccaanngtccgcagtccaaagtttcatctgagacaaggcaagtcccttccagttatgaacctgtaaaatcaaaagtaaactagttacttcctagatacaatgggggtacaggtnttgggtaaatacagccattccaaatgggagaaattggccaacacaaaagggtaacagggcccatgcaagtccaaanttcagnaggggagtcaatttttaacccccaaaatgatcacctgggatccacgtntcacaatcatctctctgagtnga

SEQ ID NO: 601549 - DNA, 242 bp, Homo sapiens
gggttacaagtcacagaggggaggtgatagcatgtctcgtgtaaattatgtaatgcaaaatttgtttactcttcgccttcatactttcggtatttcgtgggatggagaatgatgagccttcgtgccccgcccttccccctttttagtcccccaacttgagatgtatgaaggctttgggtctccctgggagtgggtggaggcagccagggcgttacctgtacactgacttgcgcacaggcgta

SEQ ID NO: 601550 - DNA, 204 bp, Homo sapiens
cggttccatgcgtcatgatgcagctcagtgttcgatgcgggtggagtgctcagacggacaacggctcgaactggctgcgcgtgacctgcgcctgtagtaactcgaaccaggggatcgtgctcgccctcgaggtagaactgcaaccgcgaccagagcgccttgatgttgtcggcatcgttgagcaccttcttcttgacatggtct

SEQ ID NO: 601551 - DNA, 242 bp, Homo sapiens
  misc_feature (139)..(139): n is a, c, g, or t
acttagaggatctggcacaccgctacggacgctgtagggtcagcaggaggcaagaggtagagctctggccaggaacgctctgcctagagagatgcctctgcagctggccctatgatcgggcgactcagtgtgagtatcntgcctaaggaccaaggagaaccaacagcctgcccaggtgtggcttgtgaggtcacacagtcctcatgagtctcctggacaggaaatgcggtagcgggttgttg

SEQ ID NO: 601552 - DNA, 268 bp, Homo sapiens
gaggaaacacaaccatctaccctctgattctatgagttaaattttacttgcaatatccacatataagtgagatcatgtagtatttctctttctgtgcctggcttctttcacttagcataattccttccaggttcatccatgttgtcacaaatgacaggatttccttctttcataaggctcaatagtattccacagtatatatcaatatattttctattttttctttttttatcatttcaactttcattttagattcaggggtacatgt

SEQ ID NO: 601553 - DNA, 186 bp, Homo sapiens
acgtgatacgcgagcatgcccttctaaaagggatgccgcctttgagctggtctccatagtcctgggtgagcactactaggtggtaggtcacatggaaatcccttctatgagtgtggacattcggcgtctacaacttcgtccatagtgatttgatttcaagaagtgtatggtcattcggcgtgtgca

SEQ ID NO: 601554 - DNA, 197 bp, Homo sapiens
tgtcttttgtggtttcctgcacatttttgggggggttatggcttctccgtttttccccccttaaactgccttgcctattcttttttcctgacatgatctcaggtatcagtgtgttgaatacatcctgcttgtgtctcagacttacgttactgtcttcaccattaaaaaaattgcagccttgtgccccatgaccttca

SEQ ID NO: 601555 - DNA, 351 bp, Homo sapiens
ggtcgacgaaaaacattgctatttctatcaattaacgtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcacgtggatcacctggggtcgggagttcaagaccagcctggccaacatggtgaaaccccatctctgctaaaaatacaaaaattagctaggtgtggtggtacatg

SEQ ID NO: 601556 - DNA, 245 bp, Homo sapiens
ctctgctgtgttgggttgccagtgcgggtactcctgacttgtcggttgctctgtcgactatggggctgttaattgtcagttcagtgttttactctgccgcaggcttctgcggaggagaatgttttcctgttccttatactaccattcagttcttctcatagggtgcatcagcatgggtcccaataggggtgtgcaggcagtccagttcatcatgtctcatcttatttcttttttaaggcaccacc

SEQ ID NO: 601557 - DNA, 714 bp, Homo sapiens
agaccgaacccctgtattcagacagcaaaaaccacgctgggctccatatgtggtcaacagtggtcacggacagatggctgagattgctgtgaatgccgtcctcactgggagcagatatggagcggagagacgttgactttgatgccttatcaggaagatagaaaggctgaaggtgggcaggctagggcctggtaggacacctaatacttgagttaagggcgtgacttgtggacaaggattttcagtcaccgcactatgagtgccaataaaaagtggacagatgctgagagagttgcaactgtctcagcatgtcctattgtgcaagccaccccacaacccatgaagacaacagcatcaagcgtggatggtgaccatctggtcgaagtattattaagcccatgttcgagaaatacgaaagaggagaggattatgaatgtagatgtattcgatacgagaattgaaagaggactggctgcgtaacctaggcagatttgtcagtggaggcggttttgatgaatgaagcaaatcacttacttcttcgagaacgaatcttgccgtgcgggttcgctggcgtagtgaggacctgtaatattgagctgtattgccatcgcaaccaggagggcggatcgtccccaggttctcagagctcacagccgagaagctgggctttgctggtcttgtccaggagatctccatttgggacacctaggatac

SEQ ID NO: 601558 - DNA, 173 bp, Homo sapiens
aggggactctgaggatcccaaagacgccaaaatcatcaaatccgctataaatatttacagagtatgataaaacattgaattcgatctattacttcacctcggtttcacagcacttatgcccgttttacacaagttaactatctcttgcatattagactacactcgtgagacat

SEQ ID NO: 601559 - DNA, 5360 bp, Homo sapiens
cttccagtctctgctgatgtgatttcagatgggcgcggctccagaccatcccctgcaatggccagttacgcagcctctccgagccactgcctctctgtggaaggagggcctgaggctgacggggagcagccgcctcgcttggccactctgggacctggggtgatggagggtgcagcggagactgaccaggaggctctgtgtgcaggggagactggggcccagaagccacctggagatcggatgctgtgtccagggaggatggatggtgcagctctgggggaacagccaactgggcagaagggagcctcggcaagggggttctggggaccaagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagacacccagggtggagtccaggggcctgaaggccccactcctgatgcctctggctccagtgccaaggatcctccaagcttgtttgatgatgaggtctctttctcccagctcttccctccaggcggtcgcttgactagaaagaggaacccgcgtgtctacgggaagcgctgtgagaagccggtgctcccgctgccaacccagcccagctttgaggagggcggtgaccccacgctgggcccagcccgcctgcccacggacctcagcgactccagctccctctgcctctgccatgaggacccgtgggaggacgaggatcccgcaggtctgcccgagtccttcctcctggatgggttcctcaatagcagggtgcctggcattgacccctgggcccccggcctcagcctgtgggccctggagcccagcagggaagctggtgcagagaagctgccctcccactgccccgaggacgatcggccggaggccattcctgagctgcacatggtcccagcggcttggcgaggcctggagatgccggcccctgccgatgactcctcctcttctctcggagatgtgagccccgagccccccagcctggagagagaacgctgtgacggtgggcttcccgggaacacccacctgctgccgctccgtgccacggactttgaggtgctcagcaccaagtttgagatgcaagacctgtgctttctgggaccctttgaagaccccgtgggtctccccggccccagcttcttagacttcgagggcacggcgagctcacaggggccacagagccgaaggacagaggaggctgcaggggcagggagggcccaaggcagaggccggccggccaagggcaggcgggcctcctacaagtgcaaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcaggggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcgcctctgccaccgccctggctgacgccggcagcccgggcccccccaggacgacccccagcccgtcccccgacccctgggccggcggggagcccctcctgcaagccaccccggtgcacgaggcctgcaaggacccctcccgcgactgccaccactgcgggaagcgcttccccaagcccttcaagctgcagcgccacctggcggtgcacagcccgcagcgcgtctacctgtgcccccggtgcccccgggtctaccccgagcacggggagctgctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcccctgaccatttccaggaagaccacctacttcagaaagagaaggaggtgtcctcaagccacatggtgtctgagggggggccccgaggcgccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggcccgtggcacagagaatgggatgaagcccgccacccccaaagccaaacccggccccagctcccagggcagtggaagccctcgccccggcaccaagacaggaggtggcagccagccccagccagccagcgggcagctccagagcgagacagccaccaccccagccaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccgcacacccaccggacggccgaggcccagagtgacctcctcagccagctcttcgggcagagactaactggcttcaaaatccctttaaagaaagatgcttctgagtaatttctagaagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgcctcctccctctgaccacagggtcatgccagcctccatttgcgctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccacctatttgcaatgttactctgaagtttctggtgctatttttgtgttgtaatgtgaatacaggcttccttgattttttttttaatgggggtattgggtgggacagacggggtcagggaggccccaccatggcttgtcgagggcacgggcacctgcatggcggcgctctccctgcctcccctgccgggctgcaagcctgaggtctgtgctgccggacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgc

SEQ ID NO: 601560 - DNA, 187 bp, Homo sapiens
gaggggtctgagtcaggaagacaggcaggaacatgaaatatatgctcgatatctgggagagatgggataacactcggtcacccaggccgagagtgcagggtgccatcgataggtcactttagacccccaccgtccatggattcaatgcgatccattccggcctcagatctgccaaggtagctgggag

SEQ ID NO: 601561 - DNA, 721 bp, Homo sapiens
agcggcgcaagctggagtgtggtggcgcgaacatggctcactgcaaccttgagctcctgggctcaagagatccacctgcttcagattttcatttagctgggaccacaggcatgtgccaccatgaccggctaattttttttacttttcagagagaggagggggaatctcactttgttgccaggctggtctcgaactcctgggctcaagcaatccacctgcctcggtggccagagtgctgggattacaggtgtgagttttttttattgtttcaaagagacagtcttacctcattcggtgtcacccagaaagtggaatgactttctaaaatggcagaaagcagaacatattcctgtgcgtgtttataatattatagtcgtatcaaagggaaagagtatttctccttaaataaaattacaaataagaaagtgtagtgtttaacatcttactcataaaaggtatggtcagaatacaaaaggtttttcaaacgggtttggtacttggatgggcttttataagtccacacttcaaagaagaaatgctttcaacttttaataccttagtcaacaacagtataaggtggccttgcctggcataacctttaactatggcaaatgatcgttggtccttccccttggtccagtatctccaaagggtcaacagttgaaacattaaccttgcactgagaaaccttgccacatttcaggagttggtaagctaaggg

SEQ ID NO: 601562 - DNA, 1034 bp, Homo sapiens
gccagttactagaataaaatcatctactttaaaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgcgtacacgttatacttctgcccggggggggcccactactcgagtcagaacgacccaacttgtattgtgtggaaaaaaggagggtgccacctacaaaggggacatcactactaaaaaacaaacacggcgcgggcgcgcgcgacacaaaacaaacagcagcgcggcaggtcggaagcacgaagactgagggcagcgggctacttgtcgtgaggagaaccaccccccgtctcggggggggggaacagaaactagaggcgccaaaaacaaccacatcggagacagatagaagtgacgccaccgccgacgggggagcaactactaaactcgacctgggaggggcagaatagggaggagtgcaccaccaccaagcgcctagtaactcgtgtggaccggcggccgaagaaaaacagcgagctcccaaagaaggaccactcatgcccgatacagcttaccaccaccacaggcggcggcgtccaaggtaccaaccacacgcccgcacgagcaaccaccaacccccagacctgcaccagacacaccgaacggaacacacaaccaccaggaagaggaggaggcgcgaggccgacctaggaagcctcgagaagagacagacgggacgcagagtggtcgcgacggatcgagcacaggcgcaaggcgcaagacggagcggcacgcgaggggggagagggccgacaggaggaggcgcggccaggcgcagagccaacgcagagcagcgagcggggcagacgcacaccagcaacgaacaggcagagaaccaacggaaagccggacgcacggagagacacgacaagggcagcaggcggggcagcgagaagcgggcaaccggagcgagcgaggcaggcaaaggca

SEQ ID NO: 601563 - DNA, 307 bp, Homo sapiens
gcctcccaaagttctgggactacaggcgtgaaccaccgtccccggcttgcgttctttttcttaaagagtcccacctgcggatcacgagatcaggagatcgagaccatcctggcccgtctctactaaaaataaaataaaataaaataaataaattagccgggcgtggttcgtggcgcctgcagtcccaggtactcgggaggctgaggcaggagaatggcatgaacccgggagacggagtgagccgagatcgcgccacggcacccagcctgggcgacagagcaagactccatctcaaaaaataaaagtt

SEQ ID NO: 601564 - DNA, 610 bp, Homo sapiens
tcggcgcagcatttgggtggctctctctttcttgtaggtgtgaggtttgtgctacctgttttgacacgccgggtgcgtcggttcctaatcccgctggtgggtcgttacccgccccgcgcgcctcttgtcccccgtcctcggtatactggcggtgtgcccactcatttggtggccgcccccccctcttccgggggaggcaaacaagtgacgtcccggtgctggcacccctctcaggcgcccaccttggcttgtttttgatattcattccttactagtaattatatttttctaccccctgtgtactagttctaaataataaataaggaagacacccgtcccccccctcattaattgtcccgtagaaaatcttttctccctctcttcgctatttaccaatataaataagtctcacattcattaggttgaacatgtgctaaccttctgagtgtgcaagcacgagatgggattgccacgagtgcgggtgtactccactgttttcagagaataattcggaggttcattcgccgtttttccccgcgtgtttctggttgtatgttaaaggaggaagacagaaagaattggaccacaaggagaacaaataaggcaagaa

SEQ ID NO: 601565 - DNA, 337 bp, Homo sapiens
gcacgagtaaaaatctaacaaacagattttgctttttaaaggtcttttcttggccaggtacagtggctcacgcctgtaagcccagcacttaggagactgagattggaggatcactttagcccaggagttcaagaccagcctgggcaacagagtgagacccctgtctctatttaaaaaaaaattgtttttaattagccaggtgtggtggcgcttgcctatagtcccagctactcagggactgaagcaggagaatcacttgagcccaggagtccaagttgcattgagctacgattgtgccactgtatttagcctgggcaacaaagtaagaccttgtctc

SEQ ID NO: 601566 - DNA, 239 bp, Homo sapiens
tgaggtgactctacaggatcttggtcgaccggggattacaggccctgccacatgccggctaattttttgtatttttagtagaggcagggtttcacccatgttgggccagtgctggtctcaaactaccagacctcgggtgatccatcctcttcggcttcccaaagtgctgggattacaggcatgcgccaccacgcccagcctttcaggcagctttctaagcagcgctccatgacatttga

SEQ ID NO: 601567 - DNA, 100 bp, Homo sapiens
ccccccgacccttccgtaatgccaccaggaacaactcggcccttcagttgaacatatgtggagtttccaggaggcctctcagagcctgaagaagatttgg

SEQ ID NO: 601568 - DNA, 151 bp, Homo sapiens
cgcattgcagagtgcacaggaacagtatctacaaaagctcaaatgctcagagaggattgaaactagatagtctaggctggagagtcatgtacaaaggggatggaaggctagagagatgagtgctggcaaagttccagttgtcggcactgga

SEQ ID NO: 601569 - DNA, 346 bp, Homo sapiens
ctatatcccttgcaggtactatatctattgcagccaggtttcactttctatcgcctatactttatttgggtaaatggtttggcataaggttgtattctattagactatggtgagctcaggtgattgatactcctgatgcgagtaatacggactgtgtttacggacgtgggacttttacggggactttagcggggtgactgcctgtcgggggccagtgccctcctaattggggagtacggggacgggacaagattaggagaaatacttaatataggtgacgggttgacgggtgcagcagaacaccagggaatgtgtatacctatgtaacaaaactgcatgttctgca

SEQ ID NO: 601570 - DNA, 191 bp, Homo sapiens
tctcatcttctagaatccagatcagacctaccttcagttcaacaaagccaaattatgacttatatgaagaaatggggaaagtcaagaaaatagatgcttctacagtctgtcggatgaacgttgctggatgaagttgtggcagattttatgacaaggaaaggactaattctaagaccgtgaaaggcatcctg

SEQ ID NO: 601571 - DNA, 364 bp, Homo sapiens
cggggctggttgtggtgcatgcagaggtcggcaccacctccaaatactttgtgagcagcggttccatcgcagtgaacgccgactcttcggtgcagttgttggcccaaaaagcccgttaccgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagtttgggagccacctttggatgaattgcccccagcccccgccccattaaagacccggaagcatgaaaaaaaa

SEQ ID NO: 601572 - DNA, 120 bp, Homo sapiens
ccaaactgctgggataacaggcatgagccagcatgcccagccaaataataaaacttgagagtcaaaatcactctctgatgcatgggttgcagagtaagtgttgtgtagcagttatgaaac

SEQ ID NO: 601573 - DNA, 1069 bp, Homo sapiens
  misc_feature (895)..(895): n is a, c, g, or t
ttgttttataaaatatttgcaacgcccacaaagatattctataacccccctgtggccacccttggtgttcaaaccccccataatttttcacagcggtccccttagggtgtgcccaccccctcgtgtgagtaaagaattccttccgtttaaacaacacttccccaaaaaatatataggggctgggaaatttctgtttctcaagcgtaatacgcgcgactccacaaacttttctgtcgcggaaagaatatatacacggttccccccccgcgtttataaattggtctggggtgtccacaattaatatagtgcacgcgccccagttgatttctccccaccccacttagggcacccacccccaaacccccccacggggacaacacgtgttggggtgtcgcacacatgtaaaagttgagggagctcccccacaatggtgcgcccctcaccacagcgttcatcaaaggtgttttacacacgcggccacagagaggccgctcagacttttgacacagtgtcgtgccacacgctctggttaaagagagcgttccacaatttccctgacaacacctctatgccacgcgtgtctcgcgaatggttctcttaatgtttaatcccacctccattatatatcgcgggtctccacagaaacacattctttatgttatcccacccccatatatatgaatgttctacgtcacccacaaaaaatcgttgccccactgaatatcactcccaaaagccgcattgtgacaaagagtaaacgctgtgagatgtgatgatgatgacgccagtgatgatgacatgatgaactatgagtataattctgcgtagtttatgccccctgcctgaaaagttaccacacgagataaacgctgggttttgaaattcccttggttcncgagtagttacaacacagcactcgctggagaggtttttccaacgtgggttttagagaaacctattataagaggggtcaccccggtcgccaacagtttccaatgaaatgaagagttttttatccccccttataagagtgttaaggaaaaaataaggttttctccctcattctgga

SEQ ID NO: 601574 - DNA, 407 bp, Homo sapiens
aaagtcaggagttcaagaacagcctgaccaccatggtgaaaccacatctctactaaaactaccaccagtagccgggcatggtggcacacaactgtagtcctcagctacttgaaaggctgaggcgggagaatcatatgaacctggaaggtagcggttgcaatgagccgagatcactccactgcaatccagcccgggcaatatagcaagactgtcagaaaaacaaaaacaaaacaaaaaaccacactagccattcaattgacagagagaaaactaattatttccttcagtttaactgtagaaccgtggctaccaaaagaaatcaccttggtcagattctgagttttttacttcaggaagacatctgaggaactaccagtgattactactatcaaccttgatcagataga

SEQ ID NO: 601575 - DNA, 319 bp, Homo sapiens
gtgcacagcacacgttccacgacagatgaggcgacggcttccatctgcctctcccagtggagccatataggcaccacctgattcttacagcaacatgtgacaacatgcaaggaggtcttccaatacttccaaccaggagcagctaacttggggttctttttgtccagagttttttgtttgcttgagacaagggcttgctcttttgcagcttggagtacaagtggtgagatcacagttaattcaagccttgaatctaacgccaagtatccttccacctcagcctcctgagtagctatgactacagtgtgctccaccacgc

SEQ ID NO: 601576 - DNA, 704 bp, Homo sapiens
agcggggaacccacagcccagcagggtccaccctcaccaggtcacttcggcccaagtcttcagagccctccatgctcccaacacggactctgtcagctccttcctgacccgcagccgccaacctaacaccactccctctgtaggtagctccagccccacacacctgctccttccctgggcccgctaaaggcatctcccagggcagtgctggtgcacgcgacgccacactggacgctttcccctcgtgacctccctccatcctcatcaactctttctgtcactgctccctaaatgcccgcccctgctccatctgtcctgttctctggggcatcccaggccaagcctagcgctgacacagaacagcggctgcctgggggcccacagcctccccgggaatcagccaggcaccctgtgtcctgcctgcccgctgcagcccaggggcgcagagagcgtgtgatggtcacacacaggcaccatccgggatgtggccacctgccaccagctgtcccttgggaagacagacctctcctgtgtgcttgcggggagaaggggggtgttatttttcttttgctcccagaacacaattcacccccacccgccctctcaggtgtgagcaaggtccctccagacaggctctctggccactgcctgttcctcctctacagagagcagcttggcaggtcaaaccctcaggacagacccca

SEQ ID NO: 601577 - DNA, 470 bp, Homo sapiens
cacatcccactgaggagcgggcgtcctgcctcatcttagagtcaaaggcagaggggctgccaggccctgatggggtatttttggtgtcacctgaagtccctctgacatcaccttgtttcatcatttgttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacaggtgcagcgtagaaggggtaccgcgct

SEQ ID NO: 601578 - DNA, 870 bp, Homo sapiens
gctctttcccttcggtgtggtgagtaagcgcagtgtcgtctcttgcggtgccgttgctggttctcacacctttaggtctgttctcgtcttccgttccgactctctctttttcgtttgcagccactgaagatcctggtgtcgccatgggccgcgcccgccggttgttaccggtatggtaagaacaagccgtacccaaagtctcgcttctgccgaggtgtcccttgatgccaagattcgcattttgacctggggcggaaaaaggcaaaagtggatgagtttccgcttgtggccacatggtgtcagatgaatatgagcagtgtcctctgaagccctggaggtctgcccgaattgtgtgccaataaagtacatggtacaaaagtgggtggcaaagatggtttccatatcgggtgcgggctccaccccttccacgtcatccgcatcacaaagatgtgtgtcctgtgctgggtctgacaggctcaaacaggcatgcgaagggggcttgtggaaagccccaggcaatgtgccaggggttcacatggccaaagttatcatgtccatccgcaccaagctgcagaacaaggagccatgtgatgaggcctgagcagggccaagttcaagttcctggcgcagaagatcacatctaaagaagtggggttcacacgttcaatgcgatgattgacgcacggggtgaaagcggtcacccaaagtggggcagaatccaaggggcctggaagtggggctgacatggggtcaggggccctaaacgccaaaatattcgcgaaaaaacaagaaagacaaaaaaaaagggggcgaaaaaaagggcggaaaagagcacgagaggtaagcagggaagggagcgaaaccgcgaag

SEQ ID NO: 601579 - DNA, 273 bp, Homo sapiens
gatcggcagtatgaagatctgtctgtttttgctaggaacaggctactgggatataccccataatctccaaccaggatcatcacagggagccccattgtacaacttaggtgcttccagcgtgggtggctcctaaggggcccctagcaatcccgtcctggagttcatgcctgtctagcccccatctctttaagtgtgggcaggaaccagacaacccggtctacagagacaaatacattaagagtgaggggaaatgctcagatccacgttatgtgc

SEQ ID NO: 601580 - DNA, 115 bp, Homo sapiens
ggatttgctggtgcagtacaactaggcttaatagggacatgatgtatgcaagtgtgtggtgcacatattatgtttgtggttactttaacttgtagatcataaactgtgtgtcaaa

SEQ ID NO: 601581 - DNA, 897 bp, Homo sapiens
  misc_feature (8)..(8): n is a, c, g, or t
  misc_feature (247)..(247): n is a, c, g, or t
  misc_feature (254)..(254): n is a, c, g, or t
  misc_feature (256)..(256): n is a, c, g, or t
  misc_feature (272)..(273): n is a, c, g, or t
  misc_feature (275)..(275): n is a, c, g, or t
  misc_feature (278)..(278): n is a, c, g, or t
  misc_feature (287)..(287): n is a, c, g, or t
  misc_feature (291)..(291): n is a, c, g, or t
  misc_feature (305)..(305): n is a, c, g, or t
  misc_feature (316)..(316): n is a, c, g, or t
  misc_feature (324)..(324): n is a, c, g, or t
  misc_feature (353)..(353): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (377)..(378): n is a, c, g, or t
  misc_feature (394)..(397): n is a, c, g, or t
  misc_feature (403)..(403): n is a, c, g, or t
  misc_feature (416)..(416): n is a, c, g, or t
  misc_feature (433)..(433): n is a, c, g, or t
  misc_feature (441)..(441): n is a, c, g, or t
  misc_feature (453)..(454): n is a, c, g, or t
  misc_feature (456)..(456): n is a, c, g, or t
  misc_feature (459)..(460): n is a, c, g, or t
  misc_feature (468)..(471): n is a, c, g, or t
  misc_feature (481)..(481): n is a, c, g, or t
  misc_feature (503)..(503): n is a, c, g, or t
  misc_feature (505)..(505): n is a, c, g, or t
  misc_feature (508)..(508): n is a, c, g, or t
  misc_feature (511)..(512): n is a, c, g, or t
  misc_feature (514)..(514): n is a, c, g, or t
  misc_feature (516)..(516): n is a, c, g, or t
  misc_feature (524)..(524): n is a, c, g, or t
  misc_feature (532)..(532): n is a, c, g, or t
  misc_feature (536)..(536): n is a, c, g, or t
  misc_feature (540)..(540): n is a, c, g, or t
  misc_feature (557)..(557): n is a, c, g, or t
  misc_feature (581)..(581): n is a, c, g, or t
  misc_feature (586)..(586): n is a, c, g, or t
  misc_feature (600)..(600): n is a, c, g, or t
  misc_feature (606)..(606): n is a, c, g, or t
  misc_feature (612)..(612): n is a, c, g, or t
  misc_feature (634)..(634): n is a, c, g, or t
  misc_feature (636)..(636): n is a, c, g, or t
  misc_feature (641)..(642): n is a, c, g, or t
  misc_feature (651)..(651): n is a, c, g, or t
  misc_feature (661)..(661): n is a, c, g, or t
  misc_feature (668)..(668): n is a, c, g, or t
  misc_feature (670)..(670): n is a, c, g, or t
  misc_feature (680)..(680): n is a, c, g, or t
  misc_feature (682)..(682): n is a, c, g, or t
  misc_feature (685)..(685): n is a, c, g, or t
  misc_feature (715)..(716): n is a, c, g, or t
  misc_feature (718)..(718): n is a, c, g, or t
  misc_feature (721)..(721): n is a, c, g, or t
  misc_feature (735)..(735): n is a, c, g, or t
  misc_feature (749)..(749): n is a, c, g, or t
  misc_feature (758)..(758): n is a, c, g, or t
  misc_feature (761)..(761): n is a, c, g, or t
  misc_feature (781)..(781): n is a, c, g, or t
  misc_feature (792)..(792): n is a, c, g, or t
  misc_feature (797)..(798): n is a, c, g, or t
  misc_feature (802)..(802): n is a, c, g, or t
  misc_feature (807)..(807): n is a, c, g, or t
  misc_feature (822)..(822): n is a, c, g, or t
  misc_feature (826)..(826): n is a, c, g, or t
  misc_feature (828)..(828): n is a, c, g, or t
  misc_feature (834)..(834): n is a, c, g, or t
  misc_feature (879)..(879): n is a, c, g, or t
actgtganaaaaatagttcaaaagtagactgtacatactttgttacataatcaggaagttgacaaaagattaatagaaaaacagaacagtaacaatgaattgtacaagtgaattaaaagcagaaaccaactgaaaagacaggctgcctctgtctctggatctgctgcacaataaataccacgccatggtctgacacactttgctggcttgttaatatgccatttaaaaagtaaaagccacatctgcnacttacncnatccaaaatggctagnncntcnaagtctaanaatntcccactaggttcnttctttaaacntgtttacnaacaaatgtaaaaagatgatttacataanacanatnangcctttattaccccnnccctcccctcctttcnnnntctccncccttcatccacnctctccccccccttccnccatcacnccctcctccttnntnctnnccctaacnnnncccacatccntctctctccaccccctcccaancnccncanncncncaacaccntccccccnctanactngtccccacgttaccccntcccgcagtctctccagctgaganaactnctcccagctcacantctcanccactnaagacaagctccccaaatccananactannctaccaaanccttaaccantgctacncncttctcatantnttntcatactcttttcagtccacatcttattannanctnatatttaacaccanccattttaaatctnttcatgctncanaataaagcatctcttgctanaaaaactacanttaanntcantcatnaaaatacaacaattncttnanattacntatccttatttcaccatcattcctctacactaccctccctccctnaaccataatccacatccc

SEQ ID NO: 601582 - DNA, 921 bp, Homo sapiens
ggcggccaggcagatcagctgaggctggctggtttgtgaccagcctggccaatcatggtgaaacttcatcgtctacgtgaaaatacaaagaaaagaaaaagttagctggacatggtggtgcaagcttgtagtccccgctacttgggaggccgaggcaggagaatctcttgaacctggaaggcagaggttgcatgtgagcagaggtcgcgccactgcactccagcctgggtgacagagtgagacttctgtcgttagaaaaaacaaaagttaactagaaattgtctcatatgcttataaattagtaaaccctttcaaaagcctgggaaggtaggcgcagaacaatttctccgatatactggttcactgcagaacctggggagctccgttaaccaagataactgtagtgagtgtctgtcaacaaagtgcaagagacatataaaactaaacgaaaaacatccaataaaactactgttggttgcggaccgccgcttgtgcgtgctcagcttgagtgaagaggacttttcttaaggacaccacttgtgtgtgtggggggcgcgcgcgcggggggcccccccacatgtgtgtttttcacggtggcaccacaccgtgggggtcctcacacaaggcgggtggttcccccccggagagagaaaaaccccggcgggatcagtcagaacaatacgggcggccgcgggaaagattctcccctccacacgaagtagtaaaaaaaacaaaccgcgccgccggcggggggaccaccaccaggaggggcgtgtttcttggtgaaaacaaaatctctctccacagagtggaggacgttatggacggagacgcacaataaggcgggggagatctctctacactcccacgggagggatctccagagagcgaaacgccgcaaaattttttcaattttcgccc

SEQ ID NO: 601583 - DNA, 451 bp, Homo sapiens
ctaagacgacagctcgtcctgttgcgcagactgtagtgcagtggcggtgatctctgctcactgcaacctcagcctgccctggttcaagcgattctcatgcctcaggctcccgagcagttgggattacaggtgcccaccaccacacccagctaattattgtatttttacgtaaagacagggttccgccatgttggccagtgctgttttgacaccccctggcctccagcagtccgcccactctggccttcccaaagtgctggctttacaggcgtgagccactgcccccagcctgatttcctgtttttctcattagtgtttaattcccgtgtatagtgctggtacctgaactcagttctgctccagtctgcctttcaccgaatcacatgcaggtacggcctgcatgcaggaggctcgcgaaatttagatggctgagttgcatggggttcctgtc

SEQ ID NO: 601584 - DNA, 634 bp, Homo sapiens
cttgtcatatgagaaactcagacaaagaagttaactacaaaatggatagagctacatgcagagctacaactatgaaacagaagaaaatactgggggtaaatcttcataatcttcaattttgcaatggtctcttggatatgacaccaacaagcacacagcaacaacaatgaacatcagcataaacgtggcaccccgatcgacaaattcaaacattcattggtgcgtgccacgtgcatacccatctaatcaaagtgcaaacaaacaattcctggcaatgggcagcaaaatatttgtaattaatttattttatagtggcttcatgtctattatatatacagaactcctgaaactgtaatcaaatgagataacccatttcaaaatgggcaaagaactggaatagcataatttccaaagaaatacaagtggccaaggaagtacattaaaaaaatgctcaacatcattagtcagaatgtaaacacatcaaaatcacgagatacttcaaacccactaggatggctataaaaaaagacatacaataacaagtgtaagattgccatatacatgattcactcattatcagccactactgaactgccagcttaggaagttaggaagctctgagttgatgtctaat

SEQ ID NO: 601585 - DNA, 315 bp, Homo sapiens
gcaggtcaaaatgattttcctgcatcagcctcctgagtagctgggactacaggtgcgtgccaccatgcctggataatttttgtatttttagtagagatggggtttcatcgtgttaaccaggatggtctgaatctcctgacctggtgatctacccacctcagcctccctagttttttaacagataatttctatctctttatcattatcttctatatggtaagacattgttcttctactttcttttatttctttagacatgctttcttttagtattttgaacatatttaaaatagctgatttaaagtctctgtttag

SEQ ID NO: 601586 - DNA, 473 bp, Homo sapiens
  misc_feature (285)..(285): n is a, c, g, or t
  misc_feature (424)..(424): n is a, c, g, or t
aatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcccaacacagagattttaaaaaagtgttttgtgtaaaattccaacaccncccggtctttgttttttccccaaaggaaaggtgtttggtgatttttgtttccctccatacctcgccagtgcagtaaaaaaagagaacaaggaaaccacacacacataaatatttaaaggtaccgttctcaatggttggngtgaattttgtttttagatgccaataaaacttatttgtttgaaaaaaaa

SEQ ID NO: 601587 - DNA, 150 bp, Homo sapiens
ccctctgctgcactcgactgcgcattcacaggctgactgcatgtcaccccatgccagaggtgtcatagtctgaatgtgcctcagccagcccctgggagaaggcattgtaacaacaggtgaagagggggctgactggagcgagacctctgt

SEQ ID NO: 601588 - DNA, 113 bp, Homo sapiens
  misc_feature (37)..(37): n is a, c, g, or t
tgtcttgaagaacgcagatgatgatcgtcgctcgcgnctgggagcgcggcagcagcggggcgagcgactgctggtactcgaccttctccagcgcgcggtcggctcgccgagga

SEQ ID NO: 601589 - DNA, 575 bp, Homo sapiens
tcgatcttatctatttatggaagaaaccaatccggggtaaagaaaaaggggaatgaggtttggggacagaggggcggggggtgcgagagaagccccagccccgtgagggggtggtgggtgggaggggaaggggaaggggtcactggtaaaactcatggctccggctcgtccttctggatgacagtctggtatggctttctcgaagtcctgggccaggacaatggtagcgggtttctcacgggacagccaacattccactctccggacagatgggaggttaatatcagctccgggaaatcttatctgggccggggccacatagtcttccaagtcaacctcctcagagaggttcatctggctagggataggggagaaaatcaatctactatctgggcgggaggggccaggaagggggaaatccaatttaacgggcgccagcacgtccagggcctgtagcaggggccgggatccaggggggtctggcacaggtagagggggccatgagataacctgggacatgggacatctctggatacaaatccatccatctgagataacagaaggctccaagcaag

SEQ ID NO: 601590 - DNA, 250 bp, Homo sapiens
gccccttttatttttcccccgtcttccatggcgagagccatatttaaaagaccctgccatccaattttttatcctttttaaataaaaattcccatgttccgtagcgggggtgatgccattgtttaaccctcccccccccattggataccttggcctggaatgttccccccctgcgggcggggccgcgggaaaccattcccctattttcccctgcccccgttttgtataaaaaaaattgggtaaaatttga

SEQ ID NO: 601591 - DNA, 163 bp, Homo sapiens
agacgaaccatcttaccatctttaggtaacttgaattcttcaacagggtattgcttacgtaccaactcaatttcatgagcaaatctcttgggcaattcactgaaaataaacacaaacaactcactcaacgtgtccaaaacttcgtggtaatgttcttcgaaag

SEQ ID NO: 601592 - DNA, 123 bp, Homo sapiens
gaggaatgctgagagaggaagagtatgtggctcctccacgggggcctctgcccaccaatacacaggatggtcccaggacattatcctgtgctgtggatgagaacctcagcattcctcgcaaca

SEQ ID NO: 601593 - DNA, 575 bp, Homo sapiens
  misc_feature (1)..(1): n is a, c, g, or t
  misc_feature (64)..(64): n is a, c, g, or t
  misc_feature (148)..(148): n is a, c, g, or t
  misc_feature (161)..(161): n is a, c, g, or t
  misc_feature (208)..(208): n is a, c, g, or t
  misc_feature (225)..(225): n is a, c, g, or t
  misc_feature (253)..(254): n is a, c, g, or t
  misc_feature (266)..(266): n is a, c, g, or t
  misc_feature (278)..(280): n is a, c, g, or t
  misc_feature (282)..(283): n is a, c, g, or t
  misc_feature (289)..(289): n is a, c, g, or t
  misc_feature (299)..(299): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (329)..(330): n is a, c, g, or t
  misc_feature (338)..(338): n is a, c, g, or t
  misc_feature (345)..(345): n is a, c, g, or t
  misc_feature (352)..(352): n is a, c, g, or t
  misc_feature (369)..(371): n is a, c, g, or t
  misc_feature (397)..(398): n is a, c, g, or t
  misc_feature (412)..(412): n is a, c, g, or t
  misc_feature (435)..(435): n is a, c, g, or t
  misc_feature (470)..(470): n is a, c, g, or t
  misc_feature (516)..(516): n is a, c, g, or t
  misc_feature (519)..(519): n is a, c, g, or t
  misc_feature (532)..(532): n is a, c, g, or t
  misc_feature (547)..(547): n is a, c, g, or t
  misc_feature (561)..(561): n is a, c, g, or t
naaaatttgtggtttttgtttcttttcatgtcataaaataacttagtagaatttataataaaantttgagaatttaatatctcatcaaaatacaataaaatatggttttcaaatatgattaaccctttcggcttttcttttacttganggcatataaaccnaaaatacccaaactatgggtgcacacttaaactttaacatatttggntttttttattgtaattnaaccattctaaattattacattgttttnnttcttgtttggntttttgtttttnnngnngttttngggttgtttnggngtntnggggggggttggttgttggttnnggggtctntgggtgnggggggnggtgtgtgtgggggggnnngggggatgtggttgagttgattgggnnccttgggatgagtntctgtgatcgttgcatcagtgtngggagtaactgcttgagtaagtacaaaggtatttnagaaacttcagtgcaatttggttcagttattttcattcagatgccntcnccgttcagggggnttaatcactgggacncattgattcatgtngggggtttgggggg

SEQ ID NO: 601594 - DNA, 1240 bp, Homo sapiens
tgctgcgcgcgagccccgtgtcccctacggtggacagcagcgggcgtgcggcggcggctgaacgctgagggggcggagggagccctgctggcggcgtgcaagcaagctacagcgaaatggcggagaccgtggcttgacacccggcggcttgatcaccaatgccgcagaaccttgaatgacgcctacgggaccccccagcaaatttcctcgagatcggattgtgagcaaaccccgcaacacggtgggggtcgggccggggccgtttcaccacttacgaaaatcagggtccagagacaaattcttcccttatttttcaagcttgaaggaatctagtgttagacacgaagataccagtgacctttgaattgcctgccgaaggttgacattacgcaaagagagaagcaaggtcgatagtttccccccggttcccctgggaaacgcgcgtataggcgtcaagttaccttttatagaaggagtattgacttggcacatacttgtgatgacaattcttcatggcgcgacaaggaacaaccaaggtgcttgagagccagttttattacacccaaggtgtcgctgggtcaatccatcttgggcaccaagcaacccgacacggttggtctcccaccattgtttctttaacaagggagtgaaacttcaccttaggaattaacagagctaaatactcccagttcgtacaagattagcggactcttttgcgtttgaccacacttgcgggccacaacgaacaggggggccaaacacaagcggttaaccctaatttaagttcgacctgggcagtaacggcccccccaggttgatcagacaagtagtttcctaacacctttttaaggcaagttgccgcaccaccaagaaaagcgttgcgatattaaaccactgttgaccatctccaggtaaattaccgtaaaacgcacgtcacaattatttttgccctcaagaggttgtaggggttggagggggcatactatggggccaggtttgtacaacacaaggaaagtgttttctgctgttgctggccttttcatcgtataagaacatactctcccctatcaatattcccagcggccttctactagttgttttaaccattacgcctcctctatacagtaggcagggtgctgaaagctggtggcgggtagcacacaccttatatagggccatcccaaacacacgcgtgtgttacttccaccgcggttgtaaaacttagtgaagcaggtctcga

SEQ ID NO: 601595 - DNA, 130 bp, Homo sapiens
cttataatgcaggtaaggttgtcctgaaatcactgtttttgggagcccacaaattcatgagggaaaagccttcaaatgctatggtacattagttgaaccataaaaacagaaatcaattataattgcttct

SEQ ID NO: 601596 - DNA, 145 bp, Homo sapiens
cgctagcggcatagtgaacgcatacccgagcccaacgatgccgactcacccaagttcaagacaacagtgggaagcgtcaagtgggtccccgagaacagtgagatcgtgtggtccaccaagtcccgttcacttaatgccgctagcg

SEQ ID NO: 601597 - DNA, 412 bp, Homo sapiens
gcattaaactgagaagaaccactgaggaaagcatgccacagtctttcccaaaatccctgtgtcttaaggaacaaccaagaaagttaactggtcagggaaaagatttcttttggaacacagaagccatcgctgtgtgcggaaatccatgacctggccatgacttctacaacccggaggacttgcctggcattaccgaaaagcacaggggaaagattctgtggcaggtgccgcatttcatccagctcactccgtgctagttcctaagacatcttaattcttacacatatgcataatcgtgatattttgccatgaataacaatatatttcacaattatcaaccattttaatttttagctttctaacctcggactactataataaaaagaaataataaatccaaaagtagtagtgg

SEQ ID NO: 601598 - DNA, 486 bp, Homo sapiens
gcattaaactgagaagaaccactgaggaaagcatgccacagtctttcccaaaatccctgtgtcttaaggaacaaccaagaaagttaactggtcagggaaaagatttcttttggaacacagaagccatcgctgtgtgcggaaatccatgacctggccatgacttctacaacccggaggacttgcctggcattaccgaaaagcacaggggaaagattctgtggcagagaatgatgggagttgtgatccatacctccgtgtgcataatggttgtacctgctccaggaaggcgctggatcctcccaactccatgggaagagattaggacacaaacaacagacagaaggtgaccacaggaggacacagtgagaagctggccatctgcaagccaaggagagagacctcaggagaaaccaaacctgccagcaccttaatcttagacttctagccctcagaacggtgaggaaataaatctctgttgttcatgcc

SEQ ID NO: 601599 - DNA, 916 bp, Homo sapiens
agctagtcttagcatttatattttaataggaagtggactcccaagcatgtaaaagtgatccacgcagccggagtgtatgccgggagctaagatggtcctatgggtgaacatatcccaccttgcttcctgagtccttggtcccaatcttctcattgtgttcctctctgttttaaatgtttattccccccaacgtcttttgatgtaagagttcagtttgtcttcgggagtgggtctctgcaagggctctgggatgagtcttgtgcttccacacgtaggacaggctattgtgttcttggacttttttctgtgctagcgctgctgcttggtggcattgtaacaggacgtggattctgcctcatcagttggcagtttcccttttctctctgacttgtcctacgtccgatttctctatggcttccctgagaaaggtgaggcccataggtagagaggccttcaacactgtcgccagcgtcctgactgcagctcagtgcgtatcttcttgcttccatgtgtcttttcccctgtctgcctcagtctaccaccccgattttgactcaggtgtttgagccatttctacaccaaagcaaagtacggctcaggagggagtaaacaagggtgccatctgttgtctggaggggcgagctgtgtttcattgcccctgtgcttacctggggcatttcagcaaatttctggcatccttgcgatgtggtgcagtcccacctcagtaaaggttactatctttgcaaggttttgggaaggccaacccaaggacagggggtggagggcctatgggctgggtgtcccttggcttgcccggggtggatccaatttttgcccccctggggccctgggtgccagtgcgtccccgcggggccctttctgcacgcccccgggtctcttgtgccgggtcaccagc

SEQ ID NO: 601600 - DNA, 261 bp, Homo sapiens
gacccccccgacctgttttccacctgaagagccacccattccatccaaacccttggcaaaagtttggttaacaaaaaaaaccggccagtatgctggccagttgcgatcatgcctgtttttaccctttaagctgaagctgctcatcaacggtgagatggcaaaaaggtgggtccaaaaaaggggaaaaaaagggagtttgtgaaaacaaaatgctgaagaatttgcatcaaataaacccttccttccttcctttttccttca

SEQ ID NO: 601601 - DNA, 646 bp, Homo sapiens
gcattaaactgagaagaaccactgaggaaagcatgccacagtctttcccaaaatccctgtgtcttaaggaacaaccaagaaagttaactggtcagggaaaagatttcttttggaacacagaagaatgatgggagttgtgatccatacctccgtgtgcataatggttgtacctgctccaggaaggcgctggatcctcccaactccatgggaagagattaggacacaaacaacagacagaaggtgaccacaggaggacacagtgagaagctggccatctgcaagccaaggagagagacctcaggagaaaccaaacctgccagcaccttaatcttagacttctagccctcagaacgaaatgttcctcaccccccaagaaggaaaccctgtacgcatcaagcagtcattcctcattctcctctcccccagcccctggagacctttcatctgctttctgtctctatagatttgcctgtactagacatttcatatgactggaagcatataatatgtggtcttttgtgtttgacttgttttacttagtctaatgttttcaaggttcgccatgttgtaacatgtacactttacacaattttaagcctaatattctttaagccatatattcaaaataaacagcttacaaaaatga

SEQ ID NO: 601602 - DNA, 208 bp, Homo sapiens
  misc_feature (2)..(2): n is a, c, g, or t
  misc_feature (53)..(53): n is a, c, g, or t
  misc_feature (126)..(126): n is a, c, g, or t
  misc_feature (153)..(153): n is a, c, g, or t
  misc_feature (201)..(201): n is a, c, g, or t
tngccaagggtcatgatatgatttatctccacactagcagagaccaaccgaanccccttcgaccttgccgaagggagtccgaactagtctcaggcttcaacatcgaatacggcgcagccccttcgncctattcttcatagccgaatacacaancattattataataaaccacctcaccactacatcttcctagggacacanatgccgc

SEQ ID NO: 601603 - DNA, 255 bp, Homo sapiens
  misc_feature (16)..(16): n is a, c, g, or t
  misc_feature (20)..(20): n is a, c, g, or t
  misc_feature (58)..(59): n is a, c, g, or t
  misc_feature (73)..(75): n is a, c, g, or t
  misc_feature (78)..(79): n is a, c, g, or t
  misc_feature (83)..(83): n is a, c, g, or t
  misc_feature (116)..(116): n is a, c, g, or t
  misc_feature (142)..(142): n is a, c, g, or t
  misc_feature (163)..(163): n is a, c, g, or t
  misc_feature (193)..(197): n is a, c, g, or t
  misc_feature (212)..(212): n is a, c, g, or t
  misc_feature (214)..(214): n is a, c, g, or t
tattactgtatggcanaganagaagtgacattgggtatgttagaaatgaataaggagnngaaatgcattacgnnntgnntaanaattatcttttcagaatgctagtttaatgactnttttaactgaattttttgaataaatnagaaatgtttgtattggtcanaggtctatcataattgcttttctgatgcannnnnaaataaatggaacantnaaatgtatattaccgatgcaaactgtggataaagttgaaag

SEQ ID NO: 601604 - DNA, 370 bp, Homo sapiens
ggccggcatgaggcagatcccagcttaccttagaattttcctaacgaagcagcaaaaagtattaattttattaagtcttgaatacatttctatttaatattctgtgtgattagatgggaagtacacacaaagcatttttgctgcatactgaagcacaacagttgtctcaaggaaaagcacttgtgcaattgagttgtgagctgaattggccatctttttttttctttttttttttttggagagggaggctggtcctggtcgcccagggctgggatgtgcaggggggtgatctccggttcactggcaagctccgtctcccggggttcacttcattctcctgcctcggcctcctgaggatctgggcctcgtg

SEQ ID NO: 601605 - DNA, 574 bp, Homo sapiens
gcattaaactgagaagaaccactgaggaaagcatgccacagtctttcccaaaatccctgtgtcttaaggaacaaccaagaaagttaactggtcagggaaaagatttcttttggaacacagaagccatcgctgtgtgcggaaatccatgacctggccatgacttctacaacccggaggacttgcctggcattaccgaaaagcacaggggaaagattctgtggcagagaatgatgggagttgtgatccatacctccgtgtgcataatggttgtacctgctccaggaaggcgctggatcctcccaactccatggcctgttccagccaccgtgtcaacatgccttggtccatagctctggaaggcacacaccaagcaggaccagtgaacagaagatgagaagggaagagattaggacacaaacaacagacagaaggtgaccacaggaggacacagtgagaagctggccatctgcaagccaaggagagagacctcaggagaaaccaaacctgccagcaccttaatcttagacttctagccctcagaacggtgaggaaataaatctctgttgttcatgcc

SEQ ID NO: 601606 - DNA, 536 bp, Homo sapiens
ccggtcactgaatggaggaactggtgccgcctgcaagggctggatggccagaacactcgggacacccgggagaatgagatctggcacctgcgggagcaggtgtcgcgcctggcgtccgagaatgcggtgagctggagtgctgcagctgtggcctgatctgcgcgatgtgaggctgctggcctgtggctgcgcggcactgccagtgaggccgatggcgctgctgcgggctggtgcgcgggctggagctggagctgcggcatggagctgcggcctcgggcacagggttggcctggctgtctgcgggcaggactgcctgccggtctggccaatggagctcggaggaggcgaatgggcatcggagcggagcctgcgccgcccaggcttgaagacgctgaccaggcgagctggcattggtacaagagggggacggcgggactcctgacgtgtgcaggcctgcccctgacgctggggagggacctggtgccttgatcggtcccggggagctgctccggcgtcgctgatgggccgttgtgccg

SEQ ID NO: 601607 - DNA, 815 bp, Homo sapiens
cagtggcatgagctcggcttcactgcaacctctgcctcctgggttcaggcgattctcctgcctcagctcttgagtagttagtagagacggggtttcaccatgtgggccaggctgtgtcgaactcctgacctcgggtgatctgctcgccttggctcccaaagtgctaattagaaaggagaaggcatcctattctgtttgagagcccattctgaagtgggtacacatcacttctgctcacattccatgtgttagaatttaacccgggcatggtgactcatgcctgtaatcccagcactttgggaggccaaggtgggaggatggccttgagctcgggagttccgcagaccagcctgggcagcatggtgacgactctgtctctaccaaaaaaacaaagtaaaaacaaagctggaacatgggtggcatgccattctgtagtccccagctccctcagggagggcttgggggtgggaaggatcactgtgagtcccaggaggtccatggctgcagtggcggtgatcggaggtaactggcaacccaagggtagggtgacaggagcaggaccccggtgttcattaacaaacacaagaccgtaacccacacacccacacacacagttggcgcgcgacccgcgacccgtgacgagaggtccaagccaccgcgtgggggcgcgggcacccggacgcgcgggagaacgggccacaccggccccaggagaccgggccaacaaggcgcgggtcccacaacaaacaccaggggcacgcgggtggagaacacaggagcacggctaggctcccgggccggcgtataccccgggg

SEQ ID NO: 601608 - DNA, 101 bp, Homo sapiens
tacctaaatggctgtatataaagacaggtatgcttttcaaaaagctgaactgcagattcttgtagatcattgcagctaatgtaatcactgatccaaatatg

SEQ ID NO: 601609 - DNA, 485 bp, Homo sapiens
taccccatcaaccctaaatttattatgcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 601610 - DNA, 548 bp, Homo sapiens
gagtcggagtgtggggtgaggcgagatcacaccattgcagcgtccatgcctattgcaactgatgactgagagtctgtcgtcaataaataatagggtgagttgggttaagtaaacgattgttgcagtgtaaaaaactgttcatatgccttaaccccttggtcatcccttaagccagtcatctattaacccagtcattcctatgttactgaagcagggaaaggagggagacccaatgtcctttcaagttaaaatgttatgattgggctgggcatggtggttcaagcttgtaaactcagcattttgggaggttgaagtgggtggatcacctgaggtcaggagttcaggaccatgcctgaccaacatggtgaaaccccatttctactaaaaatacaaaattagctgggcatggttggcacatgcctgtaatcccagctactcgggaggctgaagggggagaatctcttgaagcccggaggcgaggttgcgttagcccagatcacaccattgtactccagcctaggggacaagagtgaactccgtccttaaaa

SEQ ID NO: 601611 - DNA, 283 bp, Homo sapiens
ccgtgatgggtggctcgcttgctggccggctgaggcgggtggctgcggatgccacctcgctcttcagagactcgcccgccggtgaccacgactacgctctgccgagtgggaaagcagaagcaggacctgctggaaaaaggacgactcgcagggaggagtctgtctccatgtggacaaaggatcaggtgtcgatggagttctgctcggcgtgcgcccggaaagcgtcgtcttctcttaaaatgtagagtcaagtaatctgctcttatccgcgtttggacactga

SEQ ID NO: 601612 - DNA, 1480 bp, Homo sapiens
  misc_feature (1363)..(1363): n is a, c, g, or t
  misc_feature (1410)..(1410): n is a, c, g, or t
  misc_feature (1468)..(1468): n is a, c, g, or t
ttttttttttgtgttcagaaaagtacagtgttgacattttattttttatgtaaagaagccatatttacataatacattcatatttttaagtatgttacagctcctgtagaaaaccattccattaagacagcaacaagtgatctggattcaatctttaaaatattaagtcaaattaaaatgttcttatcaagactccaatttaatttcacagcccatctgcacaggggaactgaggagaaacaggaatgaagagtgggcgacaaagagaaagcatcccttcccacacgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccaataccatgtccccctgacgtgggaggtcaaaggagatttgcccaaccttttcattcatgccaaactgaacaatttgggcatatgcactctgagttacttttctcaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 601613 - DNA, 1655 bp, Homo sapiens
  misc_feature (1538)..(1538): n is a, c, g, or t
  misc_feature (1585)..(1585): n is a, c, g, or t
  misc_feature (1643)..(1643): n is a, c, g, or t
cagccaattttgggtctaacattttcaaaaaagtatggacgccccaaaaggctatgggccagtgtgcatttccatcaagccctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaaccttctccacgtcagctttcttttctgtgagaagagctactgttcttttataagcatcattaataagtattcgtacttcatcatctatcaatcttgcagtggcttcactgtaaggtttctccaataccatgtccccctgacgtgggaggtcaaaggagatttgcccaaccttttcattcatgccaaactgaacaatttgggcatatgcactctgagttacttttctcaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 601614 - DNA, 274 bp, Homo sapiens
cgacacaggctggcgcagcaggagcatgggggcggccacaatcactgctcagcttctccagagagacgtcgttctgttatgcgcttcatgttctcaaagtcaaaggccgatgccagccactgcgtttgtagcatgtctttgactgtcgttgcagagttgtctcaccagtgtgtggtaggcatcgataggcagcagcgaacagcaacacctaggctctccacaagcgatcatacaatggcgctcataacaagatcactgatcagccacaaaactt

SEQ ID NO: 601615 - DNA, 644 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctacctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 601616 - DNA, 620 bp, Homo sapiens
tgccggcggctcaggcgcgcctggaattcggccgccggggcgcctggggtgggcgcgggtggcggcgtcccgggctctgggttctgagcgtctgtccccccgccttgccctgcccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggagtgtagcttgcttcttgagtgactgcagcgagcatctgctcacccatgcactggctgcctagtgcagctaccctgcttcacctttaaaagcgggtctgcgtgctccagataccagccggcaaccgcatggcctgcttcgtggtatgccacagtcttcttctcctcaggctgcagaacctgcgttttcttctctaagcctaacaaaataacaacaaaaaaacccaagccattgttacagtgacactgacattaaaagacagttatacagtgctaaaaaaaa

SEQ ID NO: 601617 - DNA, 367 bp, Homo sapiens
cattgggcctagaccgacggcttgagcagctcttcgttgtggtactgcgcgtatagcattaggtgtgcatataagcggtctgatcgcttggtggtgcaccaggttttgcgaaacaaccgattcacgttcgctcggagcatcgcgcaggtgtgattcaggctgaacagtggatcgaagcgaaccttcttgagctcactctggccggtcgtggatcctcgtttgcccttgtaatgaagatggagcgagtccggaaagtgcttctgtatgtccgcgggataataagggttgtcgtcggacttgatcacaacccgatccgtaacgacgtattggagccactcgaacaagcgcttccggcccagcctctttc

SEQ ID NO: 601618 - DNA, 181 bp, Homo sapiens
ctttaatgtggcagatggatggggccagtaggaattatctcagcattatggcatcagcccactttcaataatcttttggttcttgtactaattcattaaattgctgtgcagccaacttgacttacccagcacgtacacagcaaagagaatcagaagccaattcttctaacacgtatctctt

SEQ ID NO: 601619 - DNA, 1327 bp, Homo sapiens
  misc_feature (1210)..(1210): n is a, c, g, or t
  misc_feature (1257)..(1257): n is a, c, g, or t
  misc_feature (1315)..(1315): n is a, c, g, or t
ggtagatttctcgttggtctctgcttacccttttgccaggttctctgggattgccactgtgcatgtgtagtttagttgtcggcctgagatttgggcagttcctgctcagattcggcctcaccacttggtagttttcttgcttctgggattttcctgttaaatttccagtattcgttaagtcctggactatctcctctaccacctcaggataataaagactatgtctcataccactgtagtgtggagattatgaaaaaccctttggcaagaaagccacaggctcccagttcaaacccactgcagctgctgctttataggagcaaactctccagctctcgcctgcttttggacactctgtggtccctttaaataattttctgtccaaattttatatttatctatgggacggtttgtgcaactatggttaccagaagttaccagaagttttggctaaagccttgtttctttctcctttgcaggagtgtagcttgcttcttgagtgactgcagcgagcatctgctcacccatgcactggctgcctagtgcagctaccctgcttcacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 601620 - DNA, 223 bp, Homo sapiens
ccgacgcgactactacgactactactactcctactacgactacgacgactactactcccctactactacgactactactactactacgacgactccactcgtaacgacggagtacgattcctacgactccgcggctaatacgaccacttacgactactattaggcccccccaggacgaaggaggctactgcctattacgaggccgaactagactacgaccagg

SEQ ID NO: 601621 - DNA, 1285 bp, Homo sapiens
  misc_feature (1168)..(1168): n is a, c, g, or t
  misc_feature (1215)..(1215): n is a, c, g, or t
  misc_feature (1273)..(1273): n is a, c, g, or t
agagttcccagtcccttctctaaatttctcctgtctcagtctcctgagtagctgggattataggcgttcaccatcatgtctggctaatttttctatttttagtagagacaggtttcgccacgttagccaggctggtctcaaactcctaacctcaagtgatccgactgcctcggcgtcccaaagtgctgggattacaggcatgagccactgcgcctggccttgattaggaatttttggattgtgataggcagctcagtctccaaaccccattttaggtaaggcaatgtatagcactgtataactgtcttttaatgtcagtgtcactgtaacaatggcttgggtttttttgttgttatctatgggacggtttgtgcaactatggttaccagaagttaccagaagttttggctaaagccttgtttctttctcctttgcaggagtgtagcttgcttcttgagtgactgcagcgagcatctgctcacccatgcactggctgcctagtgcagctaccctgcttcacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 601622 - DNA, 248 bp, Homo sapiens
ggcctcgtcaaagtgctggaattacaggcgtgagccactgcgcctggccaagaatggacattttttacaaaaacatcagtacttcctaccagtgctgcatgagtataatggtccggaattatcagagagcataatgcagaaatacgtattagtggagcttaatcatgtgccatataagcttacctaactaacagttatatccctattcctcgactgaatgtctttcaataaataagaatttatcattt

SEQ ID NO: 601623 - DNA, 293 bp, Homo sapiens
cataatgagagcccaggtagcctccttacaaaaccagacacagagcttccttgccacctcacaggcccatggcgctcctttctaaggggtcccctctcatgaccggtgggctgaacttcacagaaatgaagtgcatattcttatctgtttgactcattttattgaaaataatgtttatcatagaatacgttataggagaaaaaaaagtttttgagattcaatcagtgttgaatatatcactctctcatttgtctgggtgagtaataccccattttatgaatatatcacaatgt

SEQ ID NO: 601624 - DNA, 139 bp, Homo sapiens
  misc_feature (61)..(61): n is a, c, g, or t
  misc_feature (63)..(63): n is a, c, g, or t
  misc_feature (110)..(110): n is a, c, g, or t
  misc_feature (126)..(126): n is a, c, g, or t
caaacccggcaagaaacagaggagagggccaggcagggtggctcaggcctataatcccagncngggcagctgaggcaggtggatcactgaagtcaggagcaagaccagcntgggcaactggcgaancctcctctctaat

SEQ ID NO: 601625 - DNA, 102 bp, Homo sapiens
atgcaccactgatggtggcaaatggcagatactcacgccgcgcgtctttttgagacagtccccgctggcccggagaaagtaaccattcagattatggatacc

SEQ ID NO: 601626 - DNA, 426 bp, Homo sapiens
  misc_feature (116)..(116): n is a, c, g, or t
  misc_feature (185)..(185): n is a, c, g, or t
cctccataaggcctattgtaaagatattaaaagtgaacggtgccctgtaaatgtgcccccatgacagtccccccggaaaatagtaggtagtaattgcctaaatgttaagcctgtanttttattaatgttagtacagttggctgggcatggtgccttatgccctgtaatcccagcactttgggagnccaaaggcaggcggatcacctgaggtcgggagttcgagaccagcctgacccaacatggagaaaccctgtctctactaaaaatacaaagttagcccaggtgtggtggcacatgcctgtaatcccagctactagggaggctgaggcaggagaattgcttgaacctgggaggcggaggttgcagtgagccgagattctgccattgcactccagcctgggcaacaagagcaaaactccaattaat

SEQ ID NO: 601627 - DNA, 668 bp, Homo sapiens
gactgccggtgcagctgttgggtggtgcccggggtgccctgtgtggccctgggatggggaacctgcggtggcttcctgcggagtgtttcgcgcagtggcatcctggggccggtggtctgctgggcgtggatggggcctggggcctgagtgcctgcggagctcgcggaggcaaggacgaggataagtgagtgtgattgcccgtcaccaagtttgggccgcttggtcaaggacatgaagatcaatgtccctgtggaggagatctatctcttctccctgcctattaacggaatcagagatcattgatttcttcctgaggggcctctctcacaggatgaggttttgaagattatgccatgtgcacgaagcataccctgtgcccggccagcgcaccagggttcacaggcaattttgttgctatcaggtggactacaacttgtgccacgtcaggtctggcgtgttaaagtgcgtccaacggaggagtggcccactgtctatcctgtggttgccaatacattccttgtgccaaggctctccatctgtcacccgtgcggcagagagcaacttgaggtggaaccaatgatcaggagaaggcacaacacttgtcccattgcacatgtgttgacatgctggcgttgtctgactcttgttacatgagatacgcctaattc

SEQ ID NO: 601628 - DNA, 1051 bp, Homo sapiens
agacagacactctggcaatattgtccaagaaacacctcgcagaccaaattctttgaagctgaatgtggaacaaagcacctttcctttgctgagagactgcactatcaaaagtcattcccacacctacgcacctgcctaacaagactggcgaaacaccacaagacttactgctctgcttgggctttacatgagccctagcgaaactacacgactgcacttcacacacacgaaagctcttagcacatggacggcctcggctctctctcctgcacccattcgttaactctaccacgctggaacacattctaactgggacgcccaccactttctcaagaccacccaaacacagcacaactcttcgcgcaaccacagacctcttccacacagacgccttgggactaacagacaacaccttactcactgacggccaacacgaccaactcatggattctccagagcctagcttggactgcgaatctgaatttgaccgcatcgccttcaaacgtcaaagtctgccttccgctggctaacaccaatcttggtgccctctgcacgcaactagaaaaaaaacttatggcttctcccacgcacatatcatgaaaacccttccgctaggtcacccacatgccaaaccacaagtttacccttaacctccaaaacccgcttccatcaagtaacaccaaatcgggggccttccacaccccgctaaaacacttaaccctcccaacttaacttatccctccggcaagcacttcccccccacctaaaccaagcgacctgcagaaacttccaaaaacatttcaacaaaaaaaaccgcttgggtacattgtagaccctatggatcccaaaaccatctggaccatgccagggaggccccaaatctcccaccttagttaccaacaaagccatctcaccaccgcgccacaccaaaccactccacaagagatatgcccctccaacacaaactccacaatcccactggggagcaaccagccgagactccctcgggcacactcccctcccctaacactagcgcatctcgggcccgcac

SEQ ID NO: 601629 - DNA, 570 bp, Homo sapiens
gaatagaatttgggataaagtggatgaatagctgactggccaaaaatcaaatgagtgtttcaccgggaagggattcttccgggaattcatggcatgttactcctccaggatgtatgctccagaccaccccgccggtttgtgctccaaatgttccaaagcgaaaagtttccgcctcaaagatttgaggcacctgcttgctggcgaccctacgtgtcgcaggtcttagtgtccaataagaccttgtggcctgtaacatgggtgtaaagagcctccatctttacctttgcagggataaaagtgagttttgtggatgggcgcagtggcccatgcctgaaatcccagaactttgggaggctgaggttcaggccagcagtttgagaccagcatggtgaaaccccgtctctactaaaaatacaaaaaattagctgggtgtggtggtgggcgcctgtaatcccagctacttgggggactgaggcagaagaatcgcttgaacctaggaggcggaggttgcagtgagctgagatcgctccattgcactccagcctgggtgaaggagtgagactccatctc

SEQ ID NO: 601630 - DNA, 142 bp, Homo sapiens
tacagtgaaagccatatatccacacatgcctgtgcgtgtgcactagagaattctccacatcttcctccctacatctatttggaatatgcttagtccaggaactgtgtgtgtttttgtctgtcgagcggtaggcatgaagatg

SEQ ID NO: 601631 - DNA, 671 bp, Homo sapiens
tgatcatatatttcggattcatattgattaggttagattagcagtcaataaagttacttttttgcctttaaaaaaaaaaaaaaaaaaaaaaaaaaaaaaaaaaaaaaaaaaaaaaaaaaaaaggggggggggggcaaacctattactccccctgggggggccccaattcgcttcaccccgtccctccccgttattgttgtagatgagaaaaaaaggggggcgcaccacattatggaggaggtagtagtatttattaacgccaagggacgcgcgcgcggcaagtattaaacaaaggactgctgaccagaaggggcaaaaccgctgggctagcgtgggctaaccacttggtgaagcgaggacaccctatcaccactctggaggagagggtgggacagaacctagcatgctgtgcggagccaaaatcacagctctcatccatgctcgtacgtagacaatttatattaacagacctcttgcttgggggagtacacaagtctaataaatacactttgttacgacggcgtgtgtaagatatagcgtgggtgataaaccaccgacaatggagcaaggcaatttgttgcctaggtgggaaggcgacatgtaagaaaatttttttgcgcaccaaccacgtgggatatttttcgatattactggaaagacaatctttctac

SEQ ID NO: 601632 - DNA, 114 bp, Homo sapiens
ctgtgtgtacggacaaaaacaggctaggtgacaagaccaaaacaaaacaaaacaaaacaaaacaaaaaacaacaacaacaaaaaactaaaaaccttctgcggtgtggtcctttt

SEQ ID NO: 601633 - DNA, 108 bp, Homo sapiens
  misc_feature (66)..(66): n is a, c, g, or t
  misc_feature (96)..(96): n is a, c, g, or t
gtaattattgtattttttagtagagacagggtttcaacatgtttggtcaaggctgggctcggaacntcctgaaccacaatactctgaaaatcccantaggtgaattta

SEQ ID NO: 601634 - DNA, 477 bp, Homo sapiens
aaccatcttattttccaactctgtctttggccccatataccaaaaatgtcttggcctttccaaagtcaccaaagccttttgctattccttccattctacttaatgatttctagatatttaggcagggcaatgtccatccaaaaacaataatacgaaaagtcattctatttagatatttgatttacacacacccagcatcacttagaataactaaagtaggtttggactgtgtatggatagaatcatatgtgacttttaattcttccacttgttcagggtcaaagaaaatcaggcataataataagagtgggggaaggagattattttcattccctatgtcaaaacaggtatttattttagatttgctgcctcatttccttttgaaaaagcaaagtaatattagtatttatttcttgaagaccctaaactcattggccataatttgccatggttatttacttagacatctgcatttcc

SEQ ID NO: 601635 - DNA, 906 bp, Homo sapiens
  misc_feature (283)..(283): n is a, c, g, or t
agcggagtcagatgctgtggtacttggcatttaacaactagaattcagaatccagattttcaagatggtgaattattttaagataactgagttgtaatagagaatgtaataatattgtgagaattattgtgtagggaaagtggaagataccgtgactagtcgcagagaatgctgaagaagtaacaattaagatagcgtagatatcctcatctgggacaaatagtcctggaggttcagatttggcttaaggaaacggttgcagaaagggcagacacatattgtngatctctggtggattacaagatggctgatagcactaaatgaagaacaagcaacttgcctactgcagctccggataagacggaggtcactcggtgacgcacgattgctccactccggtatagaccttcctcaagcggaagccgctcccttgttatgctagtcaagtctggtctggtctgagttaatgaggctgaagctgacatgtaatcttgtctaatatctccatttattttggcatccgttacagtagtggttagcttaatcgtacgtgtgtcttagtgttcctctctcagttcactatctcatttgaggactgcacagctttgctaggtaaggcatgtagtgtgtagctgctattggtgggaagtatagcgtcgttgtaagacgttgccgagttacgtttaagcaggtgcactggtgaaggaaggacattgtgtagaggcaagcactaaggtaagagtaagtgtgaagagatagttgtgatatattgaccttgagttctagttgtaagtggctggtttctaaaccaagttaaaaaggcccgttttaaaatgtcaatgtttagggttgcatgacgttcatcttaatgatagttggattttactcttattgatataatgttaa

SEQ ID NO: 601636 - DNA, 251 bp, Homo sapiens
tataatcaaatctttggagtttttgtctttggtttgagagagggttcgagtggttgtgtctatactgaacatgtatagacttttttccttgtcattattccctaaacaatatagctccatagcatttacactgtatgaggtattataagcaacatataatttaaagtatacaggaggatgtacatgggatatgtgaaatactacagcattatatataaggaacttcaggatctgcagattttgatattcat

SEQ ID NO: 601637 - DNA, 864 bp, Homo sapiens
gacttgaaatgttggagatgacatgatatgaaatgatgagatgcaatgacctgataaacatgatgaaatgataatgatgagaatcgatgtgagtgaaatgacaataatgataatgatgatagcagatatggctgagatggaacaactgcggaaatgaagatgaggactgagtgacaatgactggtgactgaagtgtccatggtgcatcttggaagtgatgaaacagagtcagatgccctgattgacttgaacacatgctatgatatgatgaaatgatgaattggaagaatgaattgactggttgagttgttgaaggtgatcccaatgatatgcatctgatggagaatgaaatgtatactgaagtcgatgatagtgaaatgatgaagatgagtgccagtacttgaatatgctattgctgaattgagtgtacctgatgatgttgtaaatgggcctgatcgacgtattaaatggtcgaaatgagacgttgttgcattaactgaaatgttggtatcgatccgttgatatgattgcgttcacctgaatcattatcatgaatgaatgactcatgatttggatgtgcccatgccttgatgataagcatgaaactgggcaagtgcgtgactggaagtactggcgacctgcgggtgaatgaaagtgagtaccacttgatttgatggtgtgccttgaacccgtaatgagctgtgtttgcctcgtgataaggcctgtctgcctgacaaggaagcgctgatcgccgggaaggtgcattttactgataacggtctactgttttaacgggcagagccaggtttaacacagaacctgtaggaaataacctgaaaggaaaaaaacaattggggcaccaaa

SEQ ID NO: 601638 - DNA, 180 bp, Homo sapiens
ggaaaggatgggaagtacatttattgtccagggagtacacacttggagacagagggacataatttagtgaattttacacctttgccaaggtaccatttttagcattttttacagtattagttacatgtggagatgtgtttatagatacaggcggtacatgtacaggcttttaacatgggt

SEQ ID NO: 601639 - DNA, 270 bp, Homo sapiens
tcggagcaaggcggggaaacacagtgtatcacggtcagggatgtgggatgttctaatggagagaccaaaagaaacacacaaataaatacagcaccttatcacggcccatgaagactggcaccatctggcccctatcagctccctggcctgggtctctagtctggtagtgggttttggtttgggtttgggtttaggggacgggagtctcggccctggtcatgccagggctgggaatggcagggggcacagaccttcagctgcactggcaac

SEQ ID NO: 601640 - DNA, 357 bp, Homo sapiens
catctaaaccaaaaggaaagacctcatttacacccgagtagcaaaggatcgaaggcgcctgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagatatgggtagctgataggaacctcaaaaggagtacttaaaacccagaaaacattgtaaccgggtccttgggcggcttgctggggctcacacccaccctgtagagtgctttctcactttaataaaatcttgcttttgctattcca

SEQ ID NO: 601641 - DNA, 1335 bp, Homo sapiens
  misc_feature (93)..(93): n is a, c, g, or t
cgtgatagtattggtcaccacagccgcccgcccgcaacaagcgtttgggggaagaaacgaaagttcgtgtgtgcatgaagaagtcttgtagcntgacgaacggtggtgggtgagtcagcccccacactataagattttggggataagattgccttccggcggttattaaaaatactctttgtacggacgtcgcccttctcttatacaaaatattctcttgggggggggcgtgattcggcttgtgtctaaaagataagattattataataagacgcttttttatatgtagtacgccgtttagaaatgaggaagactattggtaaacagcgtgaaaaaaccgctcgtggttgtggttgatctgatgtgcgttgtaaatatcctgcgggagaacacagcactggtgcttgagacgttgtttccccccttttgcgacaacgcgcgcctcttaaagttttaacaccgacaccatcattcttgctgaggagttgtcaactattgctccgccacaacgtggaggcttgatcctcttttaaaaggggggacaacacacatcgcacgggacgctcaacggagctttggtttttttcagagagtgccacagaggagtatataggggcccctcccttataccacggggtgatatatatctttttagaagagacctcttcgtctctcggtcacaaattgtctaaagatggggggtatacctcgcgcgtgggagtatatatagagctggagaagacctatatcttgagatctcctcgagagttatctctataggttctctatagccgctctggtctgtgtgctctttttgggcaacaatgtttccacgcgatattctgtacacatatgttctatagaacatataggggagaaaacacactcgtgagagatttcttgtgtgtatatagactctgtcggcgggaagaagagatatatatttgggtgatatagagatgagacttcttgagaatagagaatatagagactgcgtgttgctgtagaaagagagcgttatatatcacacaccttgttctcacaaaggtatatgtataaagagataacacatataggtgggaatagctcttcttattactgcacacgcacagtcacatgagaatatcacattgtttatagccactttatctctaaaggagaaaaagaccacgcttttttctaaggtgaaccactgaaaggaaagaattgagccccgttggtaatgcctcgtgggggtgggaatgtgagagtgggagactgaatataaactgatacttttggtttgtaagtacatactggaagaatcttttcataataaatgagactaccccacca

SEQ ID NO: 601642 - DNA, 601 bp, Homo sapiens
  misc_feature (61)..(61): n is a, c, g, or t
  misc_feature (68)..(69): n is a, c, g, or t
  misc_feature (72)..(73): n is a, c, g, or t
  misc_feature (76)..(76): n is a, c, g, or t
  misc_feature (84)..(84): n is a, c, g, or t
  misc_feature (97)..(97): n is a, c, g, or t
  misc_feature (99)..(99): n is a, c, g, or t
  misc_feature (114)..(114): n is a, c, g, or t
  misc_feature (136)..(138): n is a, c, g, or t
  misc_feature (140)..(140): n is a, c, g, or t
  misc_feature (145)..(145): n is a, c, g, or t
  misc_feature (158)..(158): n is a, c, g, or t
  misc_feature (243)..(243): n is a, c, g, or t
  misc_feature (265)..(265): n is a, c, g, or t
  misc_feature (307)..(307): n is a, c, g, or t
  misc_feature (324)..(324): n is a, c, g, or t
  misc_feature (340)..(340): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (396)..(396): n is a, c, g, or t
  misc_feature (399)..(399): n is a, c, g, or t
  misc_feature (403)..(403): n is a, c, g, or t
  misc_feature (409)..(409): n is a, c, g, or t
  misc_feature (411)..(411): n is a, c, g, or t
  misc_feature (416)..(416): n is a, c, g, or t
  misc_feature (418)..(418): n is a, c, g, or t
  misc_feature (428)..(428): n is a, c, g, or t
  misc_feature (433)..(433): n is a, c, g, or t
  misc_feature (438)..(438): n is a, c, g, or t
  misc_feature (441)..(441): n is a, c, g, or t
  misc_feature (451)..(451): n is a, c, g, or t
  misc_feature (458)..(458): n is a, c, g, or t
  misc_feature (463)..(463): n is a, c, g, or t
  misc_feature (465)..(465): n is a, c, g, or t
  misc_feature (478)..(478): n is a, c, g, or t
  misc_feature (484)..(484): n is a, c, g, or t
  misc_feature (491)..(491): n is a, c, g, or t
  misc_feature (494)..(494): n is a, c, g, or t
  misc_feature (500)..(500): n is a, c, g, or t
  misc_feature (502)..(502): n is a, c, g, or t
  misc_feature (507)..(507): n is a, c, g, or t
  misc_feature (510)..(510): n is a, c, g, or t
  misc_feature (517)..(517): n is a, c, g, or t
  misc_feature (527)..(527): n is a, c, g, or t
  misc_feature (538)..(539): n is a, c, g, or t
  misc_feature (549)..(549): n is a, c, g, or t
  misc_feature (557)..(557): n is a, c, g, or t
  misc_feature (560)..(560): n is a, c, g, or t
  misc_feature (562)..(562): n is a, c, g, or t
  misc_feature (572)..(572): n is a, c, g, or t
  misc_feature (576)..(576): n is a, c, g, or t
  misc_feature (579)..(579): n is a, c, g, or t
  misc_feature (590)..(590): n is a, c, g, or t
ctctctcggaagagccagaaccatccaccatgatgaggttggcctgctttgaacgtactgntgaagcnntgnncangtttgggntcctaagcccccngngaatgttaaagccanagcagctggttgtaacatttgnnncnggttncaaagctggagtnttttgggcaattgtttctcaccccgctgattctgtgggatctgtgttgaataaagaaaaagggagcagtgcttctttggtcctcnaaagacttggatttaaaggggnatggaagggactgtttgcccgtatcatcatgattgggacccngactgccctacagtggnttatttatgactccgngaaggtttattcagactcctcgccctcctccccccgngangccagngtttttgaanaanaagnttgggntnactcngnagttagatcnaagcnaatgnggnctgaatttgnttgttgntcagngntgaagaaagggcnaaaggnacttttntanatttgncnggggnggnaattgtntattcctganataattactgnnggacttttgnttaaggcnagngnttcagatttnctgntgnaataaaccccncttttcttgga

SEQ ID NO: 601643 - DNA, 879 bp, Homo sapiens
  misc_feature (694)..(694): n is a, c, g, or t
  misc_feature (712)..(712): n is a, c, g, or t
  misc_feature (716)..(716): n is a, c, g, or t
ccgggtgtgaatcggccgaggctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctgtcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagaggatgagcaggagcgtggacgtgaccaacaccaccttcctgctcatgggccgcctccatctatctccacgaaccagaacccggatgccgccctgcgtgctgctgcaccagggggacagcctggagtgcacagccatgaccagtgcgagatccgtgtcgtgaagctggaccgcctggacctcgcccggaaggagctgaagagaatgcaggacctggacgaggatgccaccctcacccagctcgccactgcctgggtcagcctggccacgggtggtgagaagctgctggatgcctactacatcttccaggagatggctgacaagtgctcgccccancctgtgtgtcaatgggangggnctcgccacatggccagggccgtggagcgtgaggctgtgaggaggggtaagaaggataggggtacggaaagtggtacctcaatgctgtccagaagggaagcctgagtgaaaagatattgtcagtgagggtgcaagtccacctgaaaggagcggcaagagagatg

SEQ ID NO: 601644 - DNA, 918 bp, Homo sapiens
  misc_feature (733)..(733): n is a, c, g, or t
  misc_feature (751)..(751): n is a, c, g, or t
  misc_feature (755)..(755): n is a, c, g, or t
ccgggtgtgaatcggccgaggctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctgtcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagaggatgagcaggagcgtggacgtgaccaacaccaccttcctgctcatgggccgcctccatctatctccacgaaccagaacccggatgccgccctgcgtgctgctgcaccagggggacagcctggagtgcacagccatgaccagtgcgagatccgtgtcgtgaagctggaccgcctggacctcgccccggggaaaagggggggaaaggccctttgggcaaacaacgggaaggagctgaagagaatgcaggacctggacgaggatgccaccctcacccagctcgccactgcctgggtcagcctggccacgggtggtgagaagctgctggatgcctactacatcttccaggagatggctgacaagtgctcgccccancctgtgtgtcaatgggangggnctcgccacatggccagggccgtggagcgtgaggctgtgaggaggggtaagaaggataggggtacggaaagtggtacctcaatgctgtccagaagggaagcctgagtgaaaagatattgtcagtgagggtgcaagtccacctgaaaggagcggcaagagagatg

SEQ ID NO: 601645 - DNA, 880 bp, Homo sapiens
agaggagggaggcagcgggtgagagttcagagttcagcagcagcagcccgagcccatgattcccatatgccctgtagtttctttcacctatgtgcccagccggctggggaagatgccaaaatggcgacggcaactactttggattcacccacagcgggcgggccggcgggtgggtgcggcccaatatagccagcagccagcttcgggtgtagcctattctcatccaactacagtggctagctacatgtccatcaggctcagtagctgctcaacacagttactgtgcttatgcaaccagaagcgcgccacagtggcagctgctggacagggaccacctttacctaaaaaagcaccattccaaaataaacaagtgaaaccaaaaaggctccaaaacaccagagattcactatgggtggatgtggtaagatcagtgtgctggaccacagacttataaaggaacatttagaagggccaggaaacttaaaaaaaagaggttgctgggaagcttcaaaaattaccagagcgagaaaagttctacttcgtgggactcaaaatcaagctacgttgtggagctctggatgtgtttgtgtacagggagcacaatggtatggtggccaattcggggtgtaagcatccgaacgtggttacggttacaacaaagttgtaaacccattcatcaaagaccaattgttgttagccagtactcttcacaagtggtttgtcaaagcagaggggttcttaaggtggagaacaggctggaatgtctaggtgaaggttaagagggttgacaaggaacggtctatgattaatatgtcggggtcaattggggaattcccacattgggaaggcacgaaaaaaaagcgggtatcttttgtgtaaa

SEQ ID NO: 601646 - DNA, 1118 bp, Homo sapiens
  misc_feature (678)..(678): n is a, c, g, or t
gtgtccgtagcgctgtaggtctccgttggtctgtctggttggtgtctgttgctctgttggtgttccgctgctcacttctgtttggttgttgtttgccgccttgtcacgactgtttagtctcctgtttgcgggtgtcgcttttcgcggccttttaacaaacgcttttggggcagttccgtgatatttgcagatatgtggggcgtgtgtggtgtgcccgctttctagcacggtgctgggttatctggtgggatgtgttgtggtccgcgccgttgggtatgtagcctctgcgtgcgctcttagggtcccaaatttggagatttgtgaaagttggtgacgctttaacccccatggggcaccaacatcgttggtaaccagagggaggatttataagggaggtaatgttgacacccctgggtatgtccacgatgagaaatgacccgggcgccccttccgtccagcattttggcggccgttttttatgaaggcctttctatgggagtcactgtcccaagcggcctcactgtgccactgtgtgcgctgaggcccggagttagaggctgcttattattccgggtctgcccccccttgagcctcgagtgattctggaattcccaccctctgtgatttccccccacgtgaaccacgtcccactgtctagttcacgagttcccgctggtnttctggagaggcacttgcggttcctttccagtcacagctgagccgtggcccagtgtcctcccgtttgtcccgggtgacttcccacggtgagcccctcgccaggctttgctgccctcgagaggcctgaatggcacttcacgaagtttcagagtccactcgagatgacacggtccaccacgagtcgcctgccttcacggtcacacacacacatgttttaatcacgctggagtttgcctgcctatgagaggctttgagaagctccgccacactgctactgttggctatccacggagtgcttctgaaggctttgggctggcctaataaggccctgccccaactccctggggttttttttaccacattgttggacctggggaaggggggagtttaaaaaagaacccgaaagaaattgtccaaaacccataaatggaatcccccca

SEQ ID NO: 601647 - DNA, 187 bp, Homo sapiens
  misc_feature (47)..(47): n is a, c, g, or t
  misc_feature (62)..(62): n is a, c, g, or t
  misc_feature (71)..(71): n is a, c, g, or t
  misc_feature (77)..(77): n is a, c, g, or t
  misc_feature (92)..(92): n is a, c, g, or t
tgctgaatgttgtccaccaggttgttcttgaaactcttcaggtccantgctgcaagggagtngtctggggnataggncccatcactcatggngccttttgtatttgatcgtcttagtgcatcagcaatgtgtaccccacaatggtggttgagctgcttgccacattggaagaagtttcggcttttga

SEQ ID NO: 601648 - DNA, 413 bp, Homo sapiens
tgaagtgactctgagaatccttatgttctcgcatcgtagagaagaactggtataacagtaagtattccaatccaaaaccagggtactctgcccatttattcaagtctttaattgctttcaaaattgtatagtgctctccataaaggttttacacatcttttattttattcccaggtattttttatttataattctactttttaacttcagtgtgtttgttggtggtacactgtgatttatttttgtatgaatattttttttttttgggagacggatttcacccttttgcctagcccaggcctgggattacaggcgtgagccaccatgcctggctaagttttggtatttttagatagagacgggtttcaccatgtaagtcaggctggtctcaaactcctgaccttgtgatccgc

SEQ ID NO: 601649 - DNA, 1345 bp, Homo sapiens
agcggaggtgcttctggggtcacggatgtgctaagcgagggattctgagtgtgtgagcttgagagccgcgcgctagattcgatccggacgatggactggcgggcaccgtggaccgacggccgccgacacttcacgggctaagtgctcctgacttactgctgactggatggtggtctcacaggcgccgtgactctgtggacgcttgggcctggacgttaatcactctgtgggggctgctttcccggccaggatggccaggagatctacggagtttatcgcttggattgcatggaagcgcttacaaatagtcctgcatagtggttaatggtcggccgaatgtttaacatattactgtcgcatgtttgaccatcgattccatggaacttggggcggaaagcattggggaataggccatggaactcaccaaggcaaggggctgaccagaaggaggactggtctttatggaaaagccaaataacacggagaatgggatagctgctttcgatttccaccgttgacctggtggctcactggaggcgatattgatatttcccgatagacggcggtaacgaaaggaattcaaccgacacaagttgttagacattgagacagggcacacaccattttcgaaaggcgagggagattgaatggtataccttgggaagctagaaacttagggcgttgcccgagggaggagaggggaatcggaatcacacgagggccaacattggcgccagacaagtacatctgtgcgactctggtggtgggatagtagagccgagccccctttgttttcaacaaggggttggatttgctaaccgaatcagggcgttgcgggaaaatctcaagattgacacgtttggacatggtttccccttgggttgttaagcttttacccctaaggaaataacacaggtggaactcgaggttttttgtaatacgctacaccactaaaggtacgccgggaggcacttggggggagaggtcaggtttggttggacagaaaattcccacctctatgggccaaactgtgggagcacacctacgcgggggttagggtttacaaaaaagggatgtggccatttggatccataggcatcgttcccaatgagaggcaacaatatggaactccgtcttcatgttattttatgagcgttaacagagtgcaacagttggcctttgtcctacccccacattggatagggagggggttaacagccaacccaacggtcttgcgccacttcgtgtggacaacccttgggacacattaattgggttgagcttgggccatatggacccccttccaaagtaaccagcaagagaggaagatttgactatggggagg

SEQ ID NO: 601650 - DNA, 978 bp, Homo sapiens
  misc_feature (306)..(306): n is a, c, g, or t
  misc_feature (864)..(864): n is a, c, g, or t
gaatgggtgagaatgagctgagccggatccagtatgtgagtttttgtccaatctgctatcatgacctcaaggagtgccatgaatactatgatgtgtagaacgatgccaacggtaaaagcactaggaggttcgacattggcccgtgtaccctaagcagatgtcaacatacatgtgcctgagtgtggtgacagtagtagctgacagtcctgtgactgacaggtcaagggagaacttctactgggcgagtcagttcaaagccactgtggggagcactcaaggatccactctacttgtctgcgagctgantggcatggagagaggctgtatgcatcatcaccagcagtctggggtgtggtgactgcccaactgtgctatcgttagtcgtctgctcagacactatccacaagagatccacccataatcacttcttcatttttgggttctcggtactttccagtgacacacacgaaggtggccgtgtaggagacgcccctaggcccaaggagttgcactccctactcgtgcatagatttctgtcagtgcattgtctatggaattcggtagtactctatcagtgttactcgccccatgggctaggactgccccaaaatggagatagctgtctttgggccacgcttcccgtgcaagaacttggtcgcctgtggagtcgcggctggcgaggcgcctctaccgagcacaaatacgataccacgttgacctccatagcgtggagagacggcccacaaacgcgtataggtcgggcgagagaggacaatgctgatgggagcgtcgcttgcgaacggtttgaatttgcgcccattgctcctttcccgtcgtcacatcacatgttccagcggatgtcanagaaaggggctagtaatgcacatgggactgggctgagttatggatttcattccctcctttcgcctcgaaatccttagagaaggtggagtcattggcctttgaatgggaccgaaa

SEQ ID NO: 601651 - DNA, 300 bp, Homo sapiens
  misc_feature (124)..(124): n is a, c, g, or t
gtctactccgtggaaaaggccctggccttgctagagacctagacatccaaatacaagaaactcaaagaacacctgggcatttcagcacaaaaagatcatcacctaagcatgttgtggtcaggtnatctaaactcaagacgaagaaaagaatcttacgagctgtgagacaaaaacaccaggtaacctctaaaggaaaacctatcaggttaacaggagttttctcagcagaaaccctagaatccatagatggaattcaggctctctcttcagcgctcctcaaacaaatcacttatcagccag

SEQ ID NO: 601652 - DNA, 1003 bp, Homo sapiens
  misc_feature (371)..(371): n is a, c, g, or t
  misc_feature (447)..(447): n is a, c, g, or t
  misc_feature (449)..(449): n is a, c, g, or t
ggatgtgctaccgcggaagtgagcgtgggcatctagtgcacactccgggctaaggagtctatgagtcctcggtagtacttgaataaattgaagcagacagttcgtgtccgatggttgatagttgcgttgtcttcagagtcttgcccgtagcatcacgactgaagtgttcgtgtcgctcggaacctgtcttggaataactaagagattagacgagatatcgcatctactcatggagagaatctagagtcacgacacaaaggcgaaggcttgtcaaacagatcaatgtctagcgtgccatctgtcacacgaaaagactttgtgacctggttccaatacgaatactccggcgtcccctggcaactcctgggtantcttaatcctattgctagttatcgtcgcatgatgctactctctagacagacgggacacgatgaattatacggtacncntctaagcaatccgatgtgtcggtcattgtcactcctcaataccagaatagaggtgtcgccattgtgcacattgagccatctctcctagtaaacagttatgaccacaattcttctggtgcacatgacaccaagatgcacgatcctggtcatgagagtccgtacgtcccatccatggtcctacgcgcgtcagttcgatgttgtgcgttgcagatcgctaagtatgttgttcccaattaatcctaggcttccattggctaccgtgcttccttcgtatctcggaaccttctcagcttcagtgctacctctgatgcattcatcttggactactacggaatcatttaaggcgcgcagtatcggaatcgtctttcttggtgtcgtgataatgctgaggcattagcagaaagcccggtggtatcgcagtcttttcctgtcatcgaaggatcctaaagtagcgcgtctcaaatagcgctcaaggatcacctataagcgaaaaatatgtcgttgttgcccaggctggaatgtccagggatgccctagggtctgtggcccctgtg

SEQ ID NO: 601653 - DNA, 185 bp, Homo sapiens
ccccaaaaaaaaaaaaaaaaaatccaaaaatttacccagtgtcgcggtgcatgccagtagtcccatttactttggggctggtgtgggagatcacttaagcccaggaggtcaaggctccagtaagctaaaattgtgcccctgcactgcagcctgagtgacaaaatgagatcctgtctcagaaacca

SEQ ID NO: 601654 - DNA, 194 bp, Homo sapiens
ggggcgtaaagaggcgctagagaaagctgatcataaaccacagaactgactctggcaagcagaagggatcaaggaaagacctgaagaaccagaccctggaaagggccgggtcctgggggatctggggagcaggagcttttgagttggactggaggtttcttcagcgaacgagatgagcaaaacacccaatccac

SEQ ID NO: 601655 - DNA, 807 bp, Homo sapiens
ggacgcgcggctcccggtcgggcactgcaggcggcgacacgacttgggaaggccctttctggggtaatagtccggttcctgatgttcttgtcttatgagttacgggcagcacgagctgggtgaagtcgcgggcgggaggtccgtcgtgggtgcgcggcgtcctatcccagacgagagaccgctgcctagccggcttccctgcttctgtccgtggcctcgggtccccagaccctgcgcccctacgtccccgggtacccagtgctgttcccgtcccctactctggggacgatgcctcccggcgccgggtgggcggtgcatgctttcctcctcacccgtaactgggagcgagtgcctgtgcgcgctctggtctgcagaccctgctgtggcaatggagctcgtcgcagttctcttcgtactactaatttgattgcgttggcaagtgatcttcggtgccggggttttgaaatgactgtacgcaggtagaaacgtgcgaaagaaagacgctccatgcgtcttcctaggccagttctttgttgctagtgctcgcacgggacccatactcctatttgtctggtgcctcgtttttgctgcctctcgcttggtgctggtcctgaccttctgggccgctggtagatcgctgaggtgaatctgcagaatgcattcccatgtccgttgcacggggcgttttagtgggtcacctcatgtgcgattgtcttggagaaagtgaggactggctttacataattgactattagactgttgtaaatccaaaacctaagtgatctttaaagataagtgtatcccctg

SEQ ID NO: 601656 - DNA, 134 bp, Homo sapiens
catatagtcagggccggcatatggcatacagattcataaagtggtgactcgtggaaatgtccacagtggacatttccacgattcagggccggcatatggcatacagattcataaagtggtgactcgtggaaatg

SEQ ID NO: 601657 - DNA, 212 bp, Homo sapiens
ttgttcccgggaccctgtatcagctgaccctcctgtatgtgcacggcacgagtatgatactagaattaagtgcagtgtatagaaatgaaaaataaaaaaagggctcaaaaaagttctttaattctttactggtgtggccaatattagctgctgacatacaaggttctcagggccatgtcccagaaacagacgcagcaagtacaacctggccg

SEQ ID NO: 601658 - DNA, 218 bp, Homo sapiens
gtagtgaccagaacagggcagagtaggtcccctccatggccctgaatcctcctctgctccagggctggcctctgcagagctgattaaacagtgttgtgactctcttcccctttggtgggacctcccctttctttgggcttcagttcactcaggaagaaatgttgccagaaaaagtatctcctccaaccaaaacatctcaataaaaccattttagttga

SEQ ID NO: 601659 - DNA, 304 bp, Homo sapiens
ccccgtgaggcaggggtctaggatgattaaagcaatcagggggacggtgacgtttggactccctgaacgcctcgagctccttgtgtgagcacgatgaccccggcggagcacgcagcgacggtatgcaggcccctgcgcaagcgctgggtggactgcttccaggtgtcatataggaaaaatttgcgcacatggtatctggcgaagttgtccggaagcacggtcggaggggtcgacacgtccctctcggacttgacggaggtagcacagtacgtctccaggaggaccgggttcctcttgcgtaaac

SEQ ID NO: 601660 - DNA, 970 bp, Homo sapiens
cggctgcccccccctgcctctcctgcgccgatacacttcgagtggattctggccatttgagcattctctccaactctccaatgcccagtctgcccccacgggggtctcccccactctaccccgtccacagctaaaccctcttcgcctgaactcccttcctcatgcggtgaatgggactggcccgctcagactcccaggagcaccagagctggcccattgagtcaagaccatgccaccagcaggacggtggggacaccgggtgactcagacgtgactcaggaaggtcaggtcctgcatggcactccgcggaggtgagacggcgatcagagctgggatgggagactacccccaggaagaggggcaacccgagaggaggcaccaaggcccagcctggcgggcctccgcagtatgaaatggagcaccagaaggacacccaccaggcatggggcaccctcggacagagagaagatctccagagatgacggaccaggaactcagcattcaccctggaaggtccagggcaccacccgtgccctaaacgagggaagctacacggagaacggtgctccctgtcgctggcaccacggacgacacttgcagaacacatggtcctccgcacacgggccagtacccaccttcctactcgtgcctggccagcctggaccacggcacgaagcagcaccaccggcgtggttcaacctgatgcgctcctcattaatacatcatccgcagacgcatcaccggacatctacgaagcagacctgctacagcagccgaacccctatggcggcccccatacaccccgcgaccccgcacacgtggccacaagggaggccaaagatcgaagccccaaccaaccgcacactcgagcgccacacacaccacacacggccgccacgggcgtcgacccgagaccccccaggcacggtgcccagcccacagcacgccagacccacctgggcgccagaac

SEQ ID NO: 601661 - DNA, 438 bp, Homo sapiens
ggttaatgtctatgggtagaaggcaacaagtatttacaaaacagtatttaccaagtattataacagacatatacaaaatgccacatgatcttgtttaatccacacaataatcttgtgaaatagtgtctttttaataacagctttattgagatataattgacataccataaaagccacccttttaaaatgtacaattcagtaggttttagtacattcatagtgccatgacatcaaattagttgttatcactaattccagaacattgggttttttaaaaattttgatagagatgaagtttcactgtgttgctcaggctggtctcaaactcctgagtaaagtgatgcaaagtgccttggcctcccaaagtgctgagattacaggtgtgagccatggtggccagcccagaacattgtcttgagcagttttaagttcatagca

SEQ ID NO: 601662 - DNA, 853 bp, Homo sapiens
  misc_feature (488)..(488): n is a, c, g, or t
  misc_feature (508)..(508): n is a, c, g, or t
  misc_feature (596)..(596): n is a, c, g, or t
  misc_feature (701)..(702): n is a, c, g, or t
  misc_feature (707)..(707): n is a, c, g, or t
  misc_feature (709)..(709): n is a, c, g, or t
  misc_feature (712)..(712): n is a, c, g, or t
  misc_feature (720)..(721): n is a, c, g, or t
  misc_feature (733)..(733): n is a, c, g, or t
acggtggcggctctcggagccggcgcgaatccggcccccgcagcgggacccgggcaggtcttgacgagccctgcccgggccgacgcatgcggaggatggaaacacttgcccggcaatgtctctgggccgcctccttcgcagggcctcctccaaagcctcggacctcctgaccctcacccccggtggcagcggcagcgggtccccctctgtcctggatggagagatcatctactccaagaacaatgtctgcgtgcacccgccggaggggctgcaggggctgggggagcaccacccaggttacctgtgcttgtacatggagaaggatgagatgctgggagccaccctcatcctggcatgggtccccaactctcgcatccagaggcaggacgaggaggccctgcgctacatcacacccgagagctcccccgttcgcaaggcaccccgccctcggggccggcgcacccggagctcaggagcctcccaccagncctccccgacggagctgcgngctaccctgaccccaaagatgaggacatcctggtggtggcccagagtgttccagaccgatgctcgccagccctgcgccagaggatganggagaagctggcgcagggcttgggggtggatggtgccagccagctcgcaagcctgcttgcagcccctccgggatcttgtcgacggcagccggggatgtcaccgannagggngnaancggggccnnagccgggcagangatggtcttagaagtgaacgatgggggtgaccgagacgtactatgagaagaccaaacattatctggcttgcttcgacatcaaagggggggcgaaaaccgcggtggagaggacagaccgta

SEQ ID NO: 601663 - DNA, 610 bp, Homo sapiens
  misc_feature (574)..(574): n is a, c, g, or t
acggtggcggctctcggagccggcgcgaatccggcccccgcagcgggacccgggcaggtcttgacgagccctgcccgggccgacgcatgcggaggatggaaacacttgcccggcaatgtctctgggccgcctccttcgcagggcctcctccaaagcctcggacctcctgaccctcacccccggtggcagcggcagcgggtccccctctgtcctggatggagagatcatctactccaagaacaatgtctgcgtgcacccgccggaggggctgcaggggctgggggagcaccacccaggtgagccagggcaggcgaggctccagggtcgcacagcccaggttattttccgagccagggctctaaaggccctgggccacagcacgtgagagtgcatttggttcctcttccagaacgtgtaacaacagcagctgtcctcccggaaggagggtctggggggtgttaagtctggctcatggcaggctgggtgagtccctcagccctgctgcttccaaagggagggacaaaagatgggttagtgatccctcaggcctgcctggccccttgtcattcgtgtnaatgacttgcaacaaataaatgcattgctttgttca

SEQ ID NO: 601664 - DNA, 284 bp, Homo sapiens
accagaagtaccataaaggggtgagacttgtcctctctatcgtggtgtgaggacctgtgacggacagcttctctgttttgcagacataatttgaggtgcaaggccccccaacagccagcctgttgtggtggtgtttgtgtgggttggtactagacccctgcatgtcttaaatgctgtcccttacgggggtggagaaggctgtaagcaaagggggaatcaccaccccagcccccacccccacccttcttagttttgtgaattaaaatatttgcaaatccaaaaaa

SEQ ID NO: 601665 - DNA, 284 bp, Homo sapiens
  misc_feature (1)..(1): n is a, c, g, or t
  misc_feature (193)..(193): n is a, c, g, or t
nagaaaaggatgatttttattacttgtctcaagaagacaaagagagacgaagcggacatgaagaatccagaggtgcccagaataaaatctgtgctgggatttaaagcttcagaggcagaaaggcgaatggagcactcattagtgacatgccgtgtgaatcttgttcctgtagacccagtggacccataagtanattcaagaaaaccatcaatgaattcagatatgggaaaagtcagtaaaaatgatactgaagaggaaagtaataaatccgccacaacagacaa

SEQ ID NO: 601666 - DNA, 899 bp, Homo sapiens
acagtgtgtgtgtgtgcacgtacatactgtatagtcttaaaaatagcattatactggccagggtggtggctaacgcctgtaatcccagcacttgggaggccgaggcgggtggatcaactgtggtcaggagttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctggcaacagagtgagattccgtctcaaaaaaacgaacagaggaacgggaaaacaacaatagctttatacctcttccttgtgtttccaaccgcaaggaaatttctggaacactccaaatccagtggaataactccaaaaacaaacatttctacggtatacacctactttcaccttcttatagtaactagtctacttttaaaaagcctcagggtatataatgcttgttaaaagagtaacaattcaggtgcggttaaaattaaccaaaatatgttctctagtttgagaacaacttaggctattttcagtgcgtgtgtaagcctcaggtgcttaccgtgggtgccaactaattttcggacaattcccgctgactgtgtaaaaacccatcgtttggtgacaatggcagaaatttaagaggctggattaggtagctggaacacataatgaatggaatccagcaatgagggcggggggactaacacaagacaatttaaaccaatatggtgtttacagactcctgttagatattaacaacgggtccaacgcatttgtgtgacagcgcattggttcgatctcgtgtactccataacagtg

SEQ ID NO: 601667 - DNA, 198 bp, Homo sapiens
caggatttcttactccctcccctgctttatttttctccacagcaattattcactacagtataccttgctttacatttattcctatttacttggctttctctttctaccctgtaagaatgttatgctccatgcagcaacaaggcgaactttccctggttattactgtgaatgtatctcttggtctctaagaatgaggtc

SEQ ID NO: 601668 - DNA, 273 bp, Homo sapiens
  misc_feature (262)..(262): n is a, c, g, or t
  misc_feature (268)..(268): n is a, c, g, or t
tacacttagcttaaaacccacattatacagctacacaaaaatattttctttatatctttactctacaagctttttttggttaaaaatatttgttttcccttaaaacttttttttttttaaatggagcctaggcctacacagggtcaggatcattaatatcactgtctttcattttcacatcgtcccactagaaggccttcaggggcagtaacatgcatggagctgtcatcatttatgataacaatgcctccttcttggggcnttcccnggggg

SEQ ID NO: 601669 - DNA, 219 bp, Homo sapiens
cgagctcggcaccctgttttatacatttcctataaaacacttaccaattaactgtatttttaattactcataaaattaaaaaaattttagattctgtctctcacactagattgcacaacctatttgggaaaggactgcctttgtcttgtttatcgttattccctggaatcctgccttctgacctgccatttggggacattcagcaatatctgatgagtg

SEQ ID NO: 601670 - DNA, 423 bp, Homo sapiens
ccctgctatatcccacgtacatcatagcatgaatcttatagccggctaccaagttctgaatgaactgtcccctcagggcatagctccacgtgcccatgacatgagactaccactcgctctgacaaaggacgctctacgcctccttgcaactgtgcatatggaagcaagcctttgcaagcacgtcagggcttactaaacacttcgtgtatcgatgatcctcctagtacaggacatgctgctatgtgtaataaggaccagctttcagtagtggagataccactgtgaggaagtcagcgcatgtggagatttcactcactagaagctgaataccttcagctaacagactgactgcgggcctatgagagcttgtgcggctggaggtcagactctggctgaagctaatgagtagcaccttggatctcg

SEQ ID NO: 601671 - DNA, 852 bp, Homo sapiens
cagcccctccgtcccggcggctctggggcgtatgacgcagcagccaaagcagcggcagcgtgcaggacgtgccctctccgcgcgggggactcgcctagtgtctcctacgtctgcccctgcccaggctccctggcggccccatgctgtcacctggctcccctccatgtgattgcacatggctgcatgcccccccggctgatgccgctctggtgcctcctcactttggtgacccagcttctcctgctcccacctcgtggccccaggcctcgtgctttgcggagcggtcacacgatgttgcttgtgccacgactgcgactgacttggtgctgcctatactatgcggtaccatcaacacaacacggtgcgacatgttgctacgcggacgcgttgtgtcttggtccacgctttcgcgggcactgacttctgcacgtttcttggttctattgcgaaagcgacacttacgccctagctagccctaccctggagatggaactcctctgttgtgtctgtccgctcttgatgacttgtggtccctgggaacctggcatggtcaggcttgtgaagaacgtgtccgccattggctgcagagcggcaggtcacctgcaattggtccagccttgctcattccctccacggactggtcctctagtattcaccctgtcctggccttaggttccccaagcccatctggcttctggcccaatggcttgcttagcctttctcttaagttccatccatccgggtttcagccccagggtatcaagccacgcccatgctacccgggcgttggcaattaacctcatgcagcgcagaacgatggcttaacattgcatcctatgctaccccaactca

SEQ ID NO: 601672 - DNA, 738 bp, Homo sapiens
ggctccgttcggctcggctcgcccatttcagttcagttcgggtcagttatgctccgtcagttcagcatgctgcgcgccagatcaccactgtccgccgcggaccggcctgagccgcgctgttgtccgccgtcgcaccagcgcggtgccagcccccaagccagtcagacctgaggtcttctgcaagccagatcttcattaagcaatgagtggcacgacgccgtcagcaggaaaacatttcccaccgtcaacccttccacaggggaaggtcatctgccaggtggcccgaagggaacaaggaggactgtagacagatgcagtgaaggctgctcgtgcagccttccagcgtgggctcgccctggcgccgcgatggatgcgatctgaccggggccggctgttgtcccgagttgcggatctcattgaacgggaccggaccttacctagcggcctttggctgaccctggacacctggcacagccttattgtcaatctcgtacctggtggatttggacatggtcctgaaatgtctccgctattacgctgagctgggctggacaagtaccatggggaagaaccattcccatcgacgtgtgactatctgtcagactatacccgccatgagccttgtgggcgtgtgtggcccagatcattccgtggaacttcccgctcctgatgcgagcatgaaactgggccaagcttgcaaccgggaaccgtgggtcgcatgcaggtggccgacaaaac

SEQ ID NO: 601673 - DNA, 379 bp, Homo sapiens
cctatcacttcctgtacaaaaccaactccaaatggatgaaagacctaaatgtaagacctaaacaataaaactaccataagagaaaacaagaagcactatcaggacattggtctcgggaaaagattttatgactgagcactcaaacagccactaggctaacaacaaaccatgggcatcgatatccaaatataacaaagcttcttgtgccagcaccaggcacaacccatccaacgagatgcaaacagactagacttcacagcaatcgggcagcaacaatcattgtgtcaacactcactccatgccaacaagcaggcattcaatcattccagcaatcatagcacaacatattcaaaacaatcttataatcagccaaaaacaa

SEQ ID NO: 601674 - DNA, 827 bp, Homo sapiens
cgaaccaaggtcaaggatttgaggcgatggcatgtaccccgtccgccctgccgagtgctgttccgtgcaccataggggccgctcctgttaggcgtcgagacgaggcccatcatattttgacggtaaagggggcttataaagcccgctctggggtcccccctgctcctcgtgcatgattccaccgtcaccccccctctggtgccactgtactggggatccccgcgctggtaatttgttactttctgtcggccatgcaggaatgatcacgtggtcgtcacgggagttccttggcgcgtacccagggctgttttgcttctcgggtggccccccccgtggagcaactgcttcggctcgctctctcccgggccctcctggagtaatgaagtttctcttgcatctcgcgccaaaccacagatgtcggcgcagattgggcgctccgtacacgaagacagatgggggtcctccttcgccggtcttcattggccgtgctcggcttagctggccccgattctagcccatcctctccaattatctgcctcactccccaccgcatttataatgttctccccccctttgacccgccatcctcgctttttttgtgccataacctcagcgaatcacctcccctctggttgactcctggatctcggcgaggccaaacccccaaaggagcaccccttttacccttcattcgaggccagagatgcaatgccttggtataactgtctcgcctcacgcactgtctcttggagttgctttaaaacacacaaaacttaattccccgctaattaggaaacccaaaatccctcaggggccccaacaaaaca

SEQ ID NO: 601675 - DNA, 818 bp, Homo sapiens
ttcggaggggcccccccctagtgttccgtccggaccggggcgcccgtgtgtgtttgcccccgccctcgccaaggtgtttgtgggccgcgccccccttgtttttgccgcgagcgtgcgttctatatggggagccccccttactgggtgatcgcgagtggtgcggccccctctttttggtacgctaccgtgtgtcctctgtccccgatggtcacgctgcgcactgtgactttcccgcccttggttgggcgaacaccctctttcgcgcggcccctcccgcagagattgcggggcaggttgttccctgggacccccccctggggagtaacgctccccgccgttctttggcggcgcgcaaccccctgggccgctctcctgtctctccccccacggcggtggcacccactcatgggaccgcctgttctcacgcccctactatgtgctgggagtgtatgctgcgctgcgctcccactctctttctcctcttctggtgccagcacccgccgctgttggttctcgcccggatggctttcttgccgcccccctccgaaggggcttggtagggcctcctcaccggggccgacccgcgcacggggggccacctctccatcccacacatcaatctgtgggcatcttcgccctcttatcgtgcgcacggttttccccgaggggcctcgctgcatactatatcctgcggggtgtgtgggggagatagtctggcatgcccccccctcctctctgtctcagcgagtattccttcttgtcgcgctgtatccccggtgcgggactcccctttgacgctatctgtcccccacataaca

SEQ ID NO: 601676 - DNA, 330 bp, Homo sapiens
gcacgagctgggatttgctttaaaatgttccaggctgggcccagtggctcatgcctgtaatcctaacacgttgggaggcccaggtgggaggatcgcttgagcccaggagtttgaaaccagcctggcaacatagcaagaccctatttttccaaaaaaaaaaaaaaaaaaaaaacccctaaaaagttacccaggcagttagcttcgtacctgaggtcccagcttcttgggaagctgagctgggaggatcagttgggcatgggagttcgaggctgcagtgagccatgatcatgcctgcactccagcctgggtgacagagtgagaccctatcta

SEQ ID NO: 601677 - DNA, 174 bp, Homo sapiens
acgagcatcttacaggtacttcggaggctgacttggctcatcaggatgttcttcatgtaaaagtccagtagggcgctctggtgctggacgggaccacgtccatctcctgtgtgactcgtgcagaacggcaccagcagccccagcatgccagcatagttctggtggggctctagg

SEQ ID NO: 601678 - DNA, 105 bp, Homo sapiens
cagagtggctaacatggagctctgagatcaccccacttccatcatttcctccctcccccaacccaacgctttttgggatcagctcagacatatttcagtataaaa

SEQ ID NO: 601679 - DNA, 194 bp, Homo sapiens
  misc_feature (6)..(6): n is a, c, g, or t
  misc_feature (20)..(20): n is a, c, g, or t
  misc_feature (115)..(115): n is a, c, g, or t
  misc_feature (121)..(121): n is a, c, g, or t
  misc_feature (152)..(153): n is a, c, g, or t
actttnaacctctgtactgnttcctgtgggaagtactcgccactttccatgtggcatctcttgtatgcaaactagattgtgcgctcctagagggcagagtccactctgatcacgnttgtgntgtcttccttacccttctggcgcctaatacnntgccttgcacacagacacaataaatggcagttgaataacaa

SEQ ID NO: 601680 - DNA, 81 bp, Homo sapiens
tttgctagattgatattaaaaactcatgtggaggaactcaaggaatgtttagaagaccaaaagtcccccaatgacaggacc

SEQ ID NO: 601681 - DNA, 762 bp, Homo sapiens
  misc_feature (623)..(623): n is a, c, g, or t
tcccagcccccggttaccggaccctgcagccgcaaaaattttgatgcctaaaaaaaaccggattgccttttatgaactcctttttaaggagggattcatggtggccaaaaaggttgtccacatgtgccttaagcacccggagcgtggcagacaaaattgtgtgcccaacctttcagtgtcatgaaggccagtgcagtctctcaagtctcccgaggctacgttgaaggaacagttgtgccgtggagacattttctacgtggtaccttaccaagtgagggtactccagtatctccgtgatttacctttcattctttgcccccggagaatttgtgcctgccacccttacgccgttagccgctccagagaccgtggcaggccttcggcctaaaggctctggagggttgagcgacctgcgagatctcacaagaggggaagcttgacagagataccttacagacggagttgctgtgcccccgggtgccgacaagaaagccgaggctggggctgggtcagcaaccgatttccagtttagaggcggattgggtcgtggacgtggtcagccacctcagttaaattgggagaggatactttggctttgaataaatttacagccaaaaaccttnaaaaaaacaaataaaatataaaaaaacccccggggtttttttgggggggaccaagtgtaaaaggcacggtctagcttttcctgccccctttttccaaggggaatgcggcccaagaggggataatcaacgttctctcacg

SEQ ID NO: 601682 - DNA, 970 bp, Homo sapiens
tgtaaagcgctgatcctgttaatttgggaaggaaaacgagacaactccagcagcccaggagggacagggggatttaatcctcctcctcgtcgtctccagccccagccccacacctggcccattcattggaatataacttcctctttcactgcggcccggagcttggcacacccccgtaagggaagaagcgcagagaagaaagatcacatgattgctatctaggagaatccaggcggcacatgaaagagcacggtgatgttccaccaaccatgcttgacggcaccctgaataatggcgctggcggcatcagcaacgacgaagcgtgtgggggggacgtggaatgtatggcacaaagccccagactattgaaagacacgtgggactctgacaaggacgataattactcaataaaaaactccttagatactctctatcaggcccaagagattgttaaacctccaagcttcaactcatgtgaccactcaatacaggacaccccacatgcggaaccacccagcccgccatgcaagggcctgttcagccatttcacgaaacatgaccggccgggtgtgtgaccactcctccatacaagcgtacagccatgctcaccgggagcagcgccttgacgggatcatctcgcccccaggataaaaattatggacccctaccagaacgctcacacgtagaggtagccggagccgccatacactccgaccgaaacaagacatgaccagatcaatgagggcagaagacacgaacatcaccacggaaaggggtacaacacgagcgggcaccaacatacagcttgtgggagacaaacacccaagcacccgggccacacgggacagatgggacccgcaatcccaagagagcgctaagcaaaacaccatattggacgcgcgtagaaggccgaaaaaccccgggccgacaccgaacacagtgcatcacggcacagccccacgagcccgaa

SEQ ID NO: 601683 - DNA, 225 bp, Homo sapiens
ctatttcaggatgcaatccaggatcccacctggcattcgttgtcatgtctccattagcatcctccagaatgtgacagtacctcagtcttttcttggtttttcatgaccttgacaatttttgaagggaattggtcactttattttttaggacaaagttgggcccacttttctaacttggggccaatggtaagggttttcgttttcaggcacatatctcgtgtgcac

SEQ ID NO: 601684 - DNA, 458 bp, Homo sapiens
gaggaaaacacaagcaggatcctccgcatgcggtgggaggaagaaggtgtggagatgagtagggccgcctacacgggtgttacctgcttcgggctgagaacgtcattgcgttacgccatccagctcatcacagttgccagcttggtgtgccggaaacgcaagggtacagaagtgcaggtggatgacatcaagcgggtttactcactcttcctggacgagtcccgctccacgcagtacatgaaggagtaccaggacgccttcctcttcaacgaactcaaaggcgagaccatggacacctcctgagttggatgtcatcccccgacccccccctgttttcccccagagttctgaccctgtgactctgtataaaatggttgggaagctgccccccccctgggtatgggtggttgccctgagcccccagaaagaccccgccagagtgcggattgagaagccca

SEQ ID NO: 601685 - DNA, 484 bp, Homo sapiens
gtctaggtggttgtgtgtgctgctgtgtgtgtgatgtgtgttgtgttgctagtgtgtgttgtgttgctgtagtgtgctgtgctgctggtgaggatgacgatgctgtaaatggagttgctgtaatctccaatctccctgctgtagttgctggagtactctatgctgctgtggcggctgctgaggaggtcactgacccaataaaatttcaggaccatttccaggtcttagtgccccttttgttctatggttaccgaattcaacaggagcaaggactttaacaggtgttgctgaactttgaatggtcagcacactgggagtggcagtagtagcagagttaggctttggtctttgtcttggtgcagttgaggtctctgttggtccaatggtatctgttattctggcttttatttggcttttcctagcagctgcttcactagcagtcatcggttcaggaagagattcgcttcaatgcacgtcgctttcc

SEQ ID NO: 601686 - DNA, 859 bp, Homo sapiens
  misc_feature (748)..(748): n is a, c, g, or t
cttgttcctgcgaatgaagctgctttattgatgaacataatactactgccttgctgtacagaacaggaacagtcacctttttttgtatctccaattataaatgcactacatactgtaaaaagaaaagaaaacatcgtaaatatctttataaagtaacaacaagaaagaggatgaataaatataataactgattccaattgatataaaataaacaaaaaattgtgtaggacatgaaatttttaccacgagggataaaactccaaggtgaagccaattgggccccgaagccctaaaagggggagcttggcctcccttcccttttagggggggcaactgctggcccttccctaagtgacgcgttagcccacgaccctcgggcggggactagcggtactcgctcattcaagggcggaagaccggtattacccaaatcacggggatgcccccggaatcacacagtgtccaaagaggcccccaaaaggcaacatatccgcaaaaggccggcgcggggggcataatcccaaagacgccccccccctgaaaaattttccataaccccccgcctcttgaaaaggcgggcacaccctccacgggacaataaaaatccggcgcggtttcgccctggaaaatttccgtgtgcgggctatcttgtcccggaacttgcccgttaacggaaacctgtccccccttatccccttagagaagaggggggtctttttcttaataatacggcgaaaggtttctcatnctcggtggacagacctccaccccgaacgagggccggtgaggccaaccccgcttatatcccaccgcgcgcccaatccggagaaaaacggtatgagatcaacacggaaaaaaa

SEQ ID NO: 601687 - DNA, 126 bp, Homo sapiens
gccccccccccccccgggcccccgggggggggggtttcccccttcccttttggtcccggcccgggggggggggttttttggggggggggggttttttccttttaaaaaccccccgccccgggggga

SEQ ID NO: 601688 - DNA, 1745 bp, Homo sapiens
  misc_feature (1744)..(1744): n is a, c, g, or t
ggcagcagcaagccagtcagtcactcaaagcagcagtgccgtcatttcgccagcattggcagctgcagcttgtggactgcccagacagcatcagcgaacgcacatggcacacactgcaacagtggcacacatccaggcacacaaggtaatgagcacagcacagaaaagccactgcacaacagcacacaaacagcaagtttgcaacaaacacagcaacaggggtcacggcagtttcaacaccagtgtgcattgccaggcatattggctaacagccacagttggccccttctggggtataaggggcatgcacaatctatccacaacaggcaatcaggcatttctttcggcagacacaccagacaatcagcaacacacaatcctcaaacagcattgggcatcattgtttggcattcatcattccaactcacgtttggtggtcatattataacacccaaaacattggcacaacacaatttgcaattcacttgcattgggcgcaacagattcacattgggcccaacgtcacgaccaattaggcaagacaaagacttccaacgcacgtgactgtggttcacgaacaggctgcggaactcatgtgtgacaacggagggacacccaagtcaatttcccgggaatgagacaacacaacacacccctatactatgaggggagaaacgacgtcaaccccacacaggggcaattgcaggggcaattagaacacgtgacacacacaggagtgctccattggtccgacaccggttctaacgatttcgcgccacacacaacgtagtttcacaacttcaaccacaggccttggggcctttctacgacacaccgcgaacgatcaattatacgtggagcacaacaacctcggtatcgagcgccacacatctgggatttcggatacgcaagactactttacacagaggtatattaatacgccaacagagtaattatacacgtaaaaagagaatccataacacactggggggtaagacaactccgccatacaagtggtcagaacatattatcggcaacgtagtcagcgtacggaacaattctcgagacaaccagcacgaagaaggacacacaaacgagcaggagacaacaacaagcaacaaattgggcagatagacactaacaagaaaaaccgcaaaccgcagacacaaaaaggccacccagagaggaaaagaccctgaggcaaatatagtccaaaaacaaaccggtgaaaaaaacataagacacccagtattccgagccatataacacagatgatggtgacagcagcaaaaagagacacacgcgacacacagaagaacagcaagcgccagaagagtacaacggagcacgcacacaactttcccaggacaagatagaaacctagtgagacaagcgaccacaagagaacatagacgaaagaaaggacacacagcacacatatggggagcagacaagggaccaatgaacacacaaaaagagagtaaacaggcaaaaacaggacgatacaacagacaaagtaacgaagacaataccagacgaagcgaagacaccagtagatacgacagcgcgcgatcaaagaaaaactagagtagcgagagagaccaagcgagactaatataggacagaagagcaatactagtacaaaaacggcgacagtagacagtgccgagatcgtccactcagaagcagaacaaagcagcacgagaccgataagatgacgtcgatcctagtatgagtgaaacgna

SEQ ID NO: 601689 - DNA, 267 bp, Homo sapiens
  misc_feature (241)..(241): n is a, c, g, or t
  misc_feature (248)..(248): n is a, c, g, or t
cttcctagtattcatgtctaccaaatgctttctttggcttcctctgaaagaagccagtttcagcaagtgagtttgtgattctttctcctttcaggtacctgtttcccaggggtttgagatcagcctggcaaacatggtgaaaccatcaacccaaagtgccgagactacaggtgtgagctaccgcacccagcatatttatttatttttcagtctcactattttaaccaagctggtcttgaantcctggnctcaagcaatcctcccatc

SEQ ID NO: 601690 - DNA, 266 bp, Homo sapiens
  misc_feature (80)..(80): n is a, c, g, or t
taggtaagtgggggcggggaagggtccatagctgttttaaatgagggacgtggtccggacgtcccctaaccaagttaggntaagtcaagatcaccattccagggttggtaatgttggatgatgaaccattcatttttcccttgtggatgctagtgctgtagagttccctgttgtaccccgtttgttttctatttgtcaagaaaaaggacagcatcctggcatcatttttgagggtaataaatttgaaaaatcagatttcttcccca

SEQ ID NO: 601691 - DNA, 841 bp, Homo sapiens
  misc_feature (526)..(526): n is a, c, g, or t
gctatatcgtggcaccagatgatggtgtcccagtcagacgatgatttgggcaccgtcccgtgactataaccagctgaagaagcaggagctgcaggcaggcgacagcctataagtttcgtgttgtccggaatcaatgccggtggccgggggcccttcagcgaaatctcagcttgaagacgtgcctgcctgtgtttcccagggtccccttgtgccattaccacatcagcggaaagtccggagtggtgctcacctcaccatgggagccagcctctgtgacctccggcgaagattatcgagtactccgtgtacctggcatcgcagagctcacatggctgggggcgagctcaagagctcacaacccggtccaggctggccttcagtgctgggtgtactgtgggcccaggcccctcctgactggtgcagtccgtccagcctttccaagtgcccacgatctgaatacgagcactcaatgcccgcacatcagtcttcctgcatcagcgtccgcaaatgaggaaggggctatggnccggccacacaagtgaggtggtgcgaggaaaccagtgaaagacagctctggccaccaagcgcagccaaaaagctggcctctgcgcctcgtggccaggtctgggggcatggcatggatggggcatggaaacggggtcctccttgggcctcaccaagagttgtgcttttcttggcgaccctgggcgtgggttgtgtggccgtggacctttgtcttccccctggtggtttccaggcacctaagttcctttctcagggtccccgggcccccctgttttgggacccgcggagtttcctttctcaaaggccttgggttccc

SEQ ID NO: 601692 - DNA, 858 bp, Homo sapiens
tgtggttgggatatagtgtccgtggcaggacgctgtgtccccgagcggggcttgggggcatgtgtggtgaaacggggccccacgggggaccccttctgggacgtgtgtatccggggtgacgcggctttgtcgccgcaggccccttccggggtggcccctggtctccccgcagggtgggggtccccaatgggtttagtcggccagcgagcttcgtccagggttcacctgcgccacaatggttcgtcccggcggccgatcgagaccccgccagatgcgcgcggccggccttacaagccgccgcgctcctcctggcagatgtcgagcagcggggtctcgggatggttccggcacactgcggtgttccccgcgccgccccgctcccctggagtgctccagccagcttgtgccccggacgagctctgatctgggtctatgctccccggactggcgtggtggatgagtcaccggcagagcgcggaggagcgggcaaggaccgagccctcggcgacaatccgacaccggtgcttcacgcgggaaatgagcggcgctgccccccggtgtggaccccttccacagtttcctgctgcctgtcaccctgagggcactctgttccgtggaggcccccatgcccgcagctagccgcgcagtgcgacgagatcaccatcccagtggccttcgagtccgggtctctgcttgggggcccagaagctgccttaatccgatgagactgccgccaaattattccttctgcccggatcccactcctgccccctccactggctgtcctcccccccaccgtgtttcttttgatacctttatcttcttttttatcaaataaagttcaaagcaaccacctga

SEQ ID NO: 601693 - DNA, 426 bp, Homo sapiens
gaatgtcgaggctgcaatgagccatggtcatgccattgcactccaacctgggcaagagaacgagaccctgtctcaaaaaaagagagaaaaaaaaaaaaagaaaaaatactccatttgaaatgactgcaatttcagtatgtgtagcatggatcaggtgtgatagctaatagaaagctaatagggtcttgagtgctgaagggggaagtagcctgtatgccaagagatgtgctgatccctgctatgcattggtaaacactaagttaggggcatatgtattctgttctttaactcaaggacattaacaagctgaagtatgtacagaaggattaccaaggtattgagtcgtatgaggaattccaaggaggagaaggccagaaaagagaaatcttggtgtaagcccgttttaaatgtttgaaaggactatgc

SEQ ID NO: 601694 - DNA, 101 bp, Homo sapiens
ctagattctgcttcttgaaaagtctaatccaatcagatcactatatattaccagaaaagctttgaaatactgattgcagattcatttcaagagtatgattt

SEQ ID NO: 601695 - DNA, 108 bp, Homo sapiens
gcaacactctactgtatatttcgaactatcttggcagatagtaacaattcaaatttttctagcataaagacaatagttaaggtgatagatatacgaacacaaggtacg

SEQ ID NO: 601696 - DNA, 183 bp, Homo sapiens
aaaatgcgcatgagaacctgaagaagagtaagaggaaagataactcaaagatctaggagtgacaacgatgcctctaggccgagacacgaaagcttatcggaacgggccttaatcaaccatccagatcgcaatagtgaccagtcctaggtcaagaaggaggagaagaagttcaaggaagttgga

SEQ ID NO: 601697 - DNA, 525 bp, Homo sapiens
aggagggctaacaaaccttccaaaatccaaccatgtctaagaagacgaccagggactcccccagggactccaggtcccaagcgataacactgtcgtgaagcacccccaagccactatccactgagaatccagctccatacatggggtgtatatttattctgaacgggagaagttatatggttaaaagtgtaaaagaataattgtgtatgaagctgccttattttttttctatttgtaagttactatttgcatgtgaatatttatgtagataagatttgcctcctggtaagcctgtaatggatggggcccagaagtgaaatatttgagaaaaacaagtgaaagggtcaagatacaaatgtgtattaaaaaaaaagcctattaatagggtttctgcgcggggcagggtggtaaaccggctttatcttttaggattatccctaaatgcatcttctttataaacttgactggctatctcagcaagataaattatattaaaaaaataagaaccctgaagatcgtcggtgg

SEQ ID NO: 601698 - DNA, 146 bp, Homo sapiens
acatgatacaattcgagctggtacctactgggttaggtctacctgggttaggtacctgggttaggtctacctgggttaggtctacctgggttaggtctacgttaggtctacctgggttaggtctacctgtggttaggtctacctgg

SEQ ID NO: 601699 - DNA, 329 bp, Homo sapiens
  misc_feature (197)..(197): n is a, c, g, or t
  misc_feature (232)..(232): n is a, c, g, or t
  misc_feature (273)..(273): n is a, c, g, or t
  misc_feature (307)..(307): n is a, c, g, or t
acaactcggaagccaatacaagttttccaaaattctaactttttcttagaacttgaattttattattggtataattttccttgaagtgacatactcaattcattaatttttaaaaaatgtctgccaagtacccttgtctgaattaccataatttatgtcagttgttcttacatgtgaaaatgtgtttcatgaaaaangtggctagtttagcttgcactgcaaacaattgctntttccttaagacaaacattttaagttctttcttgagacttnttaaatttgtcacacagatattaaaaagatgtgntgctcaaaagtcaagatttcat

SEQ ID NO: 601700 - DNA, 278 bp, Homo sapiens
  misc_feature (160)..(160): n is a, c, g, or t
  misc_feature (247)..(247): n is a, c, g, or t
  misc_feature (256)..(256): n is a, c, g, or t
  misc_feature (260)..(260): n is a, c, g, or t
  misc_feature (262)..(262): n is a, c, g, or t
  misc_feature (264)..(264): n is a, c, g, or t
tgaggttgaacgtgagacggtctggtttagagtagtccatcctatttatcgaatatcttgttccttgttaaggttgttggatatggacccggtagcacatgaattgtatggctttgaacaaggcgtgggtaccgatttgccggaatgctacgtgtggttngttgatgccgattgtaactattatgagtcctagttgacttgaagtggagaaggctacgattttttgatgtcattttgtgtaagggcncacgcgccngagngntnctctagaacagcta

SEQ ID NO: 601701 - DNA, 816 bp, Homo sapiens
  misc_feature (25)..(25): n is a, c, g, or t
  misc_feature (71)..(71): n is a, c, g, or t
  misc_feature (144)..(144): n is a, c, g, or t
  misc_feature (163)..(163): n is a, c, g, or t
  misc_feature (177)..(177): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (201)..(201): n is a, c, g, or t
  misc_feature (209)..(209): n is a, c, g, or t
  misc_feature (213)..(213): n is a, c, g, or t
  misc_feature (218)..(218): n is a, c, g, or t
  misc_feature (241)..(241): n is a, c, g, or t
  misc_feature (243)..(243): n is a, c, g, or t
  misc_feature (282)..(282): n is a, c, g, or t
  misc_feature (286)..(286): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (301)..(301): n is a, c, g, or t
  misc_feature (308)..(308): n is a, c, g, or t
  misc_feature (319)..(319): n is a, c, g, or t
  misc_feature (324)..(324): n is a, c, g, or t
  misc_feature (333)..(333): n is a, c, g, or t
  misc_feature (340)..(340): n is a, c, g, or t
  misc_feature (349)..(349): n is a, c, g, or t
  misc_feature (353)..(353): n is a, c, g, or t
  misc_feature (357)..(357): n is a, c, g, or t
  misc_feature (388)..(388): n is a, c, g, or t
  misc_feature (409)..(409): n is a, c, g, or t
  misc_feature (414)..(414): n is a, c, g, or t
  misc_feature (418)..(418): n is a, c, g, or t
  misc_feature (501)..(501): n is a, c, g, or t
  misc_feature (510)..(510): n is a, c, g, or t
  misc_feature (514)..(514): n is a, c, g, or t
  misc_feature (552)..(552): n is a, c, g, or t
  misc_feature (556)..(556): n is a, c, g, or t
  misc_feature (601)..(601): n is a, c, g, or t
tactcagagctgcgcttgtactacngcgtgtgccaacctgcacctggaggagacgctggccgagttctggncccgcctgctcgagcgcctcttcaagcagctgcaccccacagctgctgctgcctgatgactacctggactgcntgggcaagcaggccgaggngctgcggcccttcngggaggccccganananctgcgcntgcgggcnaccngtgcnttcgtggctgtctcttttctttntncaaggcctgggcgtggccagcgacgtggtccggaaagtngctnangttccnctnggcncggagtnctctatagctntcatnaagctggtntactgtnctcactgcntggnagtncccggcgccaggccctgccctgactattgcngaaatgtgctcaagggctganttgcnaacnaggccgacctggacgccgagtggaggaacctcctggactccatggtgctcatcaccgacaagttctggggtacatcgggtgtngagagtgtnatcngcagcgtgcacacgtggctggcggaggccatcaacgcnctcnaggacaacagggacacgctcacggccaaggtcatccagggctgcnggaactccaaagttaactcccagggccctgggcctgaggagaagcggcgccggggcaagctggccccgcgggagaggccaccttcaggcacgctggagaagctggtctctgaagccaaggcccagctccgcgacgtccaggacttctggatcagcctcccagggacactgtgcagtgagaagatggccctgagcactgccagtgatgaccgctgc

SEQ ID NO: 601702 - DNA, 363 bp, Homo sapiens
tgcttggcagtgggccagggtgtaggtatccgttcaagagtacttcgtagggctgcccttgaattgattgggtccgcttgaattgacgggtccgcttgaattgacgggtccgcttgaatcgacgggtccgtcagtccccagaacttcagcagatcctctaggttcccatatcatctcatacggtcaactttgaacacgacagttataaagcatcattctccttgtacagctccagcggcggtacctcccgggcacgcgccccggacccgtcaagtcattgccgttaacagctgtatacctactctcaggaggccgtacgtgctagctacatgtgggcccttaacgcccatatgagtgacgttt

SEQ ID NO: 601703 - DNA, 630 bp, Homo sapiens
ggaattctgctggaggcaggcgccatatcctggaggtgaaggtaccacctcatggagtaccccgcgggcgtcgccccgctgggagcttattcccctccttcctgctcctggcctgcgggacgctggtggcgccttgctgggcgccgtcaccgctggggctcttctatcagtctgcatgcacaaggtggacaaggccaagcgtccggcatggcggagagaacgtggtcgctgtgctgagggcccatggtgtgcggttcatcttcacgctggatcggtgggcacatttccccgctgctggtggcctgtgagaaactgggcatccgtgtggtggacacacgccatgaggtcacgggcgtcttatgcgtgcgtgagtgcttatgtggcacgccttgtcctgtggaccggtgtggctgtgtgctggcagttgaacaagcatggcaccctggaccgtcagcccaagcaacggttgatcttgctgtgtgaagaattgctcagatggctcagtccccaatccgtgcttctgggtggggctgcagcactctgctgcagaaccggggtgcgctccaggctgttgatcagcttgtcccttttccggccactctgtaagttttgtgtgtctgtgcggaaggg

SEQ ID NO: 601704 - DNA, 169 bp, Homo sapiens
atgaggaggaatgccaacgcagccgctactgcagcaccaccggccgccaggagataggtggaacgccatccgctgctgttgaccatggccacgaggccaacagctgagatcacttgtccgaactggcccagcaaaccggtgagctgggttaccagaggggtctgcttgg

SEQ ID NO: 601705 - DNA, 517 bp, Homo sapiens
  misc_feature (327)..(327): n is a, c, g, or t
  misc_feature (359)..(359): n is a, c, g, or t
  misc_feature (381)..(381): n is a, c, g, or t
  misc_feature (413)..(413): n is a, c, g, or t
  misc_feature (436)..(436): n is a, c, g, or t
  misc_feature (458)..(458): n is a, c, g, or t
  misc_feature (465)..(465): n is a, c, g, or t
gaagatgcaaaaatagtagactccctgtgtacccttcactcagcttcccacaggagaacatcttatgcaaccctcagacatgatcaaagccaggaaactgacactggtacaatagcattaactgagctgcagaccttatttttcttattaaacctagggatctacagcattttagaagcattttagaatttcataagctttagcattgttgtttgtcttttagaggatgtttcaatcccttccaattgacaatcagttaaaattcgtttccgtaagttcaacaaatactggaggatgaatttcacaggttccacgggtccacatggncgctctatgggtgcatcgtctctgatggggtngcacagaggtgaccttctaccncaggttctgaggagattctggaggacattaanggaccttaggacagttagttttngttttatagggtcagaccgggngagcctnggagttctgataatgggttccgggctgtcatttagtattttagtatggtttt

SEQ ID NO: 601706 - DNA, 514 bp, Homo sapiens
atctccaggaagagatgagcaattctaccaaaacctcatgggatagacatttttgttaagatacaattcacataacataacattcaccgtcttaaccatttgaaagtgtacaagtcagtgttctcacatatatccacaatgttctacaaccatcaccatcaatttcggaacattttcatcaccccagaaacaattaagcattaaacagtcactccccattccctgtcccactaatctattttctgtctctatgtgtttgcccattctgaacatttccccagaaatccaatcatatgcagctgacccttgaacaacacggggttagggaagccaacctttcgcacagttgaaaatcttcatataactttggactctccaaagacttaactactaatagcctactgttgactggaagccttacggataacataaacagttgattaacatgtatttggaatgttgtatatattagatactgtattataaaataaaccagagaaaagaaaatgctaaa

SEQ ID NO: 601707 - DNA, 258 bp, Homo sapiens
ataatttgggagaagcacactgagtagaaacatggcctgaaagggtggtggtctggtggacctggcttcctgtggccagaggtcagcggactgctagacatggtctgatctggccacagcaaagactgggcaagaggggccccgtggaaggacacatgcatgggcacacgagcacgagtgcctggaggcgtggctcactagaatgagcagctccatgaacctagcaaggtccacgcagctacacgccagctaggtgct

SEQ ID NO: 601708 - DNA, 328 bp, Homo sapiens
agtctcgctctgtcgctcaggctggagtgcagtggcgccatctcagctcactgcaagctccgcctcccgggttcacgccattctcctgcctcagcctccagagtactcccgagtagctgggactacaggcacccgccaccatgcctggctaattttttgcatttttagtggagacggggtttcaccgtgttagccaggatggtctcgatctgctgaccgcgtgatccgcctgtcacgcggcttcccaaagtgctgggattacaggcatgagccaccgcgcccggccagaataaagctatatttctagtgacccttctgtcgtaatatc

SEQ ID NO: 601709 - DNA, 666 bp, Homo sapiens
tccaatctcctatgttatagtaaacccagccatgacccctaacaggagacctctcagccctcctaatgacctccgcgcctacccactgtgatttcacttccactccactaacgctcctcctactacgcctactaaacaacacactaaccatataccaatgatggcgcgatgtaacacgagaaagcacataccaaggaccaccacacaccacctgtccaaaaaggccttcgatacagggataatcctatttattacctcagaagtactttttcttcgcaggattttatcctgagaccttttaccacatccagacctagcacccgtatcaccccaattaggagggcactgggcacccaacaggcatcaccccgcgtaaatcccctagaagtcccactcctaaacacatccgtattactcgcatcaggagtatcaatcacctgagctcaacatagtctaatagacaaacaaccgagaaccaacataagttcaacgcacctgcctctcattacacacttttactgggtctctatcttaccctcctacaagcctcagagtaacttcgagtctcccttcaccctttccgacgggctctacggctcaacactctcttgtcgcccccggtttcccggacttcccgtccccattggctcactttactcactatcg

SEQ ID NO: 601710 - DNA, 469 bp, Homo sapiens
tcctttccttctaatgcatatatttatcaaagacttggaaccaaccgaaaacatccatcaatgatagactgaataaagaaaatgtggcacatatacaccacggaatactttgcagccaaaaaaaaggacgagtttatgtcctttgcagggacattaatgaagttggaaaccatcattctcatcaaactaacagaagaacagaaaactaaacaccgcatgttctcattcataagtggaagttcaaccatgagaacacacggacacaaggaggggaatatcacacaccggggcctatcggggggtggcaggcttggggagggagagcattaggggaaatacctaatatagatgacgggttgatgggagcagcaaaccaccatggcacgtgtatacctatgtaacaaacctgtatgttctgcacatgtattccaaaactttaaatgtaataaaacaatttaaaaatgtgaaa

SEQ ID NO: 601711 - DNA, 289 bp, Homo sapiens
agattttataaaacaaatttatattcgggttcttaactttattagggaagtaagaagttgcagctcatcgcacggatgacctggaggcatgcatggttgcatccggcccacttttttggaacaggaaagatgatcggggagggaacacaggtcagtgataggaagggggtcatgtgtcacacagagggggactgtttctctacctcctaacatgggggctaggccgggacccagaccgattcagaggcccttgcaaaaagagaaaacagacgtcccttaaacacatagg

SEQ ID NO: 601712 - DNA, 280 bp, Homo sapiens
aaaattgaatatccacatgagctactcacccggacaaattattacttttacaatgagcaaacctatattcagattaaaagataaggggggccccggggcatggtgagtcatctgtaatcccagacactttagagaggccatggcaaggaggatcgtatagcgcccagcgaattagttcaaggccagctataggcaacacaagtgagacctcgtgtcatatttataaaaaaagtaaaaacaaaataaagggggatgtagatcctgccctcaggtagcttgt

SEQ ID NO: 601713 - DNA, 211 bp, Homo sapiens
ttcggtaccgcgatggaactcactacttaaatccaaaccactgggatttaagtgcggagtgcaccgtgcccggtcatctgtgtttaacttttttagaagaatcgtcatacattttccacatgcggctgtactattatatacatcctcaccaactagtgcacacggagttccagctttcttcacacttctcacacactactttcgctctctc

SEQ ID NO: 601714 - DNA, 262 bp, Homo sapiens
tctcagcggacatcgggggtgctgttcgaattcattagaacaggtaggttagaagcaggctcttggtgaggaaatatgttgtgtacgagttcagcgtgagagtgcgtcatatgttgttcctagtgtagaattgtagtggtgagggtgtttattataataatgtttgtgtattcggctatgaagaatagggcgaaggggccttactggtttgcagtggaatcgggggtatgctgttcgaattcataagaacaggcaggttaga

SEQ ID NO: 601715 - DNA, 223 bp, Homo sapiens
ccccttttatttttttggggcccccccccccccccccccccccggggggggaaaggggcccaaaggggggaccccccatttttttgtgggggggggggggggtttttttttttttggggggccccgggggggccccccattttggggttttttgggtttttttttccccccccccccccctttttgggggggccccttttttaaaaaaaaaaaatttttttta

SEQ ID NO: 601716 - DNA, 356 bp, Homo sapiens
ttaaaaaaaaggggaccccccgggccccagaaattgggcccaagaaaaattttactttaaaaatttgccctttaacctttaatttttaagggaaaaaaaagccctaaacccacccccggttttcccagggtttttgaatttaccccaaattgtttggttatggtttcaatttcccaaccaaaaaaaattttttttttggggggggaaaaaaaaattttttatttttggtattggacagggtttttcccagccccccaatttacggtgggggttaaaaaattgggggctcaaaaaattaaaagtggtaatttgcccccgtgggggttaaaaaataaaagggggggggcccttagcca

SEQ ID NO: 601717 - DNA, 234 bp, Homo sapiens
cgtgatggctgaggtgatctagaggatcccgggtgagtacagctgtgtgtgcaggtgtgtgtttgcagatgtgtgtgcagatgtgcatgtgtccttgtgtatatgcacatgtgcactgtgtgcaggtgtgtgtgtgtacagatatgtgtgcaggtgtgtgtgcagatgtgcgtgcaggtgtgtgcgcagatgtgtgtgtgtagctgtgtgtacacacatgtgccctgtgtgcag

SEQ ID NO: 601718 - DNA, 659 bp, Homo sapiens
aggaccccagagatattgaccactatactgtgtccgctgtttttggggggggggcggggggatcctttgtgtccatcctaactgatgctggggctgccactttgttaaaacaggaagtgcgctgatgtttttttacactgataaactccttgaccgaatagagttttacacatatcttcttgtgaacgggactcaacgctttgaggggggttctcccttatacgcccaaaagcatatatctcctacgacagttggtccagggttaagggatcttactgttcatcagggggaaaagagtaagggcttaaaacgcatatctactgttgaggtctttctatgtgcgccacctcccgatatttgtgtaaaatatcaatttctctcattgaacgtatttccgccggtatccgagccaataggcatttcccaaatagagccgttttacctaattagcctttttaattaaacctctattctcaatctataactaaggcgctttataaaagtcattattttcctttaaatgaaattgctgaaatccgactaaaacctttaaaacaagaggcttttctcccttttctcattattcaccactgttctctaatctttttatctatgctttaagagatcttctaaccttctctattggtttacctcccggg

SEQ ID NO: 601719 - DNA, 364 bp, Homo sapiens
tgggctaggatgagccgttccatatagactgtccacccgaaggtgctggtcgcaatgcagaacggtgaatacgcaagtctatgggagagggttaccttttcaaccttgatatctaagatccttttcatgacctggcagaggttctaaaactgtgccttgctctgtcccatcttgttcttgtcatactcatgcttaggcatatccagaccctacttggtaactgagaccaggctctgcccatcaaattccttgagctgttgaacacactactttacaatgggctcggtcatatttaccacctcaaagcctcgttaccgcactctgtccacaaaagctgagtaggccacctgctctttgctctcac

SEQ ID NO: 601720 - DNA, 597 bp, Homo sapiens
cgtgaaaagaaaaaaaaaataaaattagaaaataaacagaaaaaaagaaaaaaatttaggcacaatacacaacgaacatcaagtatagcctagcaaaaacaaaaatcacaaacaaaacaaaccgcactgaggcgaagcaacacaaaaacaaatggaaacataaacgacagtaaatcaaatgaacaatacacgacggaccagcagccagttacacagctgcattgagccaaaacccggaaacagagagctcataacagaacaaccaccaacagaccttagcaaagctacagaagatacaaacccagccattgcacacacaacaacgccaccactcttcttaacaaaaaaaattatacacacataaactccatcattacacgtcataaaaaaataaaaccacaaatataacacaacaacctctaacataaccctacatcactaacacatcccttcaactaccatatttaacctcaacttctaccacatctaaactttcttacaccctatcaataacactcctcataacaacatatcacacaaaccaaatatcacacaccaccacaccacacctactgatcacacacactaacactacca

SEQ ID NO: 601721 - DNA, 811 bp, Homo sapiens
cgaattgtctcgtgcatgtggtgctgcatgctggcctgctgccctgtcgccctgggactccccgccctccctcgctgacccctgctgcctggtggctgtgtctgtgctgcttgctgtgctgtggcatgtggtgtgctggtgcatgtggtgatgatgtggttgtgctctgtcctgtgggtgtatgcctgcctcctcttgcatgccttgcctggctgcctctgaatgccctgtgacctgcctcctgccttcttcctccatgctgtgcttccatccctgcctccctgtgcctctgtccttccctgcctgccttcctgcctgcctgctgccccctggttgtgctttgccatctgtgcttgtgacctggtggatgtgtgttgcccagcttgctgtctgagcctgccctgctctgtgctctgtgctctgtgccctggccctggtgatgtgctgttgcattgccccttgcttgccctgctggctgctcagccattgcatgcattgctcatagtttccaggagttggttgatcagttgtgcatgtggagctgtgttgatagcttgtgctgtacttaagctttctgagtagtattactgtgagcactgttcagcctgttgagagctgttgcaggggtgctatcttcttgccagcgaacatgctgcctaaccctgcaaagcccttaccctgtggccctggatggagcagctgcgcctgtgcccccctgtgctcctctattctgctggccggcggtggttccctgtgcttcgtggcaaaaaacagtatggtgacactgtctgcttcataagacagtaaatgt

SEQ ID NO: 601722 - DNA, 279 bp, Homo sapiens
tcatgggttcctgaggctttttattttgagcacaaaaccaccggggatttagcctgtggcaccccggagatgacacgaggctcacatgactctagacacttgggtggaaagtgaggcgagaaaaccaatgatttgggcaatttccccgattgaaagcctaaacctccaaaaaggcctcaaggaatcttggcttcctagaaagtttctaagaaaccgtatagatctccaggggttgggggccctattatccggggcccccccaaatgtttggttcggggg

SEQ ID NO: 601723 - DNA, 224 bp, Homo sapiens
tataactattctgttttagtggcagatggggtttggccttgcttgtccagactgtgtcttgaactgccagactcaagcagtgccccgcgctcggccacccaacttgctgggattacaggcgtaagccaccgatgtcagccactgatttttagaaactaacgccaggcggagctgcgctgtgccatttcatctctacactactcagcgcactgtcggaaacggga

SEQ ID NO: 601724 - DNA, 262 bp, Homo sapiens
ggggggtcccccccccccccggggggaaaggggggccccaagggttaactttttcttttttaaacccccttggggggctaaaggggcccccaagggggcccctggggggggtttttaaaatttttttttcccccagggggccggggccctttttaatttttgggggtttttggggggaccccccaaattccccccggggggttgttaatccccctttttacccggggggggggggtttaatttttttttgccctttggccca

SEQ ID NO: 601725 - DNA, 159 bp, Homo sapiens
ataaagttccaattcatcgggattgggaggacggggaagataccggggggacactcatgaggggtggtgcaacgtcgttacgagtcacttcaggccgagcgtccaggcccctgtgcagctggctcaagtcaaagtcctggtcctcttgccgccgttcct

SEQ ID NO: 601726 - DNA, 878 bp, Homo sapiens
ctcggctcactgcaacctccctgcctgattctcctgcctcagcctgccgagtgcctgggattgcaggcgcgcaccgccacgcctgactggtttttgtattttttggtggagactgggtttcgccgtgttggcgcggctggtctccagctcctgaccgcgagtgatgtgcccgcctgggcctcctgaggtgccgggattgcagacggagtgtcgctcacccaggtctcaatcttgcccaggctggagtgcagtggcgtgatctcggctcgctacaacctccacctcgcagccacctgccttggcctcccaaagtgctgagattgcagcctctgccccgccgccaccccgtctgggaagtgaggagcatctctgcctggccgcccatcgtctgggatgtgaggagcccctctgcccggccgcccagtctgggaagtgaggagcgcctcttcccggccgccatcccgtctaggaagtgaggagcgtctctgcccgagcgccatcgtctgagatgtggggagcgcctctgccgggccggaccccttctgtgatctgaggagtgtctctgaccgaacgacaccccgtcttgagaagtgaggagcaacctccgacacggcaggccgccatggtctgggaagtgaggagcgtataccgcccgaagtcagacccatcacaggaagagttggaaagggaaagaccacacagaccaggcacaagccagacccaaatacagggaagtgaagatggagaggaaacacgagtccaacacaggtaacgagagagtagagaggacgccatactgaccagaacagcctgagctagagaaagtaaggaagacacatcatagccaggcggcaaccatgaatgagaggtggacccaa

SEQ ID NO: 601727 - DNA, 651 bp, Homo sapiens
accgctaatatgtaaccaagaacagatattcagaaaaggacagtctcttcaataagtgtgctgggagaactggatatccatgtgcagaaaaataaaactggaaccctatctctcactacatacgtaaagcaaatcaaaatggattacagacttatatctaagacctcaaattatgaaactactaaaagaaaacattgagaaactctccaggatgttgggctgggcaaatatttcttgagtagtaccccattagcacaggcaaccagggcaaaaatggacaaatgtgatcacatcaaattgaaaagctttggcacagggcaggaaacaatcagcagagtgaagagacagcccacagagggggagaaaatatttgcaaggtatccagggacaaaggattaataaccagaatatataatatcaatggtcatcagaaaaaatgcaaattgaactacagtgggctattaccttaccccagttaaaatggcttttatccaagacaggcaatagcgaatgctggcgaggatgtgcagaaaggggagcccttgcacactgttggtgggaataagtacaaccactatacagaacggtttggaggttcctcaggaaactataattagagctatcatacgattccgcgaacccactgatagg

SEQ ID NO: 601728 - DNA, 127 bp, Homo sapiens
tcgagctcggtaccttttccaccttcagcattttacagtataagaaagcactacctccatgagaattcacgtgtggtatagggtcggtatatgggtggtatataggtggtatggtggtatagtctgc

SEQ ID NO: 601729 - DNA, 743 bp, Homo sapiens
  misc_feature (93)..(93): n is a, c, g, or t
  misc_feature (98)..(98): n is a, c, g, or t
  misc_feature (117)..(117): n is a, c, g, or t
  misc_feature (119)..(119): n is a, c, g, or t
  misc_feature (148)..(148): n is a, c, g, or t
  misc_feature (151)..(151): n is a, c, g, or t
  misc_feature (185)..(185): n is a, c, g, or t
  misc_feature (282)..(282): n is a, c, g, or t
  misc_feature (296)..(296): n is a, c, g, or t
  misc_feature (300)..(300): n is a, c, g, or t
  misc_feature (309)..(309): n is a, c, g, or t
  misc_feature (318)..(318): n is a, c, g, or t
  misc_feature (357)..(357): n is a, c, g, or t
  misc_feature (359)..(359): n is a, c, g, or t
  misc_feature (439)..(439): n is a, c, g, or t
  misc_feature (474)..(474): n is a, c, g, or t
  misc_feature (478)..(478): n is a, c, g, or t
  misc_feature (481)..(481): n is a, c, g, or t
  misc_feature (523)..(523): n is a, c, g, or t
  misc_feature (561)..(561): n is a, c, g, or t
  misc_feature (610)..(610): n is a, c, g, or t
  misc_feature (655)..(655): n is a, c, g, or t
  misc_feature (678)..(678): n is a, c, g, or t
  misc_feature (711)..(711): n is a, c, g, or t
ctccctttatctcctccttcccctctggcagcgaggaggctatttccagacacttccacccctctctggccacgtcaaccccgcctttaattnataanggtgcccggcgccgggttnanggaaacgtcggcgggggagaggggcccanggnggcaggcccggccagagactcggcgcccggagcnagcgccccgcacccgcgccccagcgggcagaccccaacccagcatgagcgccgtaacccactcgcccatgatgcaggtggcgtccggcaaaggtganagggaacctttgcncccnggatggganatcaagatngacccgcagaccggctggcccttcttcgtggaaaaaaanancagcaccaatacgtggaacgacccgcgcgtgccctctgagggccccaaggagactccatcctctgccaatggcccttcangggaggtatctaggctgccgcttgctagggaaggncacnctntgtacccccagatccgaccaggctacattcccattcctgtgntccatgaaggcgctgagaaacggcaggtgaactctttncatgtatatatacagcctgggatgcagcgattccgaactgaggcggcanaggcggctcctcagaggtcccagtcacctctgcggggcatgccanaaaccactcagccagataaacantgtggacaggtggcagcggcggcggcagccagncccccagcctcccacggacctgagcggtccca

SEQ ID NO: 601730 - DNA, 623 bp, Homo sapiens
ggcacgactcatcaacagcgctaagctcgcactgattgtttacctgagtatgcctcgaaatacagcatgctacgcttttattccacgttctaatccaaaaaaataagatccctcgttccacagaagctgccatcaagatatttcctcaacgcaagcaaccgcatccataatccttctaatagctatcctcttacctaaaaatatactctcaggacaatgaaccataacacaatactatccaagtcacactactcatcattaactaatcataatggctatagccaataaaactatgggaatatgaacccctttcacttctgacttcccagagtgttacccgaagtgcacccctctgcactatccaggccatgtcttcttctcacatgacgtacataatctatgcccccatctcgaatcagtataaccgaaatgctctccctcagctacaacatatagccttctcctcgatgtctctcaatctttattccatcatagcatgctagttgaggtgccattaaatccaaatcttcagctacagcaaaatcttagcatactccttcaatgtacccacatgatgatgacctaaataccagttctaccgtaccaattccctaacattaaca

SEQ ID NO: 601731 - DNA, 488 bp, Homo sapiens
gcatgattggtgttcctggtcgtgcgcttgccagggtctcatcgtcgtgagaggcctgacgcttttgatatcattccaggctttcagtttcttgcggagcatagcagtttcgttggtcttcttgtacccttccactttatcttcgactaccagaggcagtgcacgaactcctctatatcgataccttatatcgtaccagtgctgtgtgggctgaggcagccagggcagaacatgatggtgtattcgtttttgggttgtgttcactctatcgactgcccacggcgcccgggttttggcttggtgcaaacattcggcctccactgacacatgtttcctcataagcaccctggtcagagcggtgagtcccaccatctcgaactctgggaattcgagccacagctctgccagtaccccaagactcagcgctagtctgataacctgctatttcattgacagcgatagggctgtctgttgtttttgcgcaggtt

SEQ ID NO: 601732 - DNA, 335 bp, Homo sapiens
  misc_feature (181)..(181): n is a, c, g, or t
acatgttgtccagtctgggctcgaactcttgtgctcacgtgatctgtgcacacttgggctctcttctcatagtgttggcttccagagatgaatttctcgatggtactggtgggtcacgggcaggttttactttggtgggttctttagctaaatttgagtagtaggaatgcctgagggcggnggccgaagggggtaggggaatggtggggaatggatttttttcttggtaatgtgtcttcatgccttttccttgaatgtcctgcctctatgggctctatatgctttccaactccattgtctgttcccgttatgtttacctttttctcctgcattct

SEQ ID NO: 601733 - DNA, 926 bp, Homo sapiens
gagactgactgttctagggcgtgatttgtttgtcgagtgcccctctctactgaataatgatctgcctgtccccgactgtgtgtaaagaggtccctggagctgccttcaagataaggggtcctagagggtgcaagatcatcaagaaccagtttaccccatgcaataggactgctaaagccagagaaatgtgacaaagcccagttgaactgaattttgaatctcataaagctacaggtgcatctgagagcaggctcagtggtgaagatcaagatagcccggtaaagccctgttggggttttttagcctcagccacatggtataacctctcagttcctgccataaacaatattcagtggaaaatacagcactgttgtctttacacatgctccactctggaagggttaatgctctgagctacaggataggttggggaacaccatttttaaatctgtggttttaaacaaaaagagaaattattaccgtggagatataattgtgctggtacatatattctgaaaagtatgtataaatcacttatgttaaagcgccagaagttacttttataagtgaactattacgaataatttcataaagcaaataaccaccttctaagcttatcttgtcagggttatatcagaattctcaattatattcatagtcctcatagactttgttacaagcagatctatcctaggtacggacacaaacttggtaatccgttataccttagctgcctaatctggaggggggcgccttattaactctatgttaataaggtctcctgagaaatccaattggggtcaataggaaacacatttcgacttcggcctaaaaccaattgccgtttacacaatagcgggaccccacacagggttctggtttcccccaggccacggtttccgggacccgagcgcacgttttaaagt

SEQ ID NO: 601734 - DNA, 792 bp, Homo sapiens
  misc_feature (117)..(117): n is a, c, g, or t
  misc_feature (128)..(128): n is a, c, g, or t
tgtggcagttccgcgcatcttttcagcggtggccattatattatggccccacccgcggcttacccgattccattgggagaaaaccaacgtggggttaaacagccccccgtgcgagtntcccacaaacntttcagagggggccccccaatattgatgctcctcaatggggcacttatcgcctcccctacttctccctgcgcgtaaacgaaattcttttgcccacacagcgtgtagtatcgtgtcgaaggcaacttaagaggtccccgcatagttgcatgtctcccaacgtcgctcgcgcgctacaatactgtttaagtatcacctgtttagagtaggtcttggaccaccccctcctcagaattgctctagaccagtcttcccgcgcaaatagtgccctccgcctgcgcaccacaattaaacattctttccctcttcatagtcgaggtcgattatgtttacgaccctactcttccaactttctaggcacccactcctccgccgtccactaatgtggccccctccgaacatcgccacccccgccgagaggtgtgtctcttctattgagagaagggaatagaaatagttttctcttgggaggcgtaattacgccagtgtccctcgactcgtttctggacataataattgccgcccaatacgtcgctccactgtatttgtgccccaactttgagaagacagtcttcagtactattccccctgcttagaattacgtgatgctccacccggtgtggtgggagccgcaacaaagattcgtctgcaaacgcccacaataac

SEQ ID NO: 601735 - DNA, 767 bp, Homo sapiens
cccgggaacctcctggctttagagacttcctgagtttcctgacccccatcagtagatgggaaggtggggcaagttggcatcatgactcagtgtgttaagtgtcaagcaagtcggtgggtaatggagcagctgatcagtaggtagcttgtgagccacatcagacttgcactgcatgcatgacggctgtctaaacctattcctcagtagagtggctcatagactcagttagcatcacgatcacgcacataggtccccagctggggactagtcaatgacctctggttctgtcttcagtcacttctgcaggctcctgcaggttctggtctgagtagtcagtgctgcgctctcggtagaggattcacaagtacagagcagtgatagatagtggggcagagccgatgtcaatcagcaggtctgcttaacaccgtcttgtcagaatctctgaacacgattgttcacaaggtgcttatgatgctggcgttctgcagagttactagaccaatgcttgtaagatcgtgctaggtgatcgcgagggttcaaatagcctagatcggtgctcttagaggtgaagcgtgattgctttatgttacagttctgtgctgctgtagcacggtcattgttctctttagtccacaagcagagcagtgcacctgcatgaagatgtcttgtagagtatatgcctaacagcttccatttcatcaggtcagcgctgcttgtagatctgatggatggatacacactgccagagagatagcgcacgaatgtac

SEQ ID NO: 601736 - DNA, 226 bp, Homo sapiens
ctgcattgttcaacagctgcgggttgaccagccaaaggagaagggggagatattgagcatgttcagcagcgtggcttcgctggctcccacttagtctccagctcttgatcagctgcacatcactcaggatttcaatggtgcccctgaagatagttgggtggaagaagattatgacaaatgcatgggctgtgacgataacgttgtagatgtggtcgttaccctgaag

SEQ ID NO: 601737 - DNA, 152 bp, Homo sapiens
  misc_feature (31)..(31): n is a, c, g, or t
  misc_feature (51)..(51): n is a, c, g, or t
gagtgacacactgttcctctccaacccggcnccagccatctggggaacccnctgttgttgcagccatccaccagctgcggcagatccaagcactcctgtggctataccgcgcgcacgatcgtcggtgacgcacaatcatcgttcagcacacc

SEQ ID NO: 601738 - DNA, 300 bp, Homo sapiens
  misc_feature (70)..(71): n is a, c, g, or t
  misc_feature (104)..(104): n is a, c, g, or t
  misc_feature (139)..(139): n is a, c, g, or t
  misc_feature (242)..(242): n is a, c, g, or t
  misc_feature (268)..(268): n is a, c, g, or t
  misc_feature (277)..(277): n is a, c, g, or t
tagtccatgctgatgtcgactccagaggatacctgaggagctttgaagtcgcctaccagcgcgtgtacgnnccactttcgcccgcgagggcccgtgctcggagnccacggacggtattggaaggtggaccacttgtgtnccgtcgtccggtccgccttcagggggctgtccctcgatcgggacccgtctctggcgcgggtgcttcgggtccatgagcaggcttggtgggctgtgcgtgagcncctgcgctgtcttctcggcgtgtatnagatgccgngcgaagtcttgtggaaccaccag

SEQ ID NO: 601739 - DNA, 382 bp, Homo sapiens
ctcctttttcctctcttcagcgcgagtcgcccacaatttgcgcgctctctttatgctgttccccagctctcggatacagccgacaccatgggttacgtagacctgatggaggtttatgagccatcacaagctgacgtggcagaattagatgccgagtccagcccactgcctgacgactggagacatgccctacgttgatatactcacattaagtgttacgactaggataaggccagcctgccagtagtgaagaaagctttaggcaaataaggacctgcccgatgaaaggacactacaggaagtggagctccagatagtatacatgatgatgacatagacccattcgtatccgaggatgatgaacacagctaccaagcaaact

SEQ ID NO: 601740 - DNA, 152 bp, Homo sapiens
acggcctcgctattcagtgatcatccacctcagcctccgttgtagctgaactgcaggagtgcaccaccctgcctggctaattctttaaattttgtagagatgagagtctccctgttatagcctagtgctggccttgaatccctgggtctcaa

SEQ ID NO: 601741 - DNA, 467 bp, Homo sapiens
gctgtgtgtttgtggaggggagtaaggttatcagataaaagaagaaaaatgggccaggcgcggtggcttacgcctgtaatcccagcactttgggaggcagaggccggcggatcaggtcaagagatttagatcatcctggccaacatggtgaaaccccttctctactaaaaatacaaaaaaattgccgggcgcggtggctcacgcctgtaatcccagcactctgggaggccgaggcgggtggatcacctgaggtcgggagttcgataccagcctgaccaacaatggagaaacccgtctctactaaaaatacaaataaaattagccgggcatggtggtgcctgcctgtaaccccggctactcgggaggctgaggcaggagaagcgcttgaacccgggaggcggaggttgcggtgagccgagattgcgccaccgcactccagcctgggtgacagagcgagactccgtctc

SEQ ID NO: 601742 - DNA, 198 bp, Homo sapiens
aggtggaggagaaggcaagccgcaaagagcgaaagaaagaagtggtggaggaggaggagaacggggctgaggaggaagaagaagaaactcctcgaggatggagaggaggaagatgaaggggaagaagaagatgaggaagaagaagaagaggatgatgaaggcccgccgtgaagagagctccgcagaggaggatgaatg

SEQ ID NO: 601743 - DNA, 246 bp, Homo sapiens
cctgggggcattaagagctgttagaacactccattagggtttctagagacaatgactttatgtggcttatatagttagattagaagaatgggccgggcacggtggctcacgcctgtaatcccagcacgttggggggcagaggtgggaggattgcctgagcccaggaagtcatggctgcagtgacctgaagtcacgccgccacgctccagcacaggctggagtagctcttattgcccaggctggagt

SEQ ID NO: 601744 - DNA, 873 bp, Homo sapiens
  misc_feature (873)..(873): n is a, c, g, or t
gatgcgaaaacttccccacgggtactgcgtccacgtggggatggcgtggggactccctgaaagcagagcggcgagccgcccggaagtcaagacacatctggcttctgtaagaggtcttcatggaaagagtggtacatggggggatgagcagtctttctgaagaaaatgtgccattcattaagacagtgtggtgtgctctgatgagagataagagccgcaattaggcaagtgaaagtgtgtgctctgaaagatgaagcatgggctatacatccctgtgggaggccaggttcctgttagaagtggtcattatgggccctttgaagctgggtcatgatgcttttagtggaccaaggatggtcaaaaagccatgtggtgtcattgttagttcaggtacattgactgtcagtgtgttaaagatatacgtcaaagggaaaactgtggtggaaaaatggtaacgcctgtctgtgaggaggaagaaagtgaatcgcgtgacgtaggagctaatccatatggggaattttaccgggaacttggatggcgcgaaatcagacagttagaatcttttagtataggcagattagtgctgaattaaagcaggcactcctctgtgatgctgctcactttccgtccagcgagagtatgtggatgtcacaggcaagactaaggaaagggtgcccagggggcatgaaaggtgggatttaaggcagctggaacggggggcaacgaaagcaaggagactggggcgtcgcactggggcatgggaggctggcggactaaacgcggaatgggaaataagggacaaaggcggaaggcggaacgacacccaacattgtggggccgagaaaagggaggcaagaaaggagaacaggcacn

SEQ ID NO: 601745 - DNA, 456 bp, Homo sapiens
gcgcagcctgtaatcccagctatttgggaggctgaggcaggagaatcgcttgaacccaggaggcagaagttgcagtgagctgagaccgcccctcagcctgggcaatagagcgagacttcacagaccctcggagtacagtcagaaattattacatttttgaatttccattttgatctaaaaataaattgatatatacctattggagatcatctgggtggcttataaaaatgaatcagtaccaatccttttatctgtctctgcttatgatggcaatgtatctgtaccaggtgatctctggaagtgataacttttcatgtattgtttctcaaactgcaatgcaaggacatagcactgggatataggagttctcaaattaaagaccttggccacactatgttatgctgtctttcagttcatcttgagtaaatgaatgagagtaaccaagaaaaaaaaaaa

SEQ ID NO: 601746 - DNA, 911 bp, Homo sapiens
  misc_feature (3)..(4): n is a, c, g, or t
atnncataaaagcagaagaagagacaaaagaagcgaacatacaacattagaaatatttggccctgttctgcggtcttaaaatacccccaattgccaggcagtgtcccagcaccctgaaccaaaagaccgctcccctaagcggtgaaggttcagcccctcggtaggaacctcttccctttgcagaaaatttgtcggctccgccgaatggtttcaaaagcttctttctttaggcccccccctcagttccccgcccgtcggattttttggaaccagacctccccccgcatcaatcctatcacttattatgccctcggggaaatttttcctacacacacagggcagaaaaatcagccccaaaacaaccgagggtctcaaacaaaagcgcgctatgaaacccccttcccgaccacctcctccttatgtcaccaccatcctccaaccatcattctggtttttttccaaaccaccgttagtcgatgcaccccttttcccgacatatttgccgccggcccatctttccactccccccctatcatagaaccaaaaagtgtagcgcacttttttataaaacggcggctcagctacaaaatggccctttataaagcccggtgttaacaatacgcttttttaaccccgtgcgagagcctcaaacccaatgaacatagcacccctctatcagaacacctcttatattgctaccctcagggtctgcacaataaccctcttccccgcaccaccccctgtgaaatgtcttttgcaaacaaaaaaagacgataatctgtcctcattgagcgcccacaacttcactttctttgtgaaattttttccacaaccacagcgttatcagatgaaactggctgtctttcccccctgcggggaaaaaaaataaacgggggcctttcaacataaca

SEQ ID NO: 601747 - DNA, 138 bp, Homo sapiens
tatcatatagtaaaccagccatgaccctgcaggccctttagcctctaatgacctcggcctagccatgtattcattccacttccttaacgtcctacatactaggcctactacacaacattaccatatccatgatggcgc

SEQ ID NO: 601748 - DNA, 872 bp, Homo sapiens
agcggagttacttaaccaacggcagatgcgggaagtgagaggagtctggggctggggctgccttccaggcccacggggcggccccgctcttcttcggattgggttacctttgggcagagatggagactgctgcacgggactctggaaccatgaagcagtattatgatcgaagagatcaacttggatgcgcttgtaaaattttctcatataaccccgtcgacgcagctagcacctgatagactggtctatgctagtttctcgccctttagtatgttatgtaggcggctgtcagggtggcctatggtccatatggtgcactcatttgcattcaggctggccttgtctgctctgcctttgggtcttcccttgagtatctgatgacttatggcgtgagtggcaacaccgtcatagccattgacaatctgaaccagaacacagacgtggagacttctctcgctggactttgccattccgtctacagtgagcttggccctgggtcccatgctcctggaaggtcttcgtattagctgtctaaccctcagctgtcctttcccactgtctttcatgggtcactggcagatgatctttgacctgcgttctaccctctagtgctagctctatgccacggcgccgtcagctagcctctttctgggaggtactcttgactgtctgccctggagcttgcttgcttttgtcgttccctggggaactgtcttcttcggatccagtttgggcttatgccaggcgaagcctgatatgtgggactgggtgcgtcatgtgtggccttccgtcctatttacgatactcaaactcattattcgaacaaggccgaacctggaagatcacggatccatatctggcactgctttgaa

SEQ ID NO: 601749 - DNA, 1034 bp, Homo sapiens
cgacccacgcgtcgccacgcgtcgggaagtcagcacttacattacgaatttcctcatatctcttctggctgtagggagaaaacagaagaggacccaaacaagaagagaaaacaggaaaagaaaaaagaacaagaaaaaaaaacacaaaaaaagggaaaaaaaagaacaaaagaagagaagagggaaatttcaaaagataaccagaatgccgacggcccatgcacgggaagtgcacacacaacagtaacgccagatggacataggacaaaagacacacaggtaacaacacaattgcagggatcccactggcgctaaccacagaccagacatagcagagctatacgtggcacagtaaccacacaacaaacgtgacaaatcacgaacaacaacaagcacaagaacaaaaaagaagcaaccacacaaacacatccaaacaaacactcaagcacgtagacaaaccacaagactgtgaacaacaataaaccacaacaagaacgatcacaaaaaagacagaggcgaccaacaacagaacaccacaggagggaaaccagtaaactagccagaaagacgcacaaccaaaacacagacagtggcacagtaaacagagataaaaaacatgcaagcaagactaaaacgaatggcaacacatagaacaaacagacgacaaatagaaacaaattaaacagacaacagatcatacaacataaccaaccaaacaagagagagccaaaaacagctaccaacacaacaccacagatgagacaataaactaaaaaaccacaaaacagaaaacaaccacggcactcataacaacgtgcgcgcatacaccaacacagcaaaacaggtgcccaccacagccacgcgagtcagacccatctccgaagacaacagaaacagaccgaatcacaaaggcagcagagacaaagagagaacagccagcaccaacagacacagaacacggacaacgacaaccacacaccaaaaacccgacacacacagaaacacaccaacacacacacacccacacccgcaaa

SEQ ID NO: 601750 - DNA, 484 bp, Homo sapiens
tcctgaaaggtaaggtccttctgggggggaaggctttcagcaatatttagggctttccggccttttagttcctgggcccaggccctaggtcacttaggcattttttgcatttccacttggcattaatggaaccttccatgtcaaggttcagctagtggcccagaaatcagtgccaggaaccctttaacagttggcagcgatttcaggtcctttttaatggcccctgggtttggatacatttttcaagatcccctttggattttttaggggctaaacccttgggccttttagaggggatatatttatattttgcctgtttaaaaaaaagtgagcagggttagcttagttttttttttatggagggtattatgattagctttggccctggttccctactcagcatgggaacaagatgaaattccctttgtaggtagtgagacaaaattgatgatccctttaggtaacaattaaagggtccctttga

SEQ ID NO: 601751 - DNA, 495 bp, Homo sapiens
  misc_feature (242)..(242): n is a, c, g, or t
  misc_feature (245)..(245): n is a, c, g, or t
  misc_feature (451)..(451): n is a, c, g, or t
ttcgagacagtgattcccagacaaattatcaagagtataaaagaagtcttctttgagtgtgaaatatctcatggaatttagcacatggcctcttcatgaagaaactactgggagagaagaagacaagctggaagaggccagggaaagggggttagtacaaaacttttctccatctctcatcccacccaactagaaatacccacaggtgtggaagggcaggccaccccttcatctggcgcccnacntgggggggcctttctctagggtaaaggtacgctaagaacatgagcattgaggacagctgacgagagattcccgaagtacggtccacagtcagcccttgcgggtaagctttgtgcactcgggaaagaatccagggtaacaatgggggcaaactgaaagtaaatatgcctctttatctcagcttcattaaaatcctcttaaagaagangggggagttaaagcttctaccggaaaatttaggtatgctaaaaa

SEQ ID NO: 601752 - DNA, 286 bp, Homo sapiens
  misc_feature (282)..(282): n is a, c, g, or t
ggtgtccggcccggaatagaaggggaaaggaccccagagaagtggctgtgacccgcccaagggcccctggccagtgaagggcagagcctctggccctgaccagctgccgggcctcgggcaagtcacttcccttctcgggtccccagtttcctcatctgtcaaagggggttaaaaacagaacccacctcgaaaagttgtgaggctaaaaagggttcaaatgtgccaagtggttaggccaaatcctggcccaaagtaggtgttcaaaaaaggctagcctttgtnacca

SEQ ID NO: 601753 - DNA, 456 bp, Homo sapiens
ccttgcttttttctcctgtgaagtgaccaaactttcctgtttctttgcctgttctgtaatttttccatttcgaagaagacatcttagatgatatactgtagcaagcccaggcactgattcctgccttttgctggccccaacctgttttgttgtttgtttggtcttttgtttgtttagtgacttgggtgagataattatgtgaagccattttccctctcaattttcatgcatcacttatttgttggtggttgtaggtaagctcctttagtcagttttacttccactatttaccactggatgtgtgtgtggctgggagactgcttcacagtttagagaatttactatttccccccatgttcagccagagaggcagaggctgcagtgagctaagattgcaccactgcactccaacctgggcaacagatggagaccctgtcttaaaaaagtaaaaaaaaa

SEQ ID NO: 601754 - DNA, 124 bp, Homo sapiens
tgctcttgaggtccccgagtgcagagtcctgacagcagtagcagttctggcaatattctaggaacaggaagaagacaatgtgactagtagcagagtgaggcaggagtgagagaaaatgtgatca

SEQ ID NO: 601755 - DNA, 948 bp, Homo sapiens
gccgccgccgccctctgccagcagctccggcgccacctcgtggccggctgtctccgtgcgggcgggatgccctggcgctgacgggcgctggcgggggcggccgagctgctcctgctgggttgcgactcacgtgctccggcgtctgcgcttccccatggggctggcctgcggcgctcttgggcgctctgagattgtcactgctgttccaagggcacaccgcagagggatttggaattcctggagagttgcctttgtgagaagctggcaaatatttctttcaattccatctcttagtttcccataggaacatcaaggaaatcatgaaccacactttggtaatgaagagttagactgccacttcctcgatgacaaggtcttactgccaaaggacattctggaccagcaaacttacatgaagatttcttcttctgatgataaggatgccttctatgtggcagacctgggagacattctaaagaaacatctgaggtggttaaaaagctctccctcgtgtcagcccctttaatgcagtcaaatgtaatgatagcacaacgcatcgtgaagaccccttgctgctaccgggacaggattagaactgtgctagcaagactgaaactacaggtaggtgcaaagtctggggtgcctccagagaggatatctatgcaaatcctttgtaaacaagttttcaaaataagtatgctgctaattctggcgttccggatgactcatttgatagtgagttgagttgacagaagtcgccgagacatccaaagcaaagtgtttggattgcaccgatattccagagctgggacacagtacattgggccagcagaacacggtcttggacggggaggcaaatcatgggggacccccgtagacggcacaacggacggcggataacgcaaaacaggccaacaaattaagaggcaaagaaaaggcagcaccgaa

SEQ ID NO: 601756 - DNA, 245 bp, Homo sapiens
ccacgtgatatgaaaagggaagcgcttgcaaccagactgtcgacggtgttcagccggtcttctgaccggttcactcgtcgtcggcaggccagcatcgtctgaggccgccggataaaggcttggggaatgtggctcctccgggagtgttatagcccctcgcacaatacggcgcgcctcgggcgaggtccgcacttcggtaaggatgctggcgtaatggtcgtaagcggcccgtcttgtaacacgga

SEQ ID NO: 601757 - DNA, 248 bp, Homo sapiens
tgtctgggcgcgcgtagcgtatgatgggcagtggagggggctgcatatgcatcctagtgctattactattctggagtatacgtagccgtgtaacgtaaagaaccgtgtacctctagaactatagctagcatgcgcaaatttaaggcgctgatatcgatcgcgcgcagatcggtcatgatgatcatggcaattggatccatatatagggcccgggttatacttacctcaggtcgacgtcccatggccat

SEQ ID NO: 601758 - DNA, 189 bp, Homo sapiens
cgctggtcctatattcaatcagtgttgcgtgccatggtactgagatacggatgacgagaaataggtcgacagtctctgcgactccgctgtcttctgggatgacgtcccatgttaatatcagtactcccacgttaagtaacatagtttccacgattaaataacagttgtcgcctgtggaataagtagaga

SEQ ID NO: 601759 - DNA, 249 bp, Homo sapiens
tctagaggtatccgctcggcaccttcaatattcagtggcatcatcaaagattcataagatcagtacacaaagagttataatcccctaacacgacatcctttaatgttcttgtggcgagcccaacctgtgccatcaattgaaggttctctcactcaactgaaacagatcaacacacatgtggtatagtgcaggagcagtctcagagtcccatgaacgcatcctctataatcctagtgggcggtatgggat

SEQ ID NO: 601760 - DNA, 296 bp, Homo sapiens
gcagagtgtcagtgcccaaaggaggtcggttgatagtgcttaccaaacatgaagtatggtgtcataggaataatctatatccaaaagatttttccaaatagggctgtgtttaaaacaacacacaaaccaaaaaacgcagcagtgattatagcgaggatcacactctaagtggagtcacggagtgacacaagcttcaaggtcacgctcgtccgtccatgcagtgaaagtgtaaacttggtcacacgtgtgtagtatcaccagatgggtcaaattgcttgtcatatcctccctgtggc

SEQ ID NO: 601761 - DNA, 350 bp, Homo sapiens
cgcgcggtctccctttccccggggagttagagaagactctgttcctccacctcttgtggaggcctgacatcagtcagtctgcccgtagttatccgagcctaactgcccgtagttatccgtgcttcagtgtcacgctctagtctgccttcattttccatcctgtacacctggctctgcttctagatagcagtagtaaattagtgaaaatactaatagtcctgatatcagaaataatggctaagctgtctttctctgtctcctctccctctctgcctcggctgccaggacggaaggccctgtcagtgaacactaccatgtgactactatactgagtactcacatcttactcc

SEQ ID NO: 601762 - DNA, 149 bp, Homo sapiens
agcggagtggagtcgcgggcacttccgctccaggaagagggggcgattgtcacggcaccatcccctttacgagagcaaggcactgtctggctcgaagcagtcccgtccggccgtctgctctctaaggctactcagatctgaattcccgc

SEQ ID NO: 601763 - DNA, 139 bp, Homo sapiens
atcatcaaagtgttggtgttgtttcagcaaagtccctttggagggctccagatgacctgtaagaagtggatcatcagatcacacaggagtaaaactggtaaagtaattaaagggtagttattttttctctgctgacagg

SEQ ID NO: 601764 - DNA, 675 bp, Homo sapiens
gcggggatgaacaaaacgaacaagggggtcaaagcggtatcttccggcaaattcccttaatgccaactcgtgttgtgcactttcttcaaccaacatattttaatacacaccatccttgtgtaggatcgaaagccccatgagacaaataagaaaactggacttttattgacaatatgagaggcaaggttccttcttactaagcaggttgttcaaacgattctcgacaaccagccgtggaactccaggagcacatactctttcatttcttacgatgagtgactgctttgttcagcagtaggtccctgatcacacttgtcattccatcagccaggtagtaacctcacttctcccctgcgtggagggttttggatcctcatatcgcatatggttggccaagcttcccagagcagggtcagtacatcttggcccattaggactgacagttggatcccagctctttggtcggccaagtcgagcagtgctcttgagatcaagagttagagacctgtctgaccaacatggtagatccctgtgtctacaaaacatacagcgattagccacgcaaggtggagcacacctgtaattccagccactcaataggctgaggcatgagaaaactttgactacagaaatcagaggttgcagtgatccaagattggacaaccgtgctccagc

SEQ ID NO: 601765 - DNA, 182 bp, Homo sapiens
gcggccgcctactactactactactgctcgaattcaagcttctaacgatgtacggggacatgtatattttctatatacaaaaacaagaaaggcgttttgagcccctgtgctcaggcccactcccacactgtggagtgtactttcatcttcaataaatccccttattccttccttacaaaaaa

SEQ ID NO: 601766 - DNA, 1402 bp, Homo sapiens
tcagtcatccatcttctctggaggctgcagaacagccagatccactatcagctacaacgcaggagaaagatgaggaccactgcagctcccgagggggcacgacctgccagctaacatcacctactgctcccgaccatgcatgggtccctgtaggctgatcagttctcgcaggcattttctgtcaagctctattcgctagagacatcaatcatatccaggcatctactacacggtgaacgggactctttctggttgtacaagcatatgacaatggtacataggtacaggccagttgcgcattttctggacacacagctcggaatcgagtgtatatcaccacatctgctgtagtgcaatctcagcgcagtttgggaacacgcactggtgtacagggaggcactagcatttcgactcaggcctgtcaccttgcttaagccgtatcgtcttacacattatcactttgaacacaggacctatataaaagctgatacattgcgtagtcaccacctaaccaatgcgttaacaagcatgctccacttggccagcggtggctttgcccaccactactagcgaaacatacactttcggaacggcccaattcagttctccaaacatgtgcctcatccccatcgtcatacacccggttcatctgtcgccctttaaactatgcgttaccgcacacgttccggcagactaggcgcgccattacggctactgcgtcgtggtgccaacgcgcagaaccgctactgctgggcttccgtagaaaactggccaaaagaatggtgccctatatcgtgacaacatggagcgattactacccccaggcccgctgcacaacaattctactacaaacactggtaaagccattacccaaatctggcgcaccacggcagacaacactatatggcgacgcagacgccacaggttgaattgccccagtagattacagccccaacatgcggcggaacagcgcgcgctcaccctcagaggcaccagagcactttaccgcccgtgaggggtatacctcatattaccctgtccacaacaccgtgcgttaccctcgcgcaacctggccatcactttatagccccgtatcaccgtattacggctatcacaacggttgggcacacaacacgcttcgtcgacaagcgaccaacactcccattgaggccagctttttgaactaaccatctggcatctgccaaacaccatatctgcaaacgtcaggccctagacgtaatcgtagtaaagataatgccacacgcacatcagggacattacgtagacgccggcatacaacacaggacggaaaacaaatagtcgcccacgacaaagtagtcaacaagtcgctcagtatacacaccagtgtgttgagaccattatgtgacaatatacagaaaac

SEQ ID NO: 601767 - DNA, 165 bp, Homo sapiens
  misc_feature (97)..(97): n is a, c, g, or t
  misc_feature (104)..(104): n is a, c, g, or t
  misc_feature (125)..(125): n is a, c, g, or t
attcaagcttctaacgatgtacggggacatggcagccatccgcagggccagcgccatcctgcgcagccaggagcctgtgatggtgaagaggaagcgngacccgnccccaccaagagctcctgagnccccctgcccccagagcaataaagtcagctggctttctca

SEQ ID NO: 601768 - DNA, 134 bp, Homo sapiens
caaagtaacatcagatgttgtgcctcctgtccttgatgcagccaggtggtggtggctgtagtgcggggtcctcttagctatctgtagatccctccgcaggagctccgcgtgatcatgctctcggtgcttgctgg

SEQ ID NO: 601769 - DNA, 158 bp, Homo sapiens
gaggacaccccgttgccaggctgagggcagtggcggggtcttgtctcactgcacctccacctccccagttcaagcgattctcctgcatcagcctcctgagtagctggaggcaggattacaggcccctgccaccaagccccggtgccgatgaatagcga

SEQ ID NO: 601770 - DNA, 198 bp, Homo sapiens
  misc_feature (157)..(157): n is a, c, g, or t
ctggggtgatctagaggatcccgccacggtagatttacgacagcctttctatttataagctgaaaacagaacaaaagaaaaaaaaaatgcaacgcaaagaaaatgagttacttgcctaagggtacgtagtacagggctctgtccatgaccgccctgnggcctctatgggcactggctcctattcctctttcagaagat

SEQ ID NO: 601771 - DNA, 383 bp, Homo sapiens
ggggatttggccccccgggcccaaaatttgggcccggggtttcttgggcccggggttggcccccccggggttaaagaacccggggtgcccttttttttgggggccccccccccttgcccaaggtggaaaaatccggggggggttttggaccttccccttttttttgccccttttccaaaggggggggggtttttccgggggggggacccccccaatgggcccaaaccccccttttagggggggggctttttttttttttttatttccggggaaaaaaaaaccccttttaagccccggggttttctttaaaattgggatggggggaagggcctttttggtttttgccgggtttttccccttttggtttttggggttaaaccgga

SEQ ID NO: 601772 - DNA, 188 bp, Homo sapiens
tctgggtcttcagccttcagggctggaaccggcagcagcatttctcgggttctggggccttcagactcagactgggaccgaaaccatcagctctccggggcctccagctggccaacgacaggtctcgggactggccccttccataagtgctggagccaggtcttcaggataaatctctttccacctag

SEQ ID NO: 601773 - DNA, 165 bp, Homo sapiens
gcaccttaaccaccagacaaccttaggcaaaccattttacccaaataaagtatagcatagaaatgagactgcgcaatagatatagtaccgcaagggagagcatgagaaagtataagcccgcatatatatagcagggactgaacccctatatccctctgcataatg

SEQ ID NO: 601774 - DNA, 474 bp, Homo sapiens
  misc_feature (93)..(93): n is a, c, g, or t
caaatgggaaggggctgggccctggggggggtcttcttgtgtttttatcgcccctaaaaaatatgtctctttgccggagccgatatgcccccnagggcttttggggtgcacgcctctttttttccccccccaaaaacaaatatacactccaagcctttttggccttttcccttggggaggggccccctgtagtatttccctttatttggtgggggccagtggatgtgaaacctgtaaatagcttgtgctcaacctcctttgggtggaaagggtgggtgcaggaggcagcccccccccccaaagccccctggggagtttttcctttttttttttaactgtaactgagggggatcccaggtttggggatgggggcccccttgggccccaggattttggttgtttcaggggtacccatgccccctgccctcgcctggaatcagggtttttgcttttttttaaatgtttcccgaaata

SEQ ID NO: 601775 - DNA, 876 bp, Homo sapiens
agaatgtagttgacaggttttcctgcccattagtactttgaagatgtcatcccattgtcttctgacctctataattgcactgagagatctgctgtcagtctgttatccttccacggctcaagtcacatgtgtttcctccttctcgctctttcacgcactttcctcttcgtctctggtgttctgaagtttcaacctatactgtcactcaagtcaccagcatttcatttttcatctcattctcttccaggcactccaagttccttccaatctgcaagcatcacatgtctttctccaggggcacatgtgggcaaaccacaaccagatgttctcacacacccatcccacgcggccacacaaataaacacacaacatcacgtctcggccacagatgtcggggcacacctcctcatacagctacctgctgcagcacttcatccctctattatcgccaaccctggggtgcccctcctggcggcatctggccacacgccgcccaccttgtacaaccctgtgactccagcactcacccactcctcaggcacccattcctacgcgacaccattgcccttccctagaacacagttcggttcacgtaccactctggtcaaccggactccactggtcggcctcgcaccattgggcgcgcagatcatgctgtacattccgcaactggtccaccactagccatgcgtcatcccctgggcctttcatccactaccgtctgctgaaggtcacacactagccccccctgctacctcttgcgcgcaacagaactgacgactcaccggaagttccatctcgtctctcggcgacactcttgctgccaccacaccagtccactcagtgcacagcgcctcgccctatcggcaaacactc

SEQ ID NO: 601776 - DNA, 1344 bp, Homo sapiens
gtgagacggagtctctgatcgacctaggcatggagtggagtggacccagatcttgagctcactgcaacctcacgactccacgggttgacagaccacttctcctgacctcagacctcccggagtggctgtgcgactgcacggacatgctgaccacctatacacatggcctcaatctcctcgctgatgactctctctatgcgctaggacgatggcggctactcccaccgagcttgcagccacggacaacgagacacatcagacacctccactgccacctccacgacgactgaaacatggacacccagtccgtccgcgcacgtcccccacaagcctgcccgcggaactcaacaagagaaggtgaaggccaagcgaagacaccaagccaagaacgccaccaacagcaatgacaacacaaaactcaacgacacagaaccccactgaccctacggacacccagcacacaccactccaccacagaacacgtcacacacacaagcaccacaaagcgaaccaggaggaacacaccgcacagccccaccgccccacaccagccccacacaccacgagaaccaggcaccacgccaccgcgagagcgagcgcaccccgcccgccaacgagcaaaggaacccgccccatgccccagcacaccaccaccttcccatccctcttacaataccctcactcacaacctatctaacgaatcaacaatacctatctataacaacacaatcatacaaacacaaaaaataaaatactccactatcacagcataacttcacaccaacgaatacacacaaccatcaaaaaaacacagggacacacaccgggtgggagagaaacacagagcgcggaccaagcgcaacgcacgaacaggcgagagcaacagacggcaacgacagcaagacgaccacgggggggcaggcggcagacgccgccacaggcgcaccgcgcacacagcacggacagcacgcacggagcgcccgacgcccacgcggcgagggggagcaggcggcgcggaagggaccacccacgcccccgcacaggcgcggcgagaaaagagaacacgacgcggagcagcacgaacagagaggcgaccagagcggagaccgacgagcgccgacgacgggacaggagcacaagaaagcggccaaacaggcgccgtacggagaggagggcgggcgagagaacgagcagcgcagacaggcggagaaagcggcgcaggagcgaggcggggcgccagcggcagcgaagcgagcgagcagcgcagcgggcgcggacgaggacgggcgccagcggagcgcgtgcaggacgccgccgacgcgaccgagcggcggacacgcaaaa

SEQ ID NO: 601777 - DNA, 101 bp, Homo sapiens
actagtgttttcctgcgcccactccggttgtcctgcgcccactcaggttttcctgcgcccactcaggttttcctgtgcccactgtggttttcctgcgccct

SEQ ID NO: 601778 - DNA, 442 bp, Homo sapiens
  misc_feature (329)..(329): n is a, c, g, or t
  misc_feature (350)..(350): n is a, c, g, or t
  misc_feature (399)..(399): n is a, c, g, or t
  misc_feature (430)..(430): n is a, c, g, or t
tcctaatttataaaatggggatattaaaaaaccctgacactagtccttcaatgtaaataaggctaagagagaaaaataaacttaataaaaaccctgacaactgtaggtctatagcatgctcagcatataatagacactctatgaattgtagcaattattttattactgagtcagggattttaattgattgtctcagcatagatggcttgttattaagtagtaagacataaagcagctttctcatccttacttatgaaaagcttcttgaaacaataatgatttttggggatttacataaaattaatttgggtggaaatagtcagccttgnggtataggataagggtacgcngggtgtggggggagtcgcgggctcatggttcggtggactcaaatgtgtnccccaaaacattgtggagggggagtccgtgncccttctacaat

SEQ ID NO: 601779 - DNA, 115 bp, Homo sapiens
ccaacgataaggtatcagtagtgacgcccatctacactggcagatgtgatcctcagaaactcatctcgaatgaagtacttatgccctaggtcacgcgtggtcctctccgggctcg

SEQ ID NO: 601780 - DNA, 712 bp, Homo sapiens
ttcccacgtacccccgaggtgctccgtctgctctgagcccatcatgcctggcctgccgagatggagactgtgcgagtggtctccctgggacacaggacttcccacatgaagtgttacaaagtgtgaggacttcgggaagccccttgtcgattgagccagatgaccatggcttgcttccccctggacggtcacgttgctctgtcggaagtgcccacactggttagagccccagacctgagtgaggacaggccctcttccaggccgcgagtccatagccgcccttgtggacctacacgcacactgtgacacattcctgcgccgcccacctcagttatctgctttgtgatgtctacgcccctcccactttccgacccctccctagcatcccaacggtgccctgaccccggagcccagcagtggtctatgggaatgcccggatccccgccctgggcgctcttggtcctctgctccacgtcctcgccacgggattgcccccccgtctttcccgacacccccaccctgagcgggggcaccccagtgtttagggcttctgctttccctgctgcacccgcgccctcgggcggccccccgagcagacctttgtactttgctttcggagggcctgggagaccctcccggacatttccaccctcccccctgctgcccagtctgtagctatagctaccaataaaacaaaaccttgttttccaga

SEQ ID NO: 601781 - DNA, 737 bp, Homo sapiens
  misc_feature (15)..(15): n is a, c, g, or t
  misc_feature (134)..(134): n is a, c, g, or t
  misc_feature (138)..(138): n is a, c, g, or t
  misc_feature (175)..(175): n is a, c, g, or t
  misc_feature (188)..(188): n is a, c, g, or t
  misc_feature (300)..(300): n is a, c, g, or t
  misc_feature (359)..(359): n is a, c, g, or t
  misc_feature (362)..(362): n is a, c, g, or t
  misc_feature (370)..(370): n is a, c, g, or t
  misc_feature (374)..(374): n is a, c, g, or t
  misc_feature (384)..(384): n is a, c, g, or t
  misc_feature (392)..(392): n is a, c, g, or t
  misc_feature (394)..(394): n is a, c, g, or t
  misc_feature (398)..(398): n is a, c, g, or t
  misc_feature (412)..(412): n is a, c, g, or t
  misc_feature (418)..(418): n is a, c, g, or t
  misc_feature (420)..(420): n is a, c, g, or t
  misc_feature (427)..(427): n is a, c, g, or t
  misc_feature (447)..(447): n is a, c, g, or t
  misc_feature (453)..(454): n is a, c, g, or t
gtccaagaactatanactcatttataccaggaaacagacaagagaacaagaggctgccgaagacaaaacttctctgcaagcacctgtgcacagcaatgtgcgtgggcatctgtgagaagaagagaatctgtgangttngagcaagcggcttcccaagatgtaccgaatatctcanctgatgtcaacancagtagcaagttcttccaggtgtgcaaacgacgaatatgctggagagctgtctcccagcgtgcaatatttcccaagtttcacctgtgattccctggatggtaccattctttngaatgcggtccatagatcccctgacaggctccactatacctgtcgccgaagtcccagantcntcaccaangggntactaatatntggcctgnangacnagcttcctgtgcgncaaaananggcaacntaactctgaaccaatcccanaccagnntatgtataaggagaccttagtagagagatatcgagacagagaacagacgagaactcgtggccatttccttttcttactctcttcaacctcagtacctccaaatctgtggctgcatggaagtatcttgtggtgacatcaactcttctccaagtgaagacaactggttgaacggggaccaggaggttggacaacagaccatttgcaattggaaatgatgatttagactgttcttctctgactggatgactgggagtcaggaacagatgactgcagagtctgtgac

SEQ ID NO: 601782 - DNA, 154 bp, Homo sapiens
cgcatatgttattttcaatagcaacaacaacaacaacaacaaaagattccgagaataattctaacaaagatatgtaggaccttatgagaaacgggtaaactttatgaaattttaagaggtccacatgaggctgagccggtggctagctatatcc

SEQ ID NO: 601783 - DNA, 239 bp, Homo sapiens
ctgagaggatcccggcttacgcgctgctgggccttaccgcgtcactgactacggtgccgtgtgtgcggtgtcttggtgtgtgtgctgtgtgctacgtgtgtgtgctgtgtgtgcatgtgtgtgcgtgtgctgtgcgtttgtgtgctgtgtgctcgtgtgtgtgctgtgtgcgcgtaacgggccacgcagacgcgtcacgggccagcagggtcacgcagctcgcactcgtcaatcatggt

SEQ ID NO: 601784 - DNA, 180 bp, Homo sapiens
aaacagactataatcttcgtactgagaggacacagacacaggagcccttctcttaataggcaagattctggaacccaggggcccctaaaatcccagtataatataccaataccctagaagaaaacccgagggacaacagattccacaggacacgcaaggctgccctgtaaggtttcaatg

SEQ ID NO: 601785 - DNA, 682 bp, Homo sapiens
aagcactgggggggactttacactgtgagcctaaccctggctacagtcgttccccgcggtggcgatcgggccctttaccgtgcctatgtcctgctagtcgtcctcgccatgctgtctctagactgttcggactatgcgcggtgcatgaactggcaccagatctcttatcaagtcctcacttttgcagtgaacgtgacatctgagctaactatcatggaaggggttcatgatgaacagctggaactgaaagaacgattgtagagctgctcactggctgcaaggaacctgcattacatccaggagatcttgtctatctagctcgagttgaagattccataccagtgtcagagatcgttgctagcacgtatgctggatgagagatagctatagttcacccgtgcttgatgatccatgaagtgcatagtgggcctatcaagttgttgaccacaggagataataatgcgaatgatgacccgggcctctataatcatggacgacattcgatacatatgtaggacgatgcaggagagccacgagatctggtcattatgacgtactgggacgaccctatgactgagtatctacaatatgcatgcagtctcctgttgctgggtcactgagcctgacatctcgggagtgctgcttgatgttctggcagatccagactttcttactggtggtg

SEQ ID NO: 601786 - DNA, 645 bp, Homo sapiens
  misc_feature (15)..(15): n is a, c, g, or t
  misc_feature (109)..(109): n is a, c, g, or t
  misc_feature (113)..(113): n is a, c, g, or t
  misc_feature (150)..(150): n is a, c, g, or t
  misc_feature (163)..(163): n is a, c, g, or t
  misc_feature (208)..(208): n is a, c, g, or t
  misc_feature (267)..(267): n is a, c, g, or t
  misc_feature (270)..(270): n is a, c, g, or t
  misc_feature (278)..(278): n is a, c, g, or t
  misc_feature (282)..(282): n is a, c, g, or t
  misc_feature (292)..(292): n is a, c, g, or t
  misc_feature (300)..(300): n is a, c, g, or t
  misc_feature (302)..(302): n is a, c, g, or t
  misc_feature (306)..(306): n is a, c, g, or t
  misc_feature (320)..(320): n is a, c, g, or t
  misc_feature (326)..(326): n is a, c, g, or t
  misc_feature (328)..(328): n is a, c, g, or t
  misc_feature (335)..(335): n is a, c, g, or t
  misc_feature (355)..(355): n is a, c, g, or t
  misc_feature (361)..(362): n is a, c, g, or t
gtccaagaactatanactcatttataccaggaaacagacaagagaacaagaggctgccgaagacaaaacttctctgcaagcacctgtgcacagcaatagaatctgtgangttngagcaagcggcttcccaagatgtaccgaatatctcanctgatgtcaacancagtagcaatttcacctgtgattccctggatggtaccattctttngaatgcggtccatagatcccctgacaggctccactatacctgtcgccgaagtcccagantcntcaccaangggntactaatatntggcctgnangacnagcttcctgtgcgncaaaananggcaacntaactctgaaccaatcccanaccagnntatgtataaggagaccttagtagagagatatcgagacagagaacagacgagaactcgtggccatttccttttcttactctcttcaacctcagtacctccaaatctgtggctgcatggaagtatcttgtggtgacatcaactcttctccaagtgaagacaactggttgaacggggaccaggaggttggacaacagaccatttgcaattggaaatgatgatttagactgttcttctctgactggatgactgggagtcaggaacagatgactgcagagtctgtgac

SEQ ID NO: 601787 - DNA, 950 bp, Homo sapiens
gcacagggtcgaggtcggtagtgtggtgtgactcctccgttccttgggtccgtcgtctgtgatactgcagtgcagccattgcagaaacgcaggccccgtccggcggctcactggacgaggcgcctcagttactgctccgacgcggaacccagtaccaaggattttctattgcagcagacatgctacgagtgaaggatcctaagaagtcactggattgttatactagagttcttggaatgacgctaaatccacaaatgtgattttcccattatgaagtttacatctacttcttggcttatgaggataaaaatgacatccctaaagaacagcgatgcaccaaatagcctgggcgctctccagaaaatgctacacttgagctgacacacaattggggcactgaagatgatgcgacccagagttaccacaatggcaattcagaccctcgacggattccggtcatatgagacattgctgttcctgcatgtatacagtcgcttgtcaaagggttgaagaactgggagtcaaatttgtgaagaaccctgatgatggtaacactgaaaggcctggcattcatcacggatcctgatgctactcgcattgcacattctgaatctaaacaaaattggacccttaatgtaagagctgagcacattctcctacgcgatccagccgacagggcgaccactgtattccagatattttctgttccagcagcatcttgggctgatttgatcactgcccggatccacataatcttagccattccctatctaatcagtgcccctacaactacgtgcagtcatctggtgaagcgcagtaaaaaggctgaacataggagaataagaagaacataactgcactacagcgcccaccatcaaaagacctcaacagacctaacaaacatagaaaggcatccaacgaactcctacaggaaatatcacacgacgcag

SEQ ID NO: 601788 - DNA, 151 bp, Homo sapiens
tgttatgcactgctccgatctcagtctagactgcaacctctgcctcctgggttctagccaattctcatgtctcagcctccagagtagatctaggattacaggcacctgccacatacatccagctaatttttagtgtttattagtattgatg

SEQ ID NO: 601789 - DNA, 259 bp, Homo sapiens
cttcttcactggtggaggtttaaaacaacagctgtgtacacacgcatgatactgtcagcataaaaaggatgatcactgatagaattacactagatgaatctcagaggtgtacactaagtgaaaagcagaccgaagactactattaaatgattccatctatatgacattttgggaaagggcaaatcacagaagcagaaaacagatctggggacttggtggtaggatgggttcactgcagagagggcaggggaatcttagt

SEQ ID NO: 601790 - DNA, 1036 bp, Homo sapiens
  misc_feature (46)..(46): n is a, c, g, or t
  misc_feature (117)..(117): n is a, c, g, or t
  misc_feature (121)..(121): n is a, c, g, or t
  misc_feature (124)..(124): n is a, c, g, or t
  misc_feature (141)..(141): n is a, c, g, or t
  misc_feature (143)..(143): n is a, c, g, or t
  misc_feature (381)..(381): n is a, c, g, or t
  misc_feature (414)..(414): n is a, c, g, or t
  misc_feature (425)..(425): n is a, c, g, or t
  misc_feature (434)..(434): n is a, c, g, or t
  misc_feature (444)..(444): n is a, c, g, or t
  misc_feature (449)..(449): n is a, c, g, or t
  misc_feature (452)..(452): n is a, c, g, or t
  misc_feature (456)..(456): n is a, c, g, or t
  misc_feature (468)..(468): n is a, c, g, or t
  misc_feature (476)..(477): n is a, c, g, or t
  misc_feature (496)..(497): n is a, c, g, or t
  misc_feature (503)..(503): n is a, c, g, or t
  misc_feature (508)..(509): n is a, c, g, or t
  misc_feature (511)..(511): n is a, c, g, or t
  misc_feature (513)..(514): n is a, c, g, or t
  misc_feature (521)..(521): n is a, c, g, or t
  misc_feature (526)..(527): n is a, c, g, or t
  misc_feature (531)..(531): n is a, c, g, or t
  misc_feature (538)..(538): n is a, c, g, or t
  misc_feature (540)..(540): n is a, c, g, or t
  misc_feature (544)..(544): n is a, c, g, or t
  misc_feature (556)..(558): n is a, c, g, or t
  misc_feature (563)..(564): n is a, c, g, or t
  misc_feature (566)..(566): n is a, c, g, or t
  misc_feature (569)..(569): n is a, c, g, or t
  misc_feature (573)..(574): n is a, c, g, or t
  misc_feature (582)..(584): n is a, c, g, or t
  misc_feature (588)..(588): n is a, c, g, or t
  misc_feature (594)..(594): n is a, c, g, or t
  misc_feature (600)..(600): n is a, c, g, or t
  misc_feature (602)..(602): n is a, c, g, or t
  misc_feature (608)..(608): n is a, c, g, or t
  misc_feature (610)..(610): n is a, c, g, or t
  misc_feature (612)..(612): n is a, c, g, or t
  misc_feature (618)..(618): n is a, c, g, or t
  misc_feature (631)..(631): n is a, c, g, or t
  misc_feature (634)..(634): n is a, c, g, or t
  misc_feature (639)..(639): n is a, c, g, or t
  misc_feature (655)..(655): n is a, c, g, or t
  misc_feature (662)..(662): n is a, c, g, or t
  misc_feature (664)..(664): n is a, c, g, or t
  misc_feature (668)..(668): n is a, c, g, or t
  misc_feature (682)..(682): n is a, c, g, or t
  misc_feature (686)..(686): n is a, c, g, or t
  misc_feature (690)..(690): n is a, c, g, or t
  misc_feature (713)..(713): n is a, c, g, or t
  misc_feature (724)..(725): n is a, c, g, or t
  misc_feature (738)..(738): n is a, c, g, or t
  misc_feature (751)..(751): n is a, c, g, or t
  misc_feature (756)..(756): n is a, c, g, or t
  misc_feature (761)..(761): n is a, c, g, or t
  misc_feature (765)..(765): n is a, c, g, or t
  misc_feature (767)..(767): n is a, c, g, or t
  misc_feature (773)..(774): n is a, c, g, or t
  misc_feature (786)..(786): n is a, c, g, or t
  misc_feature (795)..(795): n is a, c, g, or t
  misc_feature (797)..(797): n is a, c, g, or t
  misc_feature (800)..(800): n is a, c, g, or t
  misc_feature (817)..(818): n is a, c, g, or t
  misc_feature (823)..(823): n is a, c, g, or t
  misc_feature (831)..(831): n is a, c, g, or t
  misc_feature (834)..(834): n is a, c, g, or t
  misc_feature (838)..(838): n is a, c, g, or t
  misc_feature (842)..(843): n is a, c, g, or t
  misc_feature (851)..(851): n is a, c, g, or t
  misc_feature (860)..(860): n is a, c, g, or t
  misc_feature (870)..(870): n is a, c, g, or t
  misc_feature (882)..(882): n is a, c, g, or t
  misc_feature (890)..(890): n is a, c, g, or t
  misc_feature (903)..(903): n is a, c, g, or t
  misc_feature (906)..(906): n is a, c, g, or t
  misc_feature (913)..(913): n is a, c, g, or t
  misc_feature (922)..(922): n is a, c, g, or t
  misc_feature (927)..(927): n is a, c, g, or t
  misc_feature (930)..(930): n is a, c, g, or t
  misc_feature (938)..(938): n is a, c, g, or t
  misc_feature (949)..(949): n is a, c, g, or t
  misc_feature (953)..(953): n is a, c, g, or t
  misc_feature (955)..(955): n is a, c, g, or t
  misc_feature (960)..(960): n is a, c, g, or t
  misc_feature (969)..(969): n is a, c, g, or t
  misc_feature (976)..(976): n is a, c, g, or t
  misc_feature (993)..(993): n is a, c, g, or t
gccacccggcgcgggtggcggaaagatcaaaagcctcttccccaanccgaaccaacctcagcggggacccgggctcagggacgcggcggcggcggcggcgacttcagtggctgaacnattncancctccgccgaagccggnanccgtaattgcagccccaaacagccggcgctggctgtggtcggtgctggcggcggcgcttgggctcttgacagctggagtatcagccttggaagtatatacgccaaaagaaatcttcgtggcaaatggtacacaagggaaagctgacctgcaaattcaagtctactaatacgaactggcgggttgacctcaagtctcctggaacttccaaccaaagggggccgacactaactgtgtcgngcccaatcatatatgcacaattaaaaccaactncctcttacatnacaattaanaatattaaanaaatnaanaatnttttttttaaanaaaaaatnnaaaaaaattaaaaaaatanntaaaanatatnntnannaataaanaaaannaaantttagtntntttnaaaaaatataannnattannanatntaannttttaaannnaatnaaatanaaatanangtatantnanaaaaanaaaaaaaaatgtntanaaaanatatatataaatattntatttantnatcnttatataaaaaacnaatntttnattataaaaaaattttataattntagatatatanngattgtgttcgtntttttctagtttnttttnaaatnattnanaatttnnaaattcgaaaanattcgttcncnatnatttataaatcatttcnntaatntaaagaanacnaatngttnntatttcgnataacgatncgttttaatntaaatcgtaaantaattatngtaacatttactntantttaagnattaaatcnatcantanaacatacngaattttcgtntacncnatacnatacgattnatttatntccgcgtttaaaaatancgatttctatcgagttaaaaaattttaaaatatttttaatttt

SEQ ID NO: 601791 - DNA, 106 bp, Homo sapiens
  misc_feature (41)..(42): n is a, c, g, or t
  misc_feature (52)..(52): n is a, c, g, or t
gggtcaagcgcacgggctcatggtcactgaagtgtccagcnncgcttttaangaagtaaagtgcgtttatttcatccacaaaagaaagaaaagaaaaagaaaaagt

SEQ ID NO: 601792 - DNA, 541 bp, Homo sapiens
aagcttagtatacctagtaacttaaaaacagacataatgggctgggggcaggtggctcacacctgtaatcccagtactttgggaggccgaggtaggtggatcacctgaggtagggagttcaagaccagcctggccaacatggtgaaaccctgtctctactaaaaatacaaaaattagctgggcattgtggcgggtgcctgtactcccagctactcaggaggctgaggcaggagaatcgcttgaacccaggaggtggaggttgcagtgagccaacatcataccactgtactccagcctgggcaacaagagtgaaagtccatctcaaaaaaaaaaaaaattggggggagagatttttacggaattgtgagtggttaaagaggtgatgaagatgtatgtggttttatatacggagggttgggatattgggtggtattttgggtggtggtttacctggctatgagcatgtaggggcctgggaccaggaggacaggccaacctttaaaaaaattttgtttttaggggagatgtaccagggtataac

SEQ ID NO: 601793 - DNA, 789 bp, Homo sapiens
aaccgatttagagatgagaagtggattgttgggtcagatgaacaatccttccaccagtggtgtgaatggtcacctcccgggagatgcccttgcagcaggtagactgccagatgtccttgctccgcagtacccatggcagtcaaatgacatgtctgtgaacatgctgccaccaaatcacagcagtgactttctgttggagcctcctgggcacaacaaagaaaatgaagatgatgttgaggttatgtcaacagactcttcgagcagcagtagcgactctgactgagaaaggtgtggcatgcacagactccagtgcggcagagttctgtcaagggggaaagaaaagcacagacctaaggagcccatgaaaatcagcgggttttcttcctagagcccgagcccctggttttctatctgttacacaatgtttgaggattagtcagaattactgtagtgtttggttgtacatagcagccctggcatgagactgaagaggaactcacacaactcatggagcatacttagaaagagcactgagccagacgtggtggctcacacctatagtcccagcacctgggaggctgagggattgctgtgagtgtcgggccgccttgagctacagaatgagctgagccacccagggtaacagagataagaacaggcattcggagcgctgtgtgatacttcagaaagtgctcacttgaacaactcaatatatatattgttggtaaataccgttactttggggtaaactaacctggcttttgtttgtcacacaacccaaaaaaaggg

SEQ ID NO: 601794 - DNA, 298 bp, Homo sapiens
  misc_feature (83)..(83): n is a, c, g, or t
acaggatctccgggagcctaaccctatcttcgcctagttaacaactcagctgcaggtggccaacacaagcatcctttgctcanggaagccttcccggaaccacacatccaactctaggacaggctcttcagtggatatgatctcagggaacggcattcctttcttccagagcattggtctcggggccgcatttagaatggcaccctcatgtctaatatggtagggtaaatctgtctccccactccaggcttcaggaatggggccgggcttggctctccatgctattcctggctcccgg

SEQ ID NO: 601795 - DNA, 397 bp, Homo sapiens
ggccaccccaagtacacactcagcatcagccgggaacgtttctcctccggtccccgggttcaggcctcctcagcctccagcggtgggttcaaatgttcctattcggccatctgggctccccccccctacacggaatcatttattttggagccagggcttgaagcagacaatccaagcatccttctaaactatcctcagactggtcaccagcggttatctccagcttatacacggtatcacggagattaatccatgtggctccccgagggtgaggaaccggcggggttgaggcgaaggtctctggtgcaggctggtgcggctctgtgtcctccctctacctcggactctataaattaattttttacgagacagtgtcctatgtaacccaggcgggtca

SEQ ID NO: 601796 - DNA, 126 bp, Homo sapiens
ggaagggaagcccaatggaaaaacccctgaaccgttttattgcaggaatttttttcaaatctgaaactattatttaaaattttgaataagattttaaaaaataaatggcaaagatattaatttatg

SEQ ID NO: 601797 - DNA, 101 bp, Homo sapiens
aactgtgctaggccctgacaggcagacatgctttgatgaaaatgaatgtgagcaaaacaacggtggctgcagtgagatctgtgtgaacctcaaaaactcct

SEQ ID NO: 601798 - DNA, 1683 bp, Homo sapiens
ggagagagagaactagtctcgatttatttttgattttttgggttctagaagggggtaacaggggggtgctatcagggctaaatcagggccctatttaaaagcatttacaggggcaatcaattctaggcacgcatgggcatgcaacacgggggtatggcatcccacaagcatttccagaagcatggcaccggatagaaaaaccccgcgggagcggtgatagagcggagaacacaggtggttgggatatatagaacagctcgcgggacaataggcaactacgaggtaataaaaagaccaataagaggtggaggaacgaggcatcgagagagaggccaaagaagcgaactagaggtgaaaagagttcacaataaaatataatacgcgccacagtgaggagggacataaccaaacccgagcgacaaaaaaccaaacacgacacaaagagcatcacacgcgaataaaaagagacacaacacgaacaaggagtacagaccgctgagaatacatagagacaaaaataaacgagcgggagagaacaaaagctacctgaatcaagaaacacaatgcagccaaacaccacaaaataacaaacacaccgcagacgggcgaaccactccaagaagagacacaaacaccacataaaacgaatacacaaaataaacaaacaaacacgacagagggagcccccacacccagcagccacaacatagaggcacagtgagacataaaaaaagagaaaacagagacaacatctaacaaaagaaaaacaacaaccaaaaaaacaagaaacaaacagaaagatacacaagaggaaagaaacaggcgagcaaatacatgaaaacaacagaggacgaaaaaagagaggacaaacaatgagaaacacacaaaacacaaacaaccacacacagcacaagagagcccaagaacaacaagaacaaacaaacaaacaaaacgaacaaaaacagggaggcaacagtacaacaaacacaagaaccaagaagacaaaacacaggaaccacaacatgcagtagacataggacacgaccaagaaccaacaacgcagacacctcacacggcaacaccccaggcacagacgatcacacaacagacaatatcacaaccaagcacaaaaacagaaaggcacgacaacaaacacacaacaagaagacacactcaaaaaggcaccaacagagatcacaaccacaaccaaaggcacacacaaaccgcagagacaaaacacaccaacagacggagacctacgcgaaccaacaacacgcacaaaagaagaagagacacaacaactaacacgcgaccagccgccagactaacacgccatcacgcgagaaggcgatgcgcacaaacaccagcaacaagcgcatagacgtgcacacggagtcaaaagagagtaccgaccgatccaacaagagcagacactcacggagccacgcgacgatgcggaacaaacgagagctctgtgacactgaacaacggcgatctagcaaccgccacggcagagcccaaaccacacagcgcagcagcagcccggacgcgcggcgcgcacacagctcggcgagcggcagaggcctcgcagccgacctcaccgccaccggtcagcggagcagacgaccagaaactagacacaaacacaacagcacacacaccgaacgcacaccacaacgtaag

SEQ ID NO: 601799 - DNA, 415 bp, Homo sapiens
atgatgttgtttggggcaatgtgatttaatcctctgccttgttaaaaatagactaggccaggctgggcgctgtggctcacgcctgtaatcctagcactttgggatgccgaggtaggtggatcacctgaggtcaggagtttgagaccagcctggccaacatggtgaaaacccatttatgctaaaaatagaaaaattagctggacgtgggggcaggtgcctgaagtctcaagctattcgggaagttgagacaggtgaatcgcttgagcccaggaggtggaggttgccgtgagccgagatcatgccactgcactccagcctggacgacagagcaagatcctgtttcaaaaaaagaaaaaataaaagagtatcctgtttcaaaaaaagaaaagacaacagagcaagatcctgttttaga

SEQ ID NO: 601800 - DNA, 1804 bp, Homo sapiens
  misc_feature (704)..(704): n is a, c, g, or t
  misc_feature (708)..(708): n is a, c, g, or t
  misc_feature (1611)..(1611): n is a, c, g, or t
tgtcggtgctctcgcgatttggtcctattcatagtgacggagagtacttggtccctctcggggaatggatctgaataattaagacgaattctttctctggagaaacacgagaagagccccgtgttcagaagttagagtttagaaaaccaacaccattagtactgtgcaagtcgcagcgtccacaggatgcatcacttacataacagcgtcagtatactcaccgcggtgaacttcatcagaagaggggtcgttctatcgtgcgtgccctcaacgagcgtatgccactgcgtataccttccaattctttcttcacccaagtcagacgtcggtagcgatgcgtgctgtgccctctttgaggggccgacaaagccatagagaataggttcattaccgctccgtggggctcgaatgaagtggtcggtgccgcgatagcgagcatcaaatctatatggccgagcggagacagacatctcgttggtctctatgatataacgcgttgcgagtagaggggagtgtaagcgcgtaaacatcatcccgccgcctagacctcgaggttgtcgcgcccaatgagcgggctgggtgtgccgaagacttgggttcgttttccacctgaggggcagtcctcccacagagcgcgaagaagtgtattataggcccaacgaaaactagttgccgcctctcaacaagacgaggaccacctagtngggngtgcgcccacttcgtggaagtactgtccttttagctagaatcaggccaggccccagaccaaaaggcgcccccaaaagataagacgacaaggttaacaccccatattatccctgtgggcggggtgctttgtccggacgtcgtcaacctcgtaagaacgccaccgacatattatcaaccgtggtcggcgtctaccgctttgggccacccatgtaggtgaacccccaaccgttggctccaaatactccagtagggggcccctcgcacacaacagggcggccgcgacgcgcgccgaatggtcgtgggtaccccccctaattggtatggccggagggggaggagcgcacaatccaaccactaatgaagggggcaatccgtattaaccaatatatagaaaaacctcatattccccactagagttcttagtacaacacaaaccacagccgatgtgtacaccgcatccatttgtctcacccaacactttttgggaggatgacaaacctcttctgtttgtacgacacctgcgtgggggaccgtccttgttcgtttccgcccacggaagaaaaaaattggcccccccccaagaaatatggtgccgtttaactacactggactccccgggggggccgaaggaagcccccacgcgcgttcagtgacaaccaggtggccgaccacagggggggcggcaaccaagaggcggcgtagggtgacgcccctataggtgtctttgtcgcgtccacccccgttgtgctgtagggcacgaacggatctttttcttcgacccctcagcggagcagatatcatttgatgcgcccaacatagtcattcggccgtatcgacagaccaccaatctattactagtggtcggttaggaagtaaatcaccccattataagagagaacagcnggagaggagacgttaacacaatccatgttgggggagccactcacagaagttgtttattcatcataacagcgccccaacgatcgagggaggtaacaatctgacactctcaccaccaagactttgttgttgccaagcaccatacttgtgcgtgggcggcgaaccagatgagcattcttgtggaaaacacctattg

SEQ ID NO: 601801 - DNA, 229 bp, Homo sapiens
  misc_feature (71)..(71): n is a, c, g, or t
ctctagaggtccccgacggtctgacaacagggcattttttcctatcttactctgtgtacaggtgtggaatntctgtctcccaagaggaaatgtgacttcactttggtgcccatggacagaaaattctacctggtgctacataggagaagtttggaattgcacttatataggttggtttttaacatccttgaatttccgagcgtaggaaagaaatttgatcatttgaatc

SEQ ID NO: 601802 - DNA, 413 bp, Homo sapiens
cttgtgctatgctggtgatctctcccgccttcatgtgctttctttgcactgagtctcattctcataatttgcaattatattttgttgcttcttacctactattggccttagatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtagcagaagtgagtggtgtgacccttactccttaggtgcgcagaatttaccatcatctctgaaggaggttacagggaagtggtctccccaattctccccatcctccagtattggcccctctcactttagcatatattaattagcagggc

SEQ ID NO: 601803 - DNA, 367 bp, Homo sapiens
tattgaggacctcaaagaacttttgtttatgtgggttatatctgtcaacatttactatgttagaaattaacattgaggtctgggtgcggtgctcacacctgtgatcccggcactttgggaggctaaggcaggtggatcacctgtggttgggagttcgagaccagcctggtgaagccctgtcgtctccactaatattacaaaaatgagctgggcgtggggcgcatgcctgtggtcccagctacttgggaggctgtggcaggagaatcacttgaacgcgggaggtggaggttgcattgagccaggtttcacaactgtgctctaggctaggtgaaagagcgagatgccttctcaaacaaacaaaaaaaaa

SEQ ID NO: 601804 - DNA, 393 bp, Homo sapiens
ggctagttatctgcagcaggagcatgtccttaaggcacagatcgctcatggtattgtttgtggtttaagaatggctttaagcggttttccaccctgggtgggccaggtgttccttgccctcattccagtaaacccacaaccttccagcgtggacgttatgaccatcatgaacatgtcacagtgctgcagagattttgtttatggccagttttagggccagtttatggccagatgtcggggggcctgttcccaacaggaaacttacaatcatggtggaaggcaaagaggaagtcaggcaccttctcaaggcagcaggatgaagagacgagcgaagcaggggagagccccttataaaaccatcagatctcgtgagaattcactcactatcatgag

SEQ ID NO: 601805 - DNA, 365 bp, Homo sapiens
  misc_feature (39)..(39): n is a, c, g, or t
  misc_feature (79)..(79): n is a, c, g, or t
  misc_feature (87)..(87): n is a, c, g, or t
  misc_feature (140)..(140): n is a, c, g, or t
  misc_feature (151)..(151): n is a, c, g, or t
  misc_feature (157)..(157): n is a, c, g, or t
  misc_feature (200)..(200): n is a, c, g, or t
  misc_feature (210)..(210): n is a, c, g, or t
  misc_feature (212)..(214): n is a, c, g, or t
  misc_feature (248)..(248): n is a, c, g, or t
  misc_feature (256)..(256): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (348)..(348): n is a, c, g, or t
tactatactaaaacattttcaatcattctctcttctctncacatggctgtcctctttcatgtccacatcatcggaaaanagaatganaaatgcaaaccctgtgtgagaggcacatggcactcatattgctcaaacctgcnaaacctccttnggagcnaagggaagcgttttctgctatctccccattttgatagacactnatcacacatntnnntatagcaaaatatttaaaggtctatttccctgcncttcactnatctactaggaaggtatagaattaaaaagctttttttcccccagcngtnancaagaagtattaaaagaatataaaaaatcatatgggtaatnctagaagtactgtaaac

SEQ ID NO: 601806 - DNA, 159 bp, Homo sapiens
accagtttcagaagcgtgtaggacgctttattacagtggcagcagcgccctgggcgaggtctaaccagggggtgggccctgaagccagcccgtgtgtccaatgggtcctcctggtctgcgagaaatcaaacttttgggcacaagtcatgaaagccgaca

SEQ ID NO: 601807 - DNA, 945 bp, Homo sapiens
  misc_feature (666)..(666): n is a, c, g, or t
gctggtgtcggtgaaaacgacccctaaaagccagtatgggaatggaaaagactcgagtatccaactactatgtctgctctagttggacaccgatacgattcggggcgaaccggtccaccactgacgtggcccatctgatctataaactgcggtggacgatcgtaccctaagagaaccattgcaaacaatttgaaggaagagagggctgctggagatgggaaacgggcgccttcaagtatgcctgggtctatggtataaactgatgacgcgtggatgacctgttcgacacagtggggtatctaacatctgggatgatctccttgatgcgcacaactcttggacgatccgatgtcgatagctactcatggtagactatcatgtgtacttgctcgctccagggaagcaacaagaaggaagcatatttaatgccacataagatagctatttgactttgatctaggggggatcagttcgtgcagggggctagtaacgttgttagccttggttcgctggattctcgtttgggcttcgtcctggttcggtgtggggtggtacaatttgtagaagtctcgggtaacttcggtccccaacggtaaatttggagacaggaacacacggaagaagcaatgccgcatttctcggcttgtgaccagcaacgtggagcgntggctagaagacgaacggatacttctgtcgggtggtttaagcacatacacctgggatatcgcaactggaatcccaacacccttatcggagggccatgcaaaggatgaactaagtgatgcggagacctttgctttgagaacgtggatacggtccaaggcgagcctttcacgcattctaatatgtaactggccttcggagtttacgaaacccacccgcaccgagccaggggtaacgctacttctctggtggcccaaatgtatcctggggctctgggtacat

SEQ ID NO: 601808 - DNA, 405 bp, Homo sapiens
agcgtggacatatactcatgtggatcagtcttccctcgtagcgaactcgtattacggaatcgataaacattgctcgtgaccagtgcactaccccaagctgtgtcatatacttgtataacaaaaataccttctatacaaaccttttatttctacttttagctagaaatgtctactatttacagcagttctgtgcattcacgagcagagtgactgtcggtctaggaatacctggtgtacttcgggatgtactctcaggattttacacgcaatgctgggaaatgaccgggacactgaccggaatgaatctcaccagatatataatgtactcagcagagccttgaagtaacggagttaattttccaatcaagtgaagatatctacctacttctctgctggataccttga

SEQ ID NO: 601809 - DNA, 316 bp, Homo sapiens
taggacgttaacagcccgtgaaacactgccatacctctatccgctacaaaatacttacaaaaattagtctggagcttggctggtgcatacctgctagtcccagacactaggtaggctgaggcgggaggatctctccagcccaggagttcaaggctgcagtagactttgattatgccaccgcactccagcctggtgcaacagagcgagaccctgtcctcagaacaaaacaaaacaaaactcagtggtacttagcactggattacatgtcgggtatgggaaagtgaggcgtctaagaagattcccacatctgttgcat

SEQ ID NO: 601810 - DNA, 481 bp, Homo sapiens
  misc_feature (20)..(20): n is a, c, g, or t
  misc_feature (25)..(25): n is a, c, g, or t
  misc_feature (53)..(53): n is a, c, g, or t
  misc_feature (61)..(61): n is a, c, g, or t
  misc_feature (76)..(76): n is a, c, g, or t
  misc_feature (87)..(87): n is a, c, g, or t
  misc_feature (121)..(121): n is a, c, g, or t
  misc_feature (253)..(253): n is a, c, g, or t
  misc_feature (255)..(255): n is a, c, g, or t
  misc_feature (260)..(260): n is a, c, g, or t
  misc_feature (267)..(267): n is a, c, g, or t
  misc_feature (277)..(277): n is a, c, g, or t
  misc_feature (322)..(322): n is a, c, g, or t
  misc_feature (364)..(364): n is a, c, g, or t
  misc_feature (391)..(391): n is a, c, g, or t
  misc_feature (394)..(394): n is a, c, g, or t
  misc_feature (397)..(397): n is a, c, g, or t
  misc_feature (413)..(413): n is a, c, g, or t
  misc_feature (416)..(416): n is a, c, g, or t
  misc_feature (425)..(425): n is a, c, g, or t
  misc_feature (429)..(429): n is a, c, g, or t
  misc_feature (436)..(436): n is a, c, g, or t
tgcacacccattcgaatggntggcntgcaaatagcatccgtcaatctggtgtnaactggcntagggaggctctgcntagcacctgcnatagcggtgtcatgtgggatcgctttggtgactnttcatctgtccttgacagtggctgtcatcttgactacttggttgattggtgggtatgggggacattttaaagggctggagtaattttggaatgtcatgtttatgtcatagaggtagttttcgcatccttgantnaaacngccttanctcctttggnggtataagcaaaactccagggactcggtccgggtatccttttccngtgtggttgcccggtgtcctcgggcctagggttaagtgtgcnagataactactcgtgagtatccagaangtngtncctaataaatgcactngtngtcggtctncttnaatcaantcacatcttacatacagcagtcagagatgagtatactagaatcag

SEQ ID NO: 601811 - DNA, 1147 bp, Homo sapiens
  misc_feature (324)..(324): n is a, c, g, or t
  misc_feature (354)..(354): n is a, c, g, or t
  misc_feature (381)..(381): n is a, c, g, or t
  misc_feature (384)..(384): n is a, c, g, or t
  misc_feature (393)..(393): n is a, c, g, or t
  misc_feature (443)..(443): n is a, c, g, or t
  misc_feature (456)..(456): n is a, c, g, or t
  misc_feature (495)..(495): n is a, c, g, or t
  misc_feature (536)..(536): n is a, c, g, or t
  misc_feature (578)..(578): n is a, c, g, or t
  misc_feature (585)..(585): n is a, c, g, or t
  misc_feature (591)..(591): n is a, c, g, or t
  misc_feature (596)..(596): n is a, c, g, or t
  misc_feature (606)..(606): n is a, c, g, or t
  misc_feature (677)..(677): n is a, c, g, or t
  misc_feature (707)..(707): n is a, c, g, or t
  misc_feature (798)..(798): n is a, c, g, or t
  misc_feature (996)..(996): n is a, c, g, or t
  misc_feature (1000)..(1000): n is a, c, g, or t
gatccacatagggaatgcatggtgtgactacagcaaattatctgcggcctggactgatcacgtcgatgccggtggcggccacttggcgggggcggcgcagactgcattgctactagctgtgcaaatactgcacaaactagcttgagcaacatgggttcggtcggcgagaccgtgccagctacggaagccttcacgcccactggtgccaccagctctcaccgaggcccctgcaccgcctccgtctgcgtagacgctcggtggagaacctcggcacgcaacgtcccggtggacacccaaaattgacaatcgctaggggtgggacantgttggtgtccagtccctgcgcgcacaganatccattctatctccccattctctgcntgnctgccgtgngtctttgtccgatgcgcggagtctctcccattgggatcgcctggtgcacnctggacaatgagnagtattccctgcaggttgttcctgaagttcctaccaccnccaaccagtgaaaagagactttgtatgactagggacaatcntgggccaagactaagtcgctggacggttctaaggtttggccnggcgcgncaacgnattgnatgtgtaaancaccattggtggcaagaacaaccataatggtaatggtaggaggcgaggcaccgtaatccaatagacatggntctcacataaccacatatatgaaaaaccanggagcgggaactcgggaagtcggtgatataaaccgctggtgtttggtggtggctggagagagaaggcatatgggaagggctcacgcggagncttggacggcgtggggaagctgtaaattttcccccatgggtgggggtgtggggaaccatacatgctgaaaacggtcatgagccattctccttaaattgggcatgggtacccgtgttggcgagggctacacttaggttagttagctccaccactaagtggaccatggtgctgcacagtaagggaaacgtaaagttagcnttgncaggtgcggttccgtggcgtgggtcgaccaattgcgagccttgaattcaattctatttgagccctctgccttccaacgtgtacccctagggttaggcctaagtagaaattatcataataagggctcggtaacacagagtggggcccc

SEQ ID NO: 601812 - DNA, 402 bp, Homo sapiens
ttagcggcaagtactgcttttctgggggcaagaaccccctgacccccttctctccatgtgtctacccttctccgcttttctgggggtcaagaacccctgaacccttctctccatatctctagcccttctccacttttctggggtgcaagaaccccccggtcccttctctctgtgtctctaccccttctctgcttttctggaggacaagaagcccccaccccttctctccatgtctctactctctcttttttctgggcttgcctccttcactatgggcaagcttctgccctccattcccccttctcccttagcctgtgatcttaaagacctaaaaccttcctccttatatcaactctactccccccatatttagacctctcacaacacaaactactattcctg

SEQ ID NO: 601813 - DNA, 1153 bp, Homo sapiens
cggggagagctgggccgtgagagcagaacatgtgaggctagtagcgcagtcgtggaaccgtgcccggagtccggtaggcctggagccccacaggcacctactaaaccgcccagccgatctgtgtccccgacatgagtgggccctgctgtggcctccggcctgggcccagtcccctccctgtgtgccctccatggccctgtgtgcctgctgccctcctgcctgtcgagatcgccgcctgatgccgctgctgtggccgctgctgctgctgcttgctcctggaaaccggagcccaggatgtgcgagttcaagtgctacccgaggtgcgaggccagctcggtggcaccgtggagctgcctgtgccacctgctgccaccatgttcctggactgtacatctccctggtgacctggaagcgcccagatgcacctgcgaaccaccagaatgtggccgcttccaccctaagatgggtcccagctttccccagaccgaagccttggcagcgagcgggtgtcattcgtcatctgccaaggcatgagcactgggcaagacacagaggcagagctccaggacgccacgctggcccttccatgggctcacggtggaggacgagggcaactacacttgcgagtgtgccagcttccccaaggggtccgtccgagggatgagctggctcagagtcatagccaagccccaagaagcaagcttgaggccaaggaaggtcacgtacagccgagtgaccctacggacggtggccctctgcattctcgaagagggcgaccacctgcccggatctcgtggatctcaattccttgacctggggcaggcccaacaaactcaggtactcaggggacctagcccggaactggtaatgtaagcaggagggattaaacgtttggtgtccccttcgttagcagaccgacaaaattgcggtcaccgggggagaccattgacacgttgtgagcaatagaagcgtatagagggaaaccgcacggggagtacgggtggacagctattgagacagaacaccaagaacaacaggttacattcccgagattaatgtagcatggtacacatcgtggcaaggtggacccagtgaagagaggatacagagacaccacagggccagcgtaataacggacagacgcagagagccc

SEQ ID NO: 601814 - DNA, 320 bp, Homo sapiens
gcttgctgcttcctcctcctcggctcaccatgccagaccaataagggacgaagagactggtctggacatggtgaggccgaggaggaggaagcagcaagccacggtgaatggatgatgaagtatccatggacttttcgcatcctagtggccaccaagtatatcctgttgcaaaaaatgcatgcctttatgcagtacctgacaagctgccagtgctatagaaatgtgaccgcgcacaagcgtctgctcggcccaactcccagacagcactgctgtacacaattctggacaaaagggagaaacatgcccaccgcacagtcatc

SEQ ID NO: 601815 - DNA, 487 bp, Homo sapiens
caggtgtacgcactgtgctggcctattctgtataatactacaagtagagacacagtagactgaacaaacaagccgtgctgaactgtaggtgtgagtagttgactggccatagttgcagagaaccatatgtgtgttagcaaatttgggtccacagaattgcaaaatgctctcactccaaggatggctcataaacagatggcaaggacaaatggttaaatctgtcaaatccaaggcatttactatcatatgacagagtacaccgtttaccacaattcaaggaaacgcagaaacatttggatgtatttacctgtccaaaaagagatttgtccctcaggaagcatattatatctgtcatataaagggattattaatcaaacttatacataggaatcactagggaagtaacaaaattcaaatcactatacctcacttcagactgattcagctaactcagagatgacaccttatcctgccctaaaaaacaatt

SEQ ID NO: 601816 - DNA, 180 bp, Homo sapiens
tcccagttggaagatgtgcagagacagcatatggactcagtgtgctagtccattctcgtgcggctaataaagacatacccaaaactgcctaatttattaaggaaagagtttcatggactcacagttccacatggctagggaggcctcatgatcatggcagaaggcaaaggaggagcaaag

SEQ ID NO: 601817 - DNA, 940 bp, Homo sapiens
  misc_feature (29)..(29): n is a, c, g, or t
  misc_feature (33)..(33): n is a, c, g, or t
  misc_feature (134)..(134): n is a, c, g, or t
  misc_feature (361)..(361): n is a, c, g, or t
  misc_feature (889)..(889): n is a, c, g, or t
gggggatagggagaagagttaaaaaaaangggnagagcttgcgcgcctaccgggctttgttggaagtgtcatgtactaagcatacatttcatgcacttaaaatgattaaaaatcaattattttgggggtggggncgaagttacaaccatcaccactactgaaatttagaaagttttcatcacgacacaaagaaacgttctatcaattagtggtcatctcctatttcaacctccctgagacattggcaaccactattctactttctgtctctatggggtttgagggggggggggccttcctataggctaactcacataacatacaacttttaaaaaagcttaaaaccaccaattccattttnggcaaattgagcccgaccaaatgctagggtggctgggctttagaattgtggtgcgtcctattgaaatagttggcttagaatttttgtgtggaaggcaataacttggtgaatgttgagagttatgggatgctagtttttgcttttaaagaatgtaaagtggttgttaatcccctccaaacgcagatgcttttccttttaaatcgtgtggcgagcagtgatgtagtgatgaaaaaatccccgctggggtggatttagggggattactttgaggggcgtggcacgtggaaagctcaggtacatctagggttggttttttatttgtgggggggaccccgttggtggtgcgcgcatgggggggaggtgtgtggtaaaaaaggcgcggtagttaggggggagggggagtggggaaaaagtgtagtggtttgtgttttattggcgaacggcggcgtgtttgttggggatgtggagacataatatctgttagcgaggtgtgggtgtgtgccaacgggctgaggtggtgagatgggntgcgacccagaaaagggggatcagtggtggcctgtggtgggtcggcggaca

SEQ ID NO: 601818 - DNA, 1015 bp, Homo sapiens
ggctccgcgtcggtacgcactgtcaggagttgcccttcccagaggcagtggtgatcgtgatcagatgcccgttggtgctgaacactgaagaaacttgtgaatgaagataagtggcgaggcaacggtcaatgtttactcatggactacagatattagaaatttcggatgccttcaggagagtagaaagaggaatattaatagaagccgcagaaattgcgcatcgctcggggaaaggaagtggcaatcgagtcatcgagctattcgaccccgtggagatcacgcgtccgcagaggatgtcccgggatctagagttctaatagaccttcctgcgcataaccgcgaagtggctggtgtggcaactcacgcacttggtgacattgggtatacagatcaagacactcatcagagaatgtacttctccaagatggcaggagactacatctagcctggtggtggtccccagtaatgtggacattgcgcaccacagaggctctcagggatgggccaggaggtggaccccgatgggagacaggaccatcgggaatcttgatcgaatgcctgattgtggtggatcaaatggaacatgaagacgaaggttgtggacggtggttgcggaacctctgtgttgcacctgaagtatgggttcctgattgtctgagtgccggggtcagcaggggatccaggatcagctgagcctgtgcgaagccctgcagagagagaagatcttcctttgagaagcacccataattcagggatctgctggaggaaggaaggccacggttccctggcctggcagaaaactaccaggaagtcatcacgcttttggtatctctgccctgtgaaatcattcagggatcaccgaaatacgagggctacaaagttgggtgactaccgggcgaatgaaatgtctctggaataataagcctaaagagaacgacatgcggagaaggggagaaatggcccactcccctccggggaagagcatgagcctgggagactagactgaggggagcaa

SEQ ID NO: 601819 - DNA, 495 bp, Homo sapiens
  misc_feature (16)..(16): n is a, c, g, or t
  misc_feature (105)..(105): n is a, c, g, or t
  misc_feature (107)..(107): n is a, c, g, or t
  misc_feature (127)..(127): n is a, c, g, or t
  misc_feature (135)..(135): n is a, c, g, or t
  misc_feature (148)..(148): n is a, c, g, or t
  misc_feature (205)..(205): n is a, c, g, or t
  misc_feature (311)..(311): n is a, c, g, or t
  misc_feature (313)..(313): n is a, c, g, or t
  misc_feature (356)..(356): n is a, c, g, or t
  misc_feature (483)..(483): n is a, c, g, or t
ggaggagggcggggtnctgagagaaaaggagaacatcagcggcagtaacaaagtccgggaaatttacttcattggggacacagggggcaatagccactgtgtgcnanaacttttcaatggcaatggnggggtcangggcggcggaggngggggcacattctgcaaattccatagggacgatgcctgcctgcggccaacatggcancacgggggatggctggacggaccaccacgcggcagcaatcatgtcgatggcctgcttgatgtccacctcttcttgatcctcactgctgttgagcttgaggaggatntnttttagaaggtggctccggtacagtactttcatggtgtgaatnatgccaagattcagtggctgcaggacagcagttcagttggagggcagataccaacctgaatcctttccaagtgtggaagcatgttatgagcagagcagttgtctatgagcaagaggatccggcgttncgccctcttcat

SEQ ID NO: 601820 - DNA, 1175 bp, Homo sapiens
  misc_feature (5)..(5): n is a, c, g, or t
  misc_feature (7)..(7): n is a, c, g, or t
  misc_feature (53)..(53): n is a, c, g, or t
  misc_feature (159)..(159): n is a, c, g, or t
  misc_feature (380)..(380): n is a, c, g, or t
  misc_feature (407)..(407): n is a, c, g, or t
  misc_feature (558)..(558): n is a, c, g, or t
  misc_feature (823)..(823): n is a, c, g, or t
  misc_feature (1004)..(1004): n is a, c, g, or t
  misc_feature (1006)..(1006): n is a, c, g, or t
  misc_feature (1151)..(1151): n is a, c, g, or t
tctgnanagacgcgcccatttccggggggctgacgccaggggaaagtgcgggncatatatataaggtcacaaataaataaaatagaccttctgctcagagtgcgccggcgagctatcgggcgtggctgtgccgctgcgagatgcctgccgcccgtgcanagctacacaacacgtcgaccgccgccaccaagagcgtatactgtgagatgagtcaatataaatgaaagcttatatccaaccgagtaagcgagtttcatagtgtattgagaatctgattggtgaggatggtcaatcgcaacacatcgatcttggattctatttcgtctttcgaacatacgatctttggctatcgcgcacgccgtgcaggatagaaattatantaaaggggaagaccagcggtggagcgngaggagacagtattgtctactaatacacacaaacaaaccaatacaaaaaacaaattataaaaatacgcaggcaaagataaagtaagacgatagggatgagcccccatgtcgccatcatacaccgacactccctccccctcctccgaccccnttgctatgatggtatggaagtttccggatagatcgtgtagtgccgtgggcttcaccgtacgtgctacaattacagacacggacttcattgaagcgtttcaactatggacaagatatctgtgctggagctatacacgtacagacaatccgagagaggaccagtactaagtcgctacacgtgtaagagtgatgagcgcacgatatcggagacaagtgagaaactagaagtacgtttgatgtacagatagacaagcggaagagaggangacagacaaccagagtcagactacccgcggattttgtagttagagctcacacagtactccactcgacgtaccaagccactcagcagcagtagcattacacacgcatatacagtacagagaacacaacaacacattcacccatataagtactgcgatcgagttatcgctcacactgatctantncacatacatacggcgcatgtatgtgtgtagatgctctctcgacgctgaatcacagtcgaatatagcatggatgactcggactgtcatatgtatgttagtgatagtgacgtgcgtccgcgctcatggtggagcgcatgagatgcantgacatattacatacacgacacta

SEQ ID NO: 601821 - DNA, 248 bp, Homo sapiens
caatgaaaaaaaggagccagaatattgggatttgaatccaatgatgtcagatgtgactcctttctgagtgatgtggactcagctggggatgctgctatgcggtagtgcaggcaaatctgtcgatactgggtaatggtattttaaaaatccttgctccatatacaatcagtttgataaacaaaagcacttttctttctttaattgaaaaaaaagtagtaaatgagcactgtaaacatttcacagtagag

SEQ ID NO: 601822 - DNA, 122 bp, Homo sapiens
gctaatgcatttatgcaagagaaggaaacaaaaagtataagggtggggaaactgtcttgggggacagatgacctctcttgactgggaaccaagcaaggaggtcactcgtggagatttcctga

SEQ ID NO: 601823 - DNA, 157 bp, Homo sapiens
aatctgaagctggaggattgcatgagcctgggaattaaaggctgcagtgagccgtgttcatgcccctgcactccagccttggtgacagagcacgaccctgtcttgtaacaattaaagaagggcattatgccgcaacgtatagcttagaaatagatac

SEQ ID NO: 601824 - DNA, 335 bp, Homo sapiens
aaccccctggggtcccgacccagaggacagggaatcaaattgttgtcccgtctgtttaaagcttggaacagggagcttttatttctgactccggttcccccccctgtaagatcaaaaaaccctttccccttcctcccctgggcaaagtccttttcagggggtagccctactgatttgccctgatttgtttgttccctgagcttttttaaaaccccgtgaaaattttttttccccccctggtcctcatgcctctaattgtgggggaatgtttgtccaaccccccccccaaacagcctggggttgtttaaaaaaattaaccaaaaaggctgggtgga

SEQ ID NO: 601825 - DNA, 1017 bp, Homo sapiens
  misc_feature (53)..(53): n is a, c, g, or t
  misc_feature (91)..(91): n is a, c, g, or t
  misc_feature (105)..(105): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (140)..(140): n is a, c, g, or t
  misc_feature (142)..(142): n is a, c, g, or t
  misc_feature (156)..(156): n is a, c, g, or t
  misc_feature (160)..(160): n is a, c, g, or t
  misc_feature (163)..(164): n is a, c, g, or t
  misc_feature (172)..(172): n is a, c, g, or t
  misc_feature (174)..(179): n is a, c, g, or t
  misc_feature (181)..(181): n is a, c, g, or t
  misc_feature (194)..(194): n is a, c, g, or t
  misc_feature (197)..(199): n is a, c, g, or t
  misc_feature (202)..(202): n is a, c, g, or t
  misc_feature (206)..(207): n is a, c, g, or t
  misc_feature (211)..(215): n is a, c, g, or t
  misc_feature (220)..(221): n is a, c, g, or t
  misc_feature (223)..(223): n is a, c, g, or t
  misc_feature (225)..(225): n is a, c, g, or t
  misc_feature (229)..(229): n is a, c, g, or t
  misc_feature (231)..(231): n is a, c, g, or t
  misc_feature (233)..(234): n is a, c, g, or t
  misc_feature (237)..(237): n is a, c, g, or t
  misc_feature (240)..(240): n is a, c, g, or t
  misc_feature (247)..(249): n is a, c, g, or t
  misc_feature (253)..(253): n is a, c, g, or t
  misc_feature (258)..(261): n is a, c, g, or t
  misc_feature (263)..(264): n is a, c, g, or t
  misc_feature (268)..(268): n is a, c, g, or t
  misc_feature (272)..(272): n is a, c, g, or t
  misc_feature (275)..(279): n is a, c, g, or t
  misc_feature (281)..(283): n is a, c, g, or t
  misc_feature (287)..(287): n is a, c, g, or t
  misc_feature (293)..(293): n is a, c, g, or t
  misc_feature (303)..(303): n is a, c, g, or t
  misc_feature (307)..(307): n is a, c, g, or t
  misc_feature (311)..(312): n is a, c, g, or t
  misc_feature (316)..(316): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (337)..(337): n is a, c, g, or t
  misc_feature (340)..(342): n is a, c, g, or t
  misc_feature (344)..(345): n is a, c, g, or t
  misc_feature (356)..(357): n is a, c, g, or t
  misc_feature (361)..(361): n is a, c, g, or t
  misc_feature (364)..(364): n is a, c, g, or t
  misc_feature (368)..(368): n is a, c, g, or t
  misc_feature (370)..(371): n is a, c, g, or t
  misc_feature (380)..(380): n is a, c, g, or t
  misc_feature (423)..(423): n is a, c, g, or t
  misc_feature (432)..(432): n is a, c, g, or t
  misc_feature (536)..(536): n is a, c, g, or t
  misc_feature (599)..(599): n is a, c, g, or t
  misc_feature (603)..(603): n is a, c, g, or t
  misc_feature (857)..(857): n is a, c, g, or t
  misc_feature (908)..(908): n is a, c, g, or t
  misc_feature (944)..(944): n is a, c, g, or t
  misc_feature (1015)..(1015): n is a, c, g, or t
tttatggggtggacaaataattagtcttacaatttgctagaagcatgacagancttactaacattttgaagaaaaaacagcaaagaaagangtcatcaaccaagntggtatcttgncanccncacagcgctccacaactncntcatactctgtgcncaanccnncctctccngnnnnnngnggggggtgatgcnaannnggntttnntttnnnnngtggnnantnccantngnnttnttnattcttnnnaggntctannnntnncctntggnggnnnnntnnnacanaaaatntgtgttacanaggntggnnaaanttgctttntggntncgggggnttnnntnntgtgctaattnngttntgntaantnngttaaaggngtttttgtttggtgtttgagctttcaagttgaagatatatttnacaggattnttcacccaaagcttgggagctagggcggggggggggttgcagtgggtaactgagttgatggtatgcatattttttctcttggtgttagttccctttgggagggngtgctttttcttttttttttcctctttttgttatatggttcatgcttttttactgcgtttgtntcangcttgcttgcttttgagttgtgtgcgtcaggtgatggctagttgtcaaaagataaccccagtggatatttgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataanagtacacttcttcaatacataagaacaaatattttttctttaccaaaaaanctcatttttaggccaaaataagttaccacttgctgnaaaccttttatggctcagtgctcatccagatatatgagctatatttttttgtacatctccgaaacagaganac

SEQ ID NO: 601826 - DNA, 188 bp, Homo sapiens
cgcactgttggtgttggccgggctggatcttgaactacctgaactcaagtgaaccacccgactcggacctcccaaagtgctgggattgcaggcgtgcgccaacgtgcccagcctgagcatacttttttgatggagcccactcacgaggatgtcggagcgggggagatcctcatcgtaatcgacctgca

SEQ ID NO: 601827 - DNA, 968 bp, Homo sapiens
gcgccaataaattacggctaggtacgaggcttggtgtctggctttcgctcctgccatgattctgaggtctccccagccatgtggaactggtaagaacttggaaggcaacgcctccgaattaaattttgggacccccagtaaaatttcaggaaagcccagaattgatctgagaatgcacaaactcggcatgtctttgacagagaaggctctgtgatttcagcgcgttcattgccctccactaaggagctgctcagcaaagtgggcttcccctctgcgtctgctctctgggttcgtgatactccgtgagtcgacgtttccagatgagtcggcgcccgactgagcgagtgtggaagagctagtctggcgcgtgcctttccccgcgcgcgtctgcgtgatcagcgcaccgcgaggatactgcagatgctgatggctggacgcgctgtatatgccatctcgcaagtcatgcagcacctagagcaaggcagaggcttggccagtggctttgtctcgagctgatttaacagtcgcatgaagctgcctatattgaatcctgggatctgccggatcctctgcacctcttctttggtatcatgggggagccataaagctcttcttggttgatggcactgtgtccatgactttctactactctgccgccgatgtgcaatcttggattgcattttgcccctttatcctaacgtttggcgtttagctgtctcctcacaacttgctggtttcgtgcctccagccgacgagacatatgagatctcccttttgggccaccagctacctccctcacgtgtgaatgtctttgccccccaacgcacgtattttgcaggtggccaggggagacgtgctagatctccccaaatgctctcccagcctggccagttttgttgtggcgctcttagcccaagtgttgatctcctgggggaagaccttttaccttgggaaagagggaaaatcgg

SEQ ID NO: 601828 - DNA, 144 bp, Homo sapiens
tgtgaggaatggggggaacaagtggtcgcaggtatccccatttgcaaggccaccctccctctccaggtccccccacagcaataaaagcgtccccgtgatatccatccgggtgtagtttgaacaaatatattgatgtgctatgta

SEQ ID NO: 601829 - DNA, 1708 bp, Homo sapiens
  misc_feature (620)..(620): n is a, c, g, or t
ttttttcattttttcttttttaaaaatttcaaacggggttacacacgggaaaaggcgtgggtttaggggccgaaattttaattaaactcgtgtacgtgataacttaagggctacagagaatttcatatattttttttataacttttaagaaaactcagaggtgctttataaaagtggcgtggcctcagtgggcctcgtgttccacccgagaaccttctgtggacgcgcgccctcctatagcccttctgcgttgggtgtgagaaataaccgagggaaattagtgtgattctccgagtggcgttaacacaacaagaaattacttaacaccaattaaacactagcctatactcgatgtgccaaatattttctaaagccccatctccatagaaaagagtctcgagttataaccacattcatattgtgcgtcaaatagagagacacgagcaaaactatctctatatttctccccgagggcggacacttctccagtgtgtacaccaagagcggtatcacgtttggccgagggggggcgtgagcgaatctctataacccatctcgaggtgcacaaaatatatcttcatttgcgaaccccctttcttacatgtgtcttccatctttanccgaggtctctcaacccccttttagacgcgggcaaaccttgagcgggaacgtggggcgtacagtgtggccgtgcacaaaagtggggcgggaggactccataaataaaacttctttctccttttttctccacgaggttcttcttattccctctttttctcgggggcccttttggggtcgctgtgggttgcgggtcccccaagatttcttttccccttccttttattcccctttttttttataatctctcaatttttttcacaccaccacacacacacacacttttgttctctttcaaaaccctcttcattgcgggtgcgggggggtttcccccccttgttgtttcccccccttcacggagcttcaggcgctgtgtgcgctccgtggggccttttggcacatggagcacacgaccgggtttctctcccccaactttgtttttgtgtttcccaacacccgccgggaaacactttcgtggtgggaccattgtgggggcgccggggtaaaccacactgcggggcgtcgtggccccattcattttctcgccacccctttcgtggcacacaggggacaccccatacgtctacgccccagggggtgtcacccacaggagcatctgggcgctggttttaggcgggaccgccgcgagcgggcggcgccaacacaaacaagcggcgccacagagcttcccccacaaaagaaccccgcgcgaagagcacaccacgaggaggcgaggcagagaaccacccacaagtgaggtggagggagagaaatctgcggcgcctagataatctattgagagacgccgagccacccccattatcacacagaggagggacaccaacaagctcccgatgcatacccgacatcagatagtaatcaatcaaaaccaatcagcacctcgactgtacaacaaaaccaagccggccgcgaggccaacacacagacaaagaagatatagggggagctccaccactctctatcagaagataggcggacgtccacaacaataaaacaaccaccgcagctgacaaagaagtaaagcagatcatccaacgaccacagacccaccacagtagcaatcacacaa

SEQ ID NO: 601830 - DNA, 1019 bp, Homo sapiens
gcctcgtgccgatggattccaaacaccagtgtgtaaagctaaatgatggccacttcatgcctgtattggattggcacctatgcacctccagaggttccaagaagtaaagctttggaggtcacaaaattagcatagaagctgggttccgccatatagattctgctcatttatacaataatgaggagcaggttggactggggcatcccgaagcaaggattggagatgggcagtgtgaagagagaaagacatattctacacttcaaagctttgggtccacttttcatcgaacagagttgggtcccgaccagccttggaaaaatcactgaaaaaaggtcaaatggaattatggttgacctctaatcttattcatttctccaaatgtctctaaaagccaggtgaggaactttcaccaacagatgaaaatggaaaagtaatattttgacataagtggatctctgtaccacctggggagggcatggagaaagtgtaaggatgcaggatttgggcaaagtccattggggtgtcaaaactttcaacggaggcaggtggagatgatcctcaacaaagccaggatcaagtacaagctgttgaacaggtagaatgtcatccgtatttcaacggagtaaattgtagatttctgaagtcgaaagatattgttctggttgctatagtgtctgggatctcaagagagaaacgatgggtgggaaccgaactccccggtgctcttggaggacccagtcctttgtgccctgggcaaaaaaagaacaagcgaaccccaggcctgatggcctgggtaaacagctgcagagtggggtagggctgggcaagaacacaatgagcaggcacagacggaagcgacgttgagtccagaacgcgagattgaagcaatggctaagaatccattcaggatggggcccccttcacaactaaaagagggcgcgtgcacaacgcggggggggaagccgagagaaacaacaggcagcccacgcacaactaaacacaggggaggtgcgccagaa

SEQ ID NO: 601831 - DNA, 735 bp, Homo sapiens
  misc_feature (33)..(33): n is a, c, g, or t
  misc_feature (40)..(40): n is a, c, g, or t
  misc_feature (485)..(485): n is a, c, g, or t
  misc_feature (494)..(494): n is a, c, g, or t
gggcagtcaaggcgtgggcaaacgcctaacgtncgctgcngaaacacagtggcattgaacgctgttgtcaagacagagaaaacagaaggaacacactacctcaagctgctacctccctgaccccttctggactctttgacccctatgcacttccatttgggattttccacaacatattttatttctctgtctctttttctttctagaggtctctctgtaactaactaactctctctctcgcacaccaccttcagccccaacactcacccacttctactggagcccgcttcctctcttgctctgtctctatgtgattgggcttctttgactctccgggaattcccatcaatgtgggcctttaaaacgataagagatgcaactgaacgtgtgagacatcgtgcacataggctgagaggcggcaagagaaatgcccaagaaatcaagaccccagctaccccctctgcttctaccaccaccagcaacancacccaggnatgtgctttctgtttcccccaagccaaggtgaggcaagtcccagttgaatgtcattgtgctgacattaaacgtgctttgaggtggaaggtgaatgtctgtttggatggcagtgtttctgcacgtgggcgaggaggggcacatgtatccacctggctcactctctagctggattcaggtggaacggaggaccatgaaccttctcgaccttttctgctttggtcctgtgcttccaacgtttca

SEQ ID NO: 601832 - DNA, 274 bp, Homo sapiens
ttttttttttgggggcccccccgggggggggggggggaaaaaaagggttttttttctttaaccccccgggggttttcccccccccccccgggggggttttattggggtttttttttttttttccaccccccccctttttaaaaatttgggggcccgggggggggccccccttttttttttccgggggggggcctttttttttttgggccccccccttttttaaagggggttttttttggggcccccccccccctttttttgggcccttttttta

SEQ ID NO: 601833 - DNA, 485 bp, Homo sapiens
  misc_feature (463)..(463): n is a, c, g, or t
accgatgcctggcatttattgatctaggtgctagctttctgcctgtgcggagcagctctaagccggcaacatggcccgggtgccgtggcgatcaaagagaagaggcctgggcgctccatgatttagcctgaggctcttcaaacatccattctgcttccacgcatggcttctgccattggttctcttcccccagcaccctgaaacgacagaaacaagcaatccgattccagaaaactcggaggcaaatggaggcgcctggtgccccgcccaggaccctgacgtgtgaagccatggcgcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgngcttgcccactcgctgcagcac

SEQ ID NO: 601834 - DNA, 185 bp, Homo sapiens
aaattgccaggggcttatttggaacaacttccacttcctttccactggctctcaactctctaacttataaagtgttgtgaacccccacccaggcagtatccatgaaaggagaagtgactaggcctatgatgtaaaaagcctgtatctctgtgatgatttctgtgctcttgctgtttgcaattgct

SEQ ID NO: 601835 - DNA, 116 bp, Homo sapiens
agcagttatacagactcaccaatgcacagacttgtcttccacacgcacgttcttaccttatgccacgaaggtcccaagccaaacgtactaaagggtggcaactcagaagatatgta

SEQ ID NO: 601836 - DNA, 142 bp, Homo sapiens
aggtcgctctagaggaccccggcaccatagtgctggctacacggacactggtgcgacgtgtggcaggtgaccagtggcacacgctagaagtttatggcagagctttacaaataaagaaagaaaaacgggcttttcggacttt

SEQ ID NO: 601837 - DNA, 171 bp, Homo sapiens
tagcgtagtacccaatcttcacttcctttcgggtttgaccacgttaaactgagtgggctttaaaggcctggccattttgactgagcattgggacaactccatttcagttccgaagcttcctctttgatggaccctaggtcatctcaggatattgggtactacgctttggca

SEQ ID NO: 601838 - DNA, 340 bp, Homo sapiens
  misc_feature (17)..(17): n is a, c, g, or t
  misc_feature (252)..(252): n is a, c, g, or t
cggggttgacctagagnacccaatcgccacgacaaggagcagcttgggcaggttactttctctgcgccttctgcttttcctaaggctggaatgagatgatccttattttccccttgtgaatgcaacctaaaagccatgcatgagaggctgaatctcattcagccaggacttgatatatccatcactggctctggaccttggtttcgtgattcaaccatgttgctattttctgcctgtactgaaggcactaantttgaatgactgaaatgtgggaatgacatgtttggcagattgtacctcccaaagatgactgcattaaaacctcccgtcctatgcgctc

SEQ ID NO: 601839 - DNA, 1150 bp, Homo sapiens
  misc_feature (465)..(465): n is a, c, g, or t
  misc_feature (576)..(576): n is a, c, g, or t
agcggatctctctcgatgtgtgatgtcttctgacatctggtgcgccgtgacccgggtaacatcctcctgtgaactacaactcaatggacgtatgataggtcatggtcagccaagcgaaaccttgcaatctcgaagagccatgtgagaaggttgcctttcagaatgtgccgatggcagaggtggcatcctgacgcttagatctaccgtgcttgacaccttgggctagaggacagtcgatacatactcttgtgcctgctacattcataacccttctgtcttcaagattgcgcccacggtctgactgcccaaactagcaatacgtgttgttgcggaacctagacatagggcactggctgggtggcactcgggggagaacctgcatcggagctgaggcaggcctagtcctatttgctcctttctcgagggcttgggtaagtggcttgcaatgcaagtgttgttgctatncaaaccgtttcagtaccgagggccataagcacatgggacactggttcatacacggctttgcccgaggatcgtggattactggaaaattttcggaaaagtttcgcgccaaanaccttggactacataaaccttgggtaagtgcctatacaaactttaccatttgggtaaagctttgacccgtgtaggaacttttctccagattccagacacttgcttggttgggtcccgtttttgtaacccttgaaaagaattgcaatggctcaaagtctcccacgttggggctccccccaccaaatttaggaaaggtccaagggatagatccctaccttgacgttccccctgcttgcatacacactacttttctttttaaaaaaaactttgtcgtacctaaaggcgcacagtggctaccctccccggggccatctaccccggggcaccttgtgaatttccttttaccggagagggaggggcgggggccctccccggtgccatgggcccccttcatttgtagagcgtccaccgccgttgtgtgtccgaacaggggcgtctttcccaccttcgtcagcgagcctcctgtgagggagttttaaagcccggtggctcccacttaggcctggtacccttgtggtgtttgcccctctttcgttgttatccccggctctcaatcattttccccaaccgcgct

SEQ ID NO: 601840 - DNA, 722 bp, Homo sapiens
gggcaccatgggacagtgtcggtcagccaacgcagaggtgggctcattcactcctggcctttttgctcccacactcctctccttcaccctgagggtctatgtccccccactgacttctgcccttcaccttggctttgccctgcaccccagaccctgtgagtgagatgtgaaccctcttctgaggcccacacagggtgatgcagatggagtcctcctgggaagaggatgcctgggtgcatgctgggacctgctctgcctgcggtggggggtgtggggagggaagccttccccaacctgtagctgctgtggcctggaggccgagcagggggtgggggagaggggctagattctgggctctggagtgggtgggagctgtgtgccttccagctgccttctgccctgggggctttgctaggctcctggagaagcagggttttggggtgcatggagcttcactgatgtttgtgatgtcccctgccctcaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccggtatggacggagcacaccccacctcagccagtaccctgacttcccaagcaagtgctccgggaccccaaccacactggcacttgcaaacccc

SEQ ID NO: 601841 - DNA, 424 bp, Homo sapiens
aatgcgatgtgcgctctcattttaccaaagtggaagcatccccaaggcgctggaagtgacagagagcccccgtggttgaaggccatcttccatgacctgcagagccagtgcatgcctcactcctctgtggaaagcagatgggcagcatggagttccttactgtcattgtcgagagggccagtggtcaccatatggagcagtctcaacgtcagtggggccacctctgaccctgtcctcagccacgtggtccagctgctcagcctgtgacctgctactgtcgctacggacagcgctctggcaaaatctggccagtgccagccaggctgtgggggagacctaccacgcgtcctgcgctgaactggcgggcttccaacgggacctgggcagcctgcgcaggctgtgccacagcttccgcccatcatac

SEQ ID NO: 601842 - DNA, 202 bp, Homo sapiens
cagctctagcaggatccccaaagctacccgctgtgaacgctaccgcgggcttgcctttacatgcatagcctcactcttacatattctacagtcgcaaagttgaaatagcctaccaaatttagcaaagtagatcgatgtgcattctacaaaaatattagcttagagtacattacactgaataatattaatctgtacattttat

SEQ ID NO: 601843 - DNA, 790 bp, Homo sapiens
cctatcatagaagagcttatcgacctattcataagatcacgcccgtcataatcattctccttatctgctacctattcctgtatagcccttgtcctaacactcacaacaaaactaactaatactaacatactcagcatcagctcaggaaagtagacataccgtcatgaacgtatcctgcccggcgatcattccatagatcctcagtcgccctcctcatccctacgcatccttaacactaaagagacgaggtctaaggactacccgtactcctatgatgcatcaaatcgaattggccattcaatggtactgaactacgagtacaccgagaacggtggcattaatctggcaagctcctagatagttccctgcattaattccgtagaatcaggcgacctgatgactcgcttgaccgttgacaatccgaggtacgtacatcccgattgagagcccccattcagtgattaacttacattacatcacgaagagtgtctttgcagttcatgagctgttccccactattagggctaaaagtaaacaagatgcaaatttccgcggacgtgtaaacacaagaggcatctattcaacagtctaacacggacgcgggtggctatactgactggtcaatagctactagaaacttctagtcgagaacgcaaaaccacgatgttttgcagtaggcccaatacgtcctaaggaattgaatttcccccctaggacacttcttgcgaaactgacgggcccgtgattgtaaccactaataaggaaccgctgtaacccactctaaaagccc

SEQ ID NO: 601844 - DNA, 830 bp, Homo sapiens
attattattattattattattattattattattattattattttgagagagagagcctcactctgtcacccaggctggagtgcggtagcacgatcctggctgactgcgacctctgcctcctggtgcaagcaattctcatgcctcggcctccccagtagctgggattgcaggcgaacgtgaatgctaccacacccagctattttttgtattttagtggagatggggtttcaccatgttgcccaggctggtcccaaactcctgatctcagatgatgatctgcctgcctcggcctcccaaagtgttgggattacaggcatgagccacaacacccagcctgaataatgcttttaaccagttgaatgttgccttctctaatactacctatgagctgcccctccccaatactgagcccataaaagccctggactcagccacattgaggggactttcctgcctttaagtagggggaccacccccaaatcgcctctctgttgaaaactgttttatcactcaataaaccccccactattgtatcactcaataaaatctccacctcactcttcgatgccagtgtatccccattctttgtgggtgcaggacaagaacttgggaaccagtgcacaagcccagactcggcccaggtggggtgagtgggcgagctgtcctctgcagcaggtattgtggccagcgaggccaggtggggcatcatcggtggaggtcctggttgcaagtgactgagaattaaaatgtcctccatttcacacacacaaaaaaaaaaagggggcggtaaaattacctcgagggccacacttaagcgtcaccagtttttg

SEQ ID NO: 601845 - DNA, 398 bp, Homo sapiens
ctgcaggattcaatagatcgcagcaagggagttgttatgctacgtacaaaaccttgtaccagaggcatgacgtgtactaatggtttatggccaggacttgaacgtactaacgtggcatgacgaacgaggtagtgcacaaactatcgaccagggttttgcaacactgatgccatgaattctgcatggattttatctgccagtactcacagataccagtgctagctgttacatacaggatgcgtgtttaaacctccttctcaaggtaaaattctaaaaatcttttcagatgctgaagaaggaagaagcaattccatggcctggaactttagcaattgttcattcctatattggctacaaagcagcgaagaagagatacaggttactttggagttcagttt

SEQ ID NO: 601846 - DNA, 611 bp, Homo sapiens
  misc_feature (73)..(73): n is a, c, g, or t
  misc_feature (77)..(79): n is a, c, g, or t
  misc_feature (84)..(86): n is a, c, g, or t
  misc_feature (88)..(89): n is a, c, g, or t
tgtcactttaaccttgcagtatccaccccgaatggtgttctctggtcctttagctcaccagcccaccccttcngtannnctttnnnanntataacagtgaggttcccttactgtaggtattccatttgggattcccccccaaaacagttattcattgaatttggcagcatctgaagcattaatgtggttctaagtctgttacacaaaaagctgcactccttccaccctcttccgttttccatctccacctctttccaccccggggtaaccaatctcatttaattctgccttattcaccctaatttttttgcacaaatgagcagttatgtgtttttcttagcttttttcacataaagtataccatatatatatttaaataatcctgtattttgtcctcccatttgcagtttggacggggctcagcaggttcaagttcatctgtgctccagactgtcagcgagggcatctctcctggcactggaggatccacagagggggccacatggctggcagggtgctagctgctggatcctatctggaccaggcctctctactgagcaatgtggcttctcccagcacggagctgggcgccaagaagcaatgcacccgca

SEQ ID NO: 601847 - DNA, 417 bp, Homo sapiens
ataaaaaacacaccgtccaaactaccttccttttatcatcaggtgggccgcgtaaataaaaataaggtatactatacaaaagcgttcccacttggttgtacctaaggcataaaaacgacgctctataatcccttttagtgatcactactcgctgaggtaatagattaatagttgaaatgaactcaagattataatggcgaagcactttggttttaggcaaagttcagatacagcaagtgctttagctttttttcctttaaatagacctaagccaataatgattgtatcagtaggaaaaaaaaaaccctattgcattttcagtatagttttatttaaagttttatacaattaagctattttctctcactgtcaacaccaagaaataggctgagagtgataaaaagagactgcacttgg

SEQ ID NO: 601848 - DNA, 696 bp, Homo sapiens
tcacaggatctcacgacacctcctcttactgtcatctgatagtgcatgctgtagcaccctacttaaaaacttcccccatgccactaaaagataatatactaactgacctctagaggatcagaatctctgggcctaatctctctctctaggctctgtatctaaatgcctgtgatattcccaattcagtgtgtcgggacatctgggacttcacaaactcatccaatttccccgagagtctttttctctcttaaatgttttttgttttttttgaaatggagtttggctctttcacccaggctgaaatgcagtggtgcaattacagcttacggccacctctgcctactggtttaaagtgattctcctgccacagactcccgagtagctgggattacaggcgcccgcaaccaagcctgactattttgggtattttaagtagaaatgaggtatcactatgtaggccaggatggactcgaactcctgacctcaggtgatccactcacctcggcttcccaaagtgctgggataacaagtgtgggccaccatacctggcctcaatgaaccattgtaaggtcctccaaaggaggtgaatccacagtaaaacaacaggtaaagtctagccttcataaggctgaatccagtaggagacagaaatgaccctagaaatttataatgcagtctataagcttggaaagctag

SEQ ID NO: 601849 - DNA, 149 bp, Homo sapiens
caagagtttgccacagttcgctcttgggagcctctcgacaaatccaccgggtggggcccatggcagccaccatgcgggcctcggtgctactgcatgcccctggccctgggcaggcatggcccactactgtcagcagtaacctgtgggtc

SEQ ID NO: 601850 - DNA, 630 bp, Homo sapiens
  misc_feature (252)..(252): n is a, c, g, or t
  misc_feature (338)..(338): n is a, c, g, or t
taggttacccgtcgtgccagtctccttccccggcttgttggcccctggtaggatattctccaaggtctgtaagcggcttgcccggtgccccttccttcggtttatagggggaaatcattgcccatgaattgtcgggcaggctatatcaaagtagggggtggagtcaaagggtaagaattgggctggcatgaccttcacccggctgcaagtttgttattttgcagccctgggaggaatttttaagctttaagncacttttgtttgtgcatgaagactccgccctgctattggggcatttgggtgcctctccattcgtcccattagagttggggggctgnacgttgacttgcactgaatacgagctccgtcctggcaagcaagtcatgatccacgcaagtctaacatcctccctattaacacaatggtggaccatgaagaacgcactgaagcttaaacttgtggctccaaaaccgaagctaaaaaccaagtccaaagggtaatacaaagaaacagccaacgccccatacatccacagtgcaacatataagagcaaagtaaggctggcccccaagacctgagaatgaaaagtgtgctcattttccagggttgatgtaaaaacaaaatcctcgg

SEQ ID NO: 601851 - DNA, 383 bp, Homo sapiens
gccaagaggaaaagaacatctagtccaacaaaggattggcacaactgagccagtgcacaagaaagcaatggcatgtccaattcaaaagaacccatgtggtagcagtcagtgctagattccctaagtgaatgatgctttattttcagaaaaatgttaggtatcaagtaaactcaatattattattaaatgtattggagtattgtttgaatgcaaataaatgattgaatatatcacttttcattgaaatattttagcataatttaggaactgtcacttagtgttagcaggcttatcataatcttatcaagttagcctccctggattaaacttggaggcgagccttccatggaaaaaagctagctcttaaactccctaattatttt

SEQ ID NO: 601852 - DNA, 112 bp, Homo sapiens
gggcctccagtttcgcaatatatactgtgtagcatcaactctaagatagcattgggccgggcacggtggctcacgcctgtaatgccagcacttcgggaggccgaggctggcg

SEQ ID NO: 601853 - DNA, 661 bp, Homo sapiens
agacacgaaagactacgcctatatgtcttttgcaacactcgtatatacacaagacagtctgcacaattcgagggagagccccacattgaaagatccaatgccgcctagacgcatcgatgacctttatcaacacctatgtgaccatgaattacccccaagctcttcctgacactgggtactcatcccataaatgtctgacaatcagcataggtgatatgctgtgcctggcagagaggctgctagaacagggttggacatgcgcaaacttatttatgtacgtgtttatatatatacagagaactgttcaagaaccttgcgacatgcgcataagagtatataactcgtggagattgctgaccgttatatccaggagcactgaggtcacccgttcggggactgaatcacgtcctaaaacacagatgaacatttttctttaacctggctgaaaacttgccacctagtaactgaggatcccttacaagacaatccggacggctaccaactggcggcgcaaggccggcatccccgctttagaaactcccaaattccttgtggtttatcccgaaggcccggcctctttaaggagccgatcttttaaccaagcttattctagccccataatggagtaaccaggcctttcctgtctttggccctgtgggcg

SEQ ID NO: 601854 - DNA, 145 bp, Homo sapiens
actcatgtggtaatcatttcacaagtgtatgtgtatatcaacaacatcacatcatacaccttatacatatgtacaatttaatttgtcaagctatacctcaataaagactgaaacacatatacatggcatagtattacatagtgtg

SEQ ID NO: 601855 - DNA, 132 bp, Homo sapiens
ttggacctctcagaggcctcttgggctcggacgggctcattgtacacgggctcagaagctgagcaggctgctgttgtccagatgtgtgggcacgagtgtaagagctaggccttcacgctccgggtacgagct

SEQ ID NO: 601856 - DNA, 1540 bp, Homo sapiens
  misc_feature (823)..(823): n is a, c, g, or t
tccagaaaaaggatttttttttttatccaagtaactggcaattaggaacccaaaaagggacgccccaggcgtgggacaaattctgggctaccccttccccaaactaaaacagggcggtagagaggtggccccttacacccttttattggctcagattcggtgccccctttgctcactcttagttgcagcattccatagggcgcagggccccgaccttctcccgtggaactgggggttagctccggctcaccacatcgcctgtgccatgtgcccccacagacccccttttttccccaccacacaagagaggtttactcctgtgcgtggagaagggcgagatctctgtgtcggcgtccaagatcacagtgagacggccaaatatagaagagatttagaaaccattttgttggccggctgtgggtataccccgagacaggtccaatgtgcaacgcggcgaatcttgtctcgcgaacagacaacatgtgtgcacaccccatttgtggacactccatacaatacaacctactcacacacacaatcgccgtggtctccccagagaagtgtcttacggtctgtcgtcttagaaacccagagcagggagcaaacacacaatggtggtggcaactcctctagaacataacccctttggtgcgggcggggcgacccaacgggcgacacgcgaaacccatagaagaatgttgtgcgcgtcgtattgtggagaagacgcttggtgctcaccatgccgagtggtttaccagcatctccctgtttgctcgtactaagttgtgggtgcttgccccccccaaactattcttgttttganagtaggagacgctgctgccgtcggacacagactgctggcgtctatttgaccgtctgtttggcgcgagctgagtaccaactgacaaccataacagctatactggagtggtttacaattcggggagaggtatcgtccatctgcttcccccacctgaatgaccgcccaccaacatcttttaacagatagttggttgttgcatgtctagtcgtgaccacacaaactgaatgcggtggcacctctctacctgatgtatgcggacggctctcctctttacaaccgctgctggttgataggaacaacaatagaataaatacactgcctgcgtgttagagcatagttgttagtcctatactttcttcttccacactaaatgattcacaaccacaccactaaacaaaacagaattgaatactacgtgtagcgtagttacccatctcattcgactagaagaagacatagcttatccccccactgacagtgtgcagtactggtatgatatacagctcgtgttcagtcccatatcatagatgtagtttggtatagcgcattcatattgtgtgtcatgatgcgtcacgcaccacacgacggtggtgtggtagactaacacaatagtcacacgggcggtagccataacatacattaatacgagctggctcgagcatcatgaatccactccttaacacaacaccgccgccgtcactacactcccgtactatt

SEQ ID NO: 601857 - DNA, 124 bp, Homo sapiens
gccatctggagtggaacatatttctgttagctctaccacttttggctttgttctatgcagtctaactctcattacgctctgcaccgatgattgctctagtatgtccaggacgaagcatcgagat

SEQ ID NO: 601858 - DNA, 355 bp, Homo sapiens
caagttcttgcgcaatcgtatatatggcacgcacagtgagctatggggcgagttacatggcgacacagtcactctctccagcggctgtcattggcaccatggactctctatatctgatagccttgtaccacacaactgacaggctaccggcaatcctgggtgttccttggaaggctgaacagggcctgctagtggcccagggcagggcagatagtcaggcccagttgatgctgtgcacagaggtggacgtagtcacagtcccagacctgtacctgaagcaaacgattgtgcgacagtctgtctatacccctgtggtactatcacgcactatggacttgacagctgctgttgctgt

SEQ ID NO: 601859 - DNA, 1208 bp, Homo sapiens
  misc_feature (609)..(609): n is a, c, g, or t
  misc_feature (739)..(739): n is a, c, g, or t
  misc_feature (799)..(799): n is a, c, g, or t
ccatgggggaatattttaggataaaccaaagggcgaaacacaggccttttggaatccattcgagtggacgaactgaatgccccaaaacaagggcaagtttggccttcaccgttccaagatagctccttcatggatttgtttttcagggccccgaaacccccccctggtgtttcctgtgagggccgttatttcccctggggtgaaagcctgttttcctaaccctaccacttcccacgggttcgtctggaggcagtagccaagcccccaaaatgggaaccgaatggcctttctaaggctgagtgggcatccctttggaacctggcttttggtcccaggttccattacgtataaacaacaagggtctgcgtgaactcgtggtactggcttgagcatttccgctacccaaatgttccattttcacatccactcgaacgggtaccaggatccttcatgtggaaaaacgagaaatttggtcttctaaccatacagcggttagtcccggaccctcgcaaactcttattcgtttggggtccttgttcatgatattccttcgatgtttcgagaattcacgctggccgccaaaataccacgggggactaatagatagcncatgagttagcacacggctacaccacatggaagtgcatgagaaattctggcctcaaggtaattcgatgatggcttagcttagcatctgttgccgccacgattacaggcttacgtgagcacgtcgtaatgncatgtcgcactcatcataccaaacgttatgtgagatacgtgtgacgatgacgctctgaanactgatgcttgctcgacacgacatagagaccagtgaattcctccacataggtctactgtgaaagacacacaaagtggcctggttactactaatgcggagtgtgagacggggagtattccattgactaaagctggaggcccaggcatgagttacaagagatttgagaatgcttgttcgttgtctcatggtccgtcaagccgagcactcaagccttgattgggcgagctattcacgggcctgatggaaagatctctagaacaatacagatgcaaatgctggaagagagattgtgaacaaatcttctatggctggatttgaagcattaaactcctgtggaatcacatcaaataccaggtcagttagtgtcaattgttctagtaaattagttccaaatatgcaaacagggtac

SEQ ID NO: 601860 - DNA, 836 bp, Homo sapiens
gaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaagggctctccaaagtgtcttgttcagcaccaaaggggaataggcacaggggtgaccccagaagttcattggtgacacttaaatctccagatatttatcccacgtggggtctggatggcgggctcagcactaaattacctggttatgtgggaaggtggtcaatggcagagccttctggtatcgatgaggcttccgccactggtccatggcttagccccctggcctcttcctggggagcatggctttctattcctatgtgaaacagcctggacataagtgaaggattgggcgctcaagcaaacttgagatgggggttcatatctgtggcaccactcctgatagctggtgtgatcatggcaaacctcgtttcatccgtcgtgtcaggtggcggatgaagacgactgctggctgtaacagtgtcagcatctgtgttaagcagggcaataggtctccctggctctttttcttgagtaagcctttgaactttctgattcttcttagagagggggagaacgattttttggggggccttggatctgg

SEQ ID NO: 601861 - DNA, 361 bp, Homo sapiens
catgtcagaaatattacagcaagaatcagaaaatccattctgggctgggcgcagtggctcacgcctgtaatctcagtactttgggaggccaaggcgggtggatcacttgagagcaggagttcgagaccagcctgaccaacatggtgaaaccccgtctctactaaaaatacaaaaatcagccaggcatggtggcatgtgcctgtaatcccaactacttgggaggctgaggcaggagaatcgcttgaacctgggagacagaggtcgtagtgaactgagattgcaccattgcactccagcctgggcaacaagagtgaaactctgcctcaaaaaaaaataaaataaataataattcgatatctca

SEQ ID NO: 601862 - DNA, 190 bp, Homo sapiens
ataaaaatatatatatgggtagatgggggtttccctgtgttgcccaggctagtcccaaactccgggcctcaagtgatcctcctgtctgggcccctcaaagtgctgggattataggcatgagccactgcaccaggtctttttttttttttttttttttttttgggaaaaagagttgggctttggtccccag

SEQ ID NO: 601863 - DNA, 154 bp, Homo sapiens
agtcacgccatcgaacacgttacctagggataacagcgcatcctattctagagtccatatcaacaatagggtttacgaactcgatgttggctcaggacatcccaatggatgcagccgctattaaagcttcgttagttcaacgattaaagtccta

SEQ ID NO: 601864 - DNA, 269 bp, Homo sapiens
  misc_feature (9)..(9): n is a, c, g, or t
aaataatgnaccccagtgaatttgtaaagtgggggtatttgacatattttacagggtggagtgtcctataaactattccctttgaatgggtttgcaaagctagggtatgtgtttgtctccaagtatgattgctgttacataaccccccaaattaactcccaaattaaaacccagttgtgctgtcaatacctcaaactgctttccctttttttcctggaaatctgggtattttcaaatgtttctatatattaaagcagaaatatacccca

SEQ ID NO: 601865 - DNA, 693 bp, Homo sapiens
  misc_feature (558)..(558): n is a, c, g, or t
catggcaaaaccccatctctagtaaaaatacaaaaattagttgggcattggggtgggtgcctgtagccccagctacttgagaggctgagacaggaaaatcacttgaacctgggaggtggaggttgcagttagctgagatcatgccactacaatgcagccggggcgacagagtgaaactctgtctcaaaaaaaaaaaaagtaaagtatttcttggctgggcatggtgtctcatgcctgtagtatcagcactttgggaggccaaggcaggaggatggcttgagcccagaagttggagaccaacctgggcaacaaagtgagaccccgtctctacaaaaaattaaaaagttagccaggtgtggtgacacgcatctgtagtcccagctactggggaggctgaggtgggaggatcacttgagcctgtgaagttaagactgcagtgagccatgattgcaccacggcattccaggctgagggacatagaaagacctgtcttaaaaaaaaaaaaggcctggcatggtggctcacgccttgaatcctagcactttgggagaccgaggncggtggatcacatggtcaagagttcaagaccagccttgccaagatggtgaaaccccatctttactattcaaagattgcttgaacttgaagttgcagtgagctgtatgcccaattgaacttcagccttggggacgt

SEQ ID NO: 601866 - DNA, 225 bp, Homo sapiens
gcaaaagactaaggtcaacaagctttatggcgaatgaagagtagaacagcccatggattcattctgtggctgtctgtgtctctctgtactttcgagtaccttgaggccattcttgattgttctgtattatacagctatgtatgcatatatatatgtcacacaggctcaggccatatgatcacacactcacacagctagagcacacatagacagagatacagatct

SEQ ID NO: 601867 - DNA, 323 bp, Homo sapiens
gagactgtttcaagaccctggttaggcaggccagcctagtgctgaagcctgcaatctcaacactttgggaggctgaggcagcagaatcacttgaacccgggaggcagaggttgcagtgagctgagattgtgccactgcgctccagtctggatgacagcgcaaaactccatctcaaaaagcccccccccacagagatgatatacagatcgcaaacagtatctgacacaattgcacaacatcatcttagtcaatgggaaaatgcaaattaaaactgcaaagagatactttgacaaacccactaaaatggccagaacttttcaatg

SEQ ID NO: 601868 - DNA, 355 bp, Homo sapiens
aggctccatgcttaacgatatttggagtgtcagcactggtgctcactgtgtcgacggaacttgtacagggatggcatgcaccgacagtggtgaatacacgttgaccaggctccatgttaacgatatttggaggtcagcacggtgctcacgtgttgaaggaactatgtcagggaggcatgcaccgcagtggtgaatacacgttgacgctggaggcatgcatagcatgattgggaacttggaggatgctctaaagtcgaccaggatccatgcttaacgatatttggaggtcagcacggtgctcacgtttcgacggaacttgtacaaggggaaggcatgcacccggcaggggtgaata

SEQ ID NO: 601869 - DNA, 2708 bp, Homo sapiens
gctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagacacccagatttgcacagcctggctcctttgagtatgaatatgccatgcgctggaaggcactcattgagatggagaagcagcagcaggaccaagtggaccgcaaccatcaaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacacgcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctaagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttggtccatctggtttcattggcttggccccgcccccgagacgggagtcttactctgtcgcccaggctggaggtgtagtgggcatgatctcggctcactggcaatctctgcctccggggtttcaagcttgtccaggtgtgatcttgaactccttgacctcggtgatctacccaccttcggcctcccaaaatgctggggattacacggggtgagccaccgtgcccaacctcacttggcttcttatccttacactcccccagccccagagaaactgccacatacaccacaaaaaccaaaaatcccccaatgaccttagccccattggctccattcattcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggggaggacacccaggaatgacccttttgtgtctatgatgttgctgttcacagcttttcttgataggcctagtacaatcttgggaacagggttactgtatactgaaggtctgacagtagcttttagactcgcctatcttaggtagtcatgctgtgcattttttttttcattggtggactgtgtttgatttgtctcaaatatttggagtttttttgaaaaatggagcagtaatgcagcatcaacctattaaaatacattttaagccttttaa

SEQ ID NO: 601870 - DNA, 561 bp, Homo sapiens
  misc_feature (249)..(249): n is a, c, g, or t
  misc_feature (257)..(257): n is a, c, g, or t
  misc_feature (259)..(259): n is a, c, g, or t
  misc_feature (271)..(271): n is a, c, g, or t
  misc_feature (309)..(309): n is a, c, g, or t
  misc_feature (326)..(326): n is a, c, g, or t
  misc_feature (485)..(485): n is a, c, g, or t
gctcttttctcgggacgggagaggccgtgtagcgtcgccgttactccgaggagataccagtcggtagaggtcaagcttgtccaggtgtgatcttgaactccttgacctcggtgatctacccaccttcggcctcccaaaatgctggggattacacggggtgagccaccgtgcccaacctcacttggcttcttatccttacactcccccagccccagagaaactgccacatacaccacaaaaaaaccaaancaattccncnccccaaaaaaantttgtgggaaaaacccccccttttttttttaaaaggcncccccccccccccaaanttttgtgggctccattcattcccaggtgagaattcaggcaaacgtccacaaaggtcacaggcagcgtacatacggttctgttataccccatatattaccccttcatgtcctaaagaagacattttctcttagagattttcattttaaggtggtatcttnttaacacacaacaacatctgtggtggctttaaaacccttttgtggggggccccccccccccccttttttttccccc

SEQ ID NO: 601871 - DNA, 108 bp, Homo sapiens
tcagcgcgtacctcagcctctctctatgttgcaggttgacaatgtgtgtgtctgagagctggttcctgcctcagacacccaccatttagggggatcgtcatagagtcg

SEQ ID NO: 601872 - DNA, 351 bp, Homo sapiens
acctccgcctcccaggtcctggttgaagcaattctgcctcagcctcccaagtagctgggattacaggtgtgtaccatgcccagctaattttttgtatttttttagtagagacggggtcttaccctgatagccaggctggtcttgaactcctgacctcttgatccgcccacctcggcttcccaaagtgcagggattacaggtatgagccaccgcaccctagatcgcgagcggccgcccttttttttttcattggtggactgtgtttgatttgtctcaaatatttggagtttttttgaaaaatggagcagtaatgcagcatcaacctattaaaatacattttaagccttttaa

SEQ ID NO: 601873 - DNA, 184 bp, Homo sapiens
ttgaagctgattttttgtctctggttttggaagaaagttgctagcaaagtattttttgtgttgaagctttggggtgtgatccagtaggtggcacttatgcatactggtcagctggtagactcttgtccagctatgtggctcccctgtttcctctcatttgtaactgtgttctttctcaatgctc

SEQ ID NO: 601874 - DNA, 2662 bp, Homo sapiens
gctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagacacccagatttgcacagcctggctcctttgagtatgaatatgccatgcgctggaaggcactcattgagatggagaagcagcagcaggaccaagtggaccgcaaccatcaaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacacgcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttggtccatctggtttcattggcttggccccgcccccgagacgggagtcttactctgtcgcccaggctggaggtgtagtgggcatgatctcggctcactggcaatctctgcctccggggtttcaagcttgtccaggtgtgatcttgaactccttgacctcggtgatctacccaccttcggcctcccaaaatgctggggattacacggggtgagccaccgtgcccaacctcacttggcttcttatccttacactcccccagccccagagaaactgccacatacaccacaaaaaccaaaaatcccccaatgaccttagccccattggctccattcattcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggggaggacacccaggaatgacccttttgtgtctatgatgttgctgttcacagcttttcttgataggcctagtacaatcttgggaacagggttactgtatactgaaggtctgacagtagcttttagactcgcctatcttaggtagtcatgctgtgcattttttttttcattggtggactgtgtttgatttgtctcaaatatttggagtttttttgaaaaatggagcagtaatgcagcatcaacctattaaaatacattttaagccttttaa

SEQ ID NO: 601875 - DNA, 624 bp, Homo sapiens
agcggaggggattaatgaagagccaccagactatctttatggagaatctagattgggaagttaagctaagaatgtgcatttttgaaaacagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttaacaaggacctgtatggcctcattttagctgcttcagtgtgttggagctgttacttgctccttcatttcctgggccctggtgtgacagttggctactgagcgccatgaaggttgtcccagaaaaagaatgctgtccggatactctggggggcgagaacggggtgctcgggccatgggagctcaggcggcttctgcaggagctcggtagaggataaaacccggtggactgaaatgggaggggcagagagtagaactgccggatacgtccacgctctaccttcttattggccttcagcccagacaggactctcttagcctccaccatgtgaacataatatctatattacggaaggtgaaga

SEQ ID NO: 601876 - DNA, 224 bp, Homo sapiens
aaagataaaaaaaaaaagggacacgcaggggggctcaggccggtaatcccagcacttgggtatatacaactataaattaccaatttacaatcatatttttaaaaagaaaggctttggaaggtaaaattccaaggacaaattagggtagcattaaggtcggttatttccactgggtatagacacaacttgcacatcacctactttcaccagggatgcccaacagg

SEQ ID NO: 601877 - DNA, 2605 bp, Homo sapiens
gctcttttctcgggacgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagacacccagatttgcacagcctggctcctttgagtatgaatatgccatgcgctggaaggcactcattgagatggagaagcagcagcaggaccaagtggaccgcaaccatcaaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacacgcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttggtccatctggtttcattggcttggccccgcccccgagacgggagtcttactctgtcgcccaggctggaggtgtagtgggcatgatctcggctcactggcaatctctgcctccggggtttcaagcttgtccaggtgtgatcttgaactccttgacctcggtgatctacccaccttcggcctcccaaaatgctggggattacacggggtgagccaccgtgcccaacctcacttggcttcttatccttacactcccccagccccagagaaactgccacatacaccacaaaaaccaaaaatcccccaatgaccttagccccattggctccattcattcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggggaggacacccaggaatgacccttttgtgtctatgatgttgctgttcacagcttttcttgataggcctagtacaatcttgggaacagggttactgtatactgaaggtctgacagtagcttttagactcgcctatcttaggtagtcatgctgtgcattttttttttcattggtggactgtgtttgatttgtctcaaatatttggagtttttttgaaaaatggagcagtaatgcagcatcaacctattaaaatacattttaagccttttaa

SEQ ID NO: 601878 - DNA, 470 bp, Homo sapiens
  misc_feature (8)..(8): n is a, c, g, or t
  misc_feature (73)..(73): n is a, c, g, or t
  misc_feature (145)..(145): n is a, c, g, or t
  misc_feature (154)..(154): n is a, c, g, or t
  misc_feature (199)..(199): n is a, c, g, or t
  misc_feature (206)..(206): n is a, c, g, or t
  misc_feature (235)..(235): n is a, c, g, or t
  misc_feature (237)..(237): n is a, c, g, or t
  misc_feature (249)..(249): n is a, c, g, or t
  misc_feature (268)..(268): n is a, c, g, or t
  misc_feature (271)..(272): n is a, c, g, or t
  misc_feature (278)..(278): n is a, c, g, or t
  misc_feature (286)..(286): n is a, c, g, or t
  misc_feature (289)..(289): n is a, c, g, or t
  misc_feature (298)..(298): n is a, c, g, or t
  misc_feature (307)..(307): n is a, c, g, or t
  misc_feature (315)..(315): n is a, c, g, or t
  misc_feature (321)..(322): n is a, c, g, or t
  misc_feature (329)..(329): n is a, c, g, or t
  misc_feature (332)..(332): n is a, c, g, or t
  misc_feature (334)..(335): n is a, c, g, or t
  misc_feature (338)..(339): n is a, c, g, or t
  misc_feature (341)..(341): n is a, c, g, or t
  misc_feature (353)..(353): n is a, c, g, or t
  misc_feature (468)..(468): n is a, c, g, or t
ctgctgcntccaggccagggggatcttggcgaaccagtcctcctcccagctgctggcggtcctgttccggtanctcggggggaagcggagctgccggtccacctggagtagctgcagcagctgcgcggcgtcctcgtccagagtntccagcttncccacgaagtcgtagtcgatctggcacgggtggcagaggcggtanacctgcngccagtgctcgttgaagggcgccagcttntncgtgtgcgggtncagcaggtaatggatcaanttnnccaagnacaccttnagnccacccccnaacgcctcncgcccccnaggccnncaccctnctntnnttnncntacagcccgcancatggcgcacggcgaacttgcggtagaactcctcgttctccagctcgaacttgctgcggaaggcggagatcaggcgcacgaaggggtcgcgcacgaagaggaacttggtgtactnct

SEQ ID NO: 601879 - DNA, 192 bp, Homo sapiens
  misc_feature (80)..(80): n is a, c, g, or t
  misc_feature (135)..(135): n is a, c, g, or t
ggtggcccaagtcttggtctggaagcactggggccctggaccagggcactgagtttgaggaggcccagagttcagggctntttggagcgagaccacaagcggctggtgagggagccaaggaagaggttctgcttnttggacttggagagctcggccaggcgctgctgcttcctcctgctctagccggctttg

SEQ ID NO: 601880 - DNA, 114 bp, Homo sapiens
actcttgacaggcaacccttcgtgctgtattttcatatccttgttgtgttgttataaaccaagtctcgatctgtgtcaaaataaataaataaataaacaaaaagttggcggccg

SEQ ID NO: 601881 - DNA, 1935 bp, Homo sapiens
gaattcttttgttaattgttcctttggttgggcaaagatatctaacagtgagccacgttcaatgatttcaccattttgcatgaccgcgactttattggcgatttctttgacggcctgcatttcgtgggtgatgagcacaattgtcaaaccaaattcttggttgagctttttgagcaaggccaaaatttgattcgttgtcttgggatccagtgccgaagtggcttcatcggaaattaaaatttcaggatcattggccaaagcgcgggcgatggcacacgttgcttttgaccaccagacaattgtgatggatattgttgtgcgcgatcagataagtcaaccaattcaaggagctcagccactttttagctttttctttttcagatagtgggctgtgttggagggcaaacgccacgttttctgttaccgtgcgttcgtttagcaagttaaaatgttggaaaatcatgccaattttgcgtcgcccatcacggagcttttggctagaaatacgggtaattttaccggtcttatcatcactttgaaagaaaacttcgccgttgacgaccacagaaccactggttggttcttgtaggaggttaatgacacgtactaatgttgatttaccagcacctgaataaccaacaatgccgtaaacatccccccgttcaacatggacagagacgttgtttaccgcagtaatcgtccgtttttttcgatggaaagcgacagtaatattgtctaatgcaataatgggttgactcattcatttactcctttagttgagatgcttgataactcttaattaaagctttgacggcatcaatatgttggtcataatcaaccaaacgaatatgctcgtttggtgcatgatcgaggttattggcataaccaacgccaaggctggcaattggggcctgcaaagccgcataaatcgttgccattggacccgtgccaggtgatgtcggcatgaccacgggtgcgacttgataataagctttggccacagagatgacccgttgaatttctgggtcagacatatcgctgcgataaccagctagccccagtgttttggtaacggtgatatccgtaaaaccttgtgcagtcaaatggtaagcaatgcgttgtaacgtgatgtcaggtgacatattggggactaagcgcttctaatttagccgtggcggtcgcgggtaagacagttttaacacctttatcattataccctgagatgatgccttggacattaagggttggttggaaatacaaggtttcttttaaatcttggccgttacgatctgtataaagtggcacttttaggccgtgttgtgccactaaatcttctcgtgttagcggtaactggccaattaaagctttttcacgtgcatttggtgcgatgacttcatcataaaaatacggtacggcaatattgccttgttggtcaaataatgcggcaatggcttgtgataagcggataggagccgagtcaacaacagccgacaatgatgaatgtaggtcactatctgctgtgttagcggttaattcaaaggtcacaatccctttattcccgccataaatttcgacaatgtcgtccgcatttttaccaccagattcccaaagcactaaatcagccgcgatggtgttagtatgttttgccaaatattctggtaagtatggtgaagcagtttcttcggcaccttcgacgataaagatgatattaaccggtaaggtttggtcattttcttttaaatactcggcaactgcgctagacgcgcagttaaattgcctttatcgtcgtcaacaccgcggccatatagcttaccatcccgtgctgacaatgtccaaggcgccgtcgtccacaggtcaaggggttcggcgggttggacatcatagtggttataaatcacaagggtcttggcatcgggttggtcactggtgaattcc

SEQ ID NO: 601882 - DNA, 281 bp, Homo sapiens
taccggttcgcatgttcctgagtaggctccttccaccccacctcgcccttccccttcactgcagaggtctggggctcctggggcctggattatttcctggacatcctcctcacaggcagcatgggatcaaacattggcacttggagcctggcgttctagcccaggttctgcaaccaattcctgcataacctcaggaaagtctcttctgtaatatgaaactactagtctattctacatttcaacttttgtcaccaaacaaaaagcggaacccctttttcggg

SEQ ID NO: 601883 - DNA, 954 bp, Homo sapiens
agcgagcaggagctggtggatcgccgagcgcgagtgagggagccgagccgccgccgcgcgctccgctcccctccggaacaggagcccgggcggggccccgaaggcgcccagccgtccctcggcgtcaggccggagtgttagcgcgcgcagaggaaacaaggggaaggaagacccgagcgagcgcgggagaaggggccgaaccgagggggcgccggcgcggttgtgccgttgaagggacaagaccgtgttggcgcgggacatcgagacagtcgaatgtcacaccaccaccggacaaagggtggcgggggaacaaaaacacattcagtaacagagacggcccaaacacaaaaacggcgagccgaagcacgaccacacgccgcatgagcgggtgcaccggacacagaaaacgccaaacacagaagcaagagagcaacccacacacaaacaagtagagacaacatcaacagacaccaaaagaaacgcgaacaacacaaaagaagaagcgaaggagaaaggaaccaagagaaaccaaaacaacgaaaagacacaagcacacgaagagcagcacagcaagacgaacgacaaaagagcaccacagagcgcaaaaggcagggcaaaccaaaacaggcacccaaacaagcgacggggctcccgagtctagcgacaaagaagcagacagcacgcaggacatactagacaagacgcacagacacgatagcagaagtcaaacgaggcaagcgacaaagtagtagagtggagaacaagtagaaaatacaccacgcaggcgcaacgaggacggcgagagaaacaaggaacagcagataagaagaagaaaagagagaagggaacagagcgaaggaaagaaccgcataagtagacggggaagacaacgaaagggacaacagcatgaggccagcacaacgacaagaccccacaccggagcctcgccagcta

SEQ ID NO: 601884 - DNA, 174 bp, Homo sapiens
tgctgatctagaggatcctggtgttccctttgtctggtggtaaattcgatacaaaatgattctttttggaatcctgaatccataaattacactcttttttttcaagcttcacaaaattcacagtggtgctgactgtagtaataaccactaattgggaaacatcccgctaaacct

SEQ ID NO: 601885 - DNA, 122 bp, Homo sapiens
  misc_feature (110)..(111): n is a, c, g, or t
cacatgctattcttgattgctgcagtagcctacgcccaaagcaccatgacatgtgtcatgtgctcaataaatacgggatgatgggtggttggaatcacaacgcgatgaannttattcactgt

SEQ ID NO: 601886 - DNA, 241 bp, Homo sapiens
ttcccccatttttggggcccccccttaattttttggggaaaaaaagcccggggctcccccacccttttaccctttaaagagggaagggaaagggggccctttttcctttttttgggggccaagttttgcccccccttttgggggttttagggggggggggttttcctttggggaaaaaaaagggtttttttccccccccccccccggggtttggggaaaaaaaatcccccccccgggggga

SEQ ID NO: 601887 - DNA, 799 bp, Homo sapiens
tggtcaaatgatcctttattgaaatgtttcccttggtgcttaacgggctgggcttcccaaagccccacggttgatgtcatcgatgatgtcatgaggatggcggccatcaacattacagcccattgacggggcagtccccaggatctctttaatgggttccagagagttctcgggctaaggatcggtgccgcatctgtcgagcaatgttgacaatctcatcaaaagtgatatccccacggtgtcaaatggtttctctggtttctttctgtctctggggggtccccttgagggcttggatagatcagggcagaggcagaaggcaccacctcaatctgggggcctgtctgtctgaagggtcagtttcactggtaatcctcaggcccttccagtcacccgttgcctgggagatgtcatcaccaacttttttgggagacagacccagggggccgatctgggcgggccaggcagaagtggcaccgatttcacctcgggtgcacctcaggtatacgacttggatctcgtgggggtcgaactccggcggacatgggggaggcggcgggggtcggatagaacccggattcgggacgaccgaacgtaagttgccacttgggcttcctccgagccaaggttaacttagacaagtggccacaccccagggttccgtctcatccctcaggggttctcttctgaccggaggtcaacatccgtcatcgggggctcccacaaacccaatctctgcaccagggacacccaaccctgtgcggctcacagcggcgaggaaacaaaacacaaaaaaact

SEQ ID NO: 601888 - DNA, 863 bp, Homo sapiens
cgagcttggtctgcttgcggcgtcctgcggatgtcgtcggcgcgccccgccccgtgttgtgcgccgcccccgcgcttgtggtggttcgcgcgacgcgcccgtggtgtctgtctgtcccctccagcacccccccctctcgtgtagggacgttctctcttccgtgcgcgcgccgggctggagtgttgttttatgtgtgtgtgtgtggctcgcacccgcgggaggaggtgggttcgacactgcgctctcttctctgtgattttgtgtttgttgctcgctcttgcggccggcgtaccctctcgtctcgactgtttctctggatgatcgccactctctctcacacacttcgcgtcgctttgcatgaaaataactctctctcttctcacagagggacgtttcccccacaactgtttgtttcgccctcgacagctaagagcagagacgtcgttgtgtaaaggagcaatgtttttttgacacaaacccacctcgcttggatagaatcgatgcgcgcattaatccccccccccccctcctcttttaacaactcactgtcgcggggggtgaatatctcttctctgtgtgtgtgacacaacgtcgtgtcgtcgtgctcgaggatagcaccccttgtcccttctctcacggggagtcaccaaccaatgttgttgttcacagcccgaattacgcccccgctggacaaatgtgtgctcccacgcaccaacaggggggtgcactcaccccacgccacccctttccaccaagtagaccccccttctcaccgggggggaaccccccccttttttaaacccctccccccttttttcctttttccccccccccccccatctttcccggtgttttttttttta

SEQ ID NO: 601889 - DNA, 429 bp, Homo sapiens
  misc_feature (114)..(114): n is a, c, g, or t
aggatataatttgatagcagctggaacctttaaatggtgtgatcattcttaggaattttgtgacgtccactgtcaaaaaagtgtaagttgtgtattatccttaaacaatgtaanagctttactgcagaagggctcagtagcatgcaacactcagggaagggctgggcgcggtggctcaggtctgtaaacccagaactttgggaggaggatcacttaaggccaggagttcgagatcagccttaccaacatggtgaaaccctgtctctactaaaaatacaaaaagtagcagggcgcagtggcgcctgcctgtaatcctatctaatggagagggtgaggcatgagaattgcttgaacctgggaggtggaggtagcagtgagctgagatcacaccaccgcactacatcctggggacagagtgagtgtcgacgc

SEQ ID NO: 601890 - DNA, 503 bp, Homo sapiens
gtctcaaaaaataataaataaataaaagctatggctgaggggcccagctgggcttgctccaggacaggaactagcagcaggggatgtggaatcgcctgccagtcattgcagacagtctgcaggctcctaggggcgtccaagcccactcttactctgcagggtgctcctgacaccagtttcaaggtggaaaggttgacggccctaaggattggagggcgcagatgggaaagggggatgctcgtgatgtctggggtgctgagatgaggaggtcaccagcagaacagcagctccggcaggcacaaggcagactcgaccaccaagctgggtttctgtaggtctggaatctggccagaaggctgcagccgcatgcagcctgggggtaggcacctctgccctcagccctaatgggcagcaactccccctcctgccacaagctccccacatgagggagggcagtttttagttcaacctattcagtctaaccccagggaagaggctgctcc

SEQ ID NO: 601891 - DNA, 316 bp, Homo sapiens
  misc_feature (155)..(155): n is a, c, g, or t
gaaagagaaaaaggaaaggtggggctcctttctaagggtgtgtgaggtaatgctaagagatttctgagataaagcagagatacgaaacctctttcctggctggcgtttctctatcaaggagtacagtcagcttgtttgaaagggtagaacaaccnctgctagaagaagctgaagccccggaagagatccccgggttcttttggtatgaatttaaactttaaggcataatttcttaagaacttagccatattgcaaggtaattaaaaatcccctttaaaaattttttgaaaatcatgaagatagggactaagtgctt

SEQ ID NO: 601892 - DNA, 330 bp, Homo sapiens
gcatttgttaactgctgtttcttcaacttatgatacatcatccttccatcgaggccactaactttgattcttggggtccatcaaaactcaggtcaataagatgtcctggctcacacctgtaatcccactactttgggaagccaaggtgggaggatcacttaaggctaggagttggaaatcagcctggccaacacagtgatatcctgtccctataaaaaatgcaaataaaaaataaaaaatcagtttgatttctttatcttctgctgagtcatctctgctcctctgaggtcactgtactctctttttactgtgacttcatgaccctctgca

SEQ ID NO: 601893 - DNA, 175 bp, Homo sapiens
aacgggtggttgtcatgtgatgagacccctccaggttactaaagggtgcatgtcccctgcttgaacactgaagggcaggtggtgggccatggccatggtccccagctgaggagcaggtgtccctgagaacccaaacttcccagagagtatgtgagaaccaaccgcatcacccgtt

SEQ ID NO: 601894 - DNA, 228 bp, Homo sapiens
cgtgacccgaggtatccctctcttccggcttacttccatcaaacttttctttaaagcctgggactagggaacagatgacttctttaacagtgacaataacagagtcagctatgctccagatgctgcactcacctatccctgctcttaactctcgtaatttactctatcgccttatgcttaaccatttttatctgaattacagttagtgtagtagaacctacggaaaca

SEQ ID NO: 601895 - DNA, 228 bp, Homo sapiens
  misc_feature (35)..(35): n is a, c, g, or t
  misc_feature (99)..(99): n is a, c, g, or t
gacgctgttcactgtgcacgactgttatatatttntgctgtggtgaaaacatagtgtgagtaaaattatttgcagtggtgagacatttttgagtacacngtacatgtcgctggggggtgtgcgagaacagaagaggtcctgtttcaaccctacgtgtgggtgactagttattgctaggtgatacagtaggtgctgtaagggaacattacgaggtattcgtatgtcgtg

SEQ ID NO: 601896 - DNA, 563 bp, Homo sapiens
  misc_feature (1)..(1): n is a, c, g, or t
ntgggaaaatatggggaaaatccatgtctgaggttaattgattaaaaaggaggagctttgagtgacttctgtgcttggtgtgatggtgatattcaccaaggtaagttatactagaataataagttagggagataatagtgagttgagacatttatgaaatatgcaggtgtctagtagagttggataaataggcctggagcttgagaaattcagaacaaagatagtgatttggacatcatgagaggcagtatacagtaataataataataaatagactggacgtggtggctcacgcctgtaatcccagcactttgagaggccgaggcaggtggattgcctgagctcaggagttcaagacaagcctgggaaacattgcaaaacccattctctacaaaaaatacaaaaaattagccaggcatggtggcatgcgcctgtggtcccagctacttgggaggctgaagtgggagaatcgcttgagcctgggaggttgaggctgcagtgagctcacgtcatgccactgcactccagcctgggtgacagagggagatcctatctcaaaaaaa

SEQ ID NO: 601897 - DNA, 104 bp, Homo sapiens
tacttcaggaaattgaggcaaatgtatcatcatgattaatgttaagagagataacctaaaaccacaatcagtatcttacgttacttataagtcacgaaaaatag

SEQ ID NO: 601898 - DNA, 436 bp, Homo sapiens
ataggaaacagtacataccttattacctgggaaaacccgcttgagttcttctgaaaccagaaagtgtttcttttttcatatgcagagaacacctgttctcctctctatcgctcactacacaattctcctctgtttatattttaaaccataggattcttatccttctagccccactgctaacaatctattttcttatggcccttccgtctgtctgtgaaagggtcaggcttatctagctaaaccctataaatacaaatattttgtgatgaccacagtcaagacagtacttataatatgtaataggggggacggagttttgctactagtagcccaggctggagggcaatggcgcagtctcagttcactgcaacctctgcctccagggttcaagtgattctcttacctcagcctcccaagtagctaggattaacaggtg

SEQ ID NO: 601899 - DNA, 464 bp, Homo sapiens
gccccccacgccgctgggcacctcagcatgactggcactgggccggcgctatgggctgcttacgtggtgcgtgtggaccttcgtcgcctggccccaggccaccagtaccgagcctgctgacccggtcatcaagatcccgaagcacgctgctccccgtctcatctgcctacgtttatcccgtccagtcgagcgtggactgatcggcaggctgaacaggctgtcgacgccgccggagagtggctgaggcgctccacgcacgcggtacgagaacggggtctactgctcgctagctttgcctacactcaggtgacccctcgcatagagagcgatgccacgtctggcgcggacgtcgtagcatagcgtaagcgtgagcgctctctggactcgcaaggggcctatcgatagtgcagctccgttgggagaaaggaggtccggttcagtgacccaccaccagaacgccgttt

SEQ ID NO: 601900 - DNA, 600 bp, Homo sapiens
  misc_feature (63)..(64): n is a, c, g, or t
  misc_feature (68)..(68): n is a, c, g, or t
  misc_feature (79)..(79): n is a, c, g, or t
  misc_feature (97)..(97): n is a, c, g, or t
  misc_feature (114)..(114): n is a, c, g, or t
  misc_feature (127)..(127): n is a, c, g, or t
  misc_feature (135)..(135): n is a, c, g, or t
  misc_feature (147)..(147): n is a, c, g, or t
  misc_feature (149)..(149): n is a, c, g, or t
  misc_feature (152)..(152): n is a, c, g, or t
  misc_feature (154)..(154): n is a, c, g, or t
  misc_feature (162)..(162): n is a, c, g, or t
  misc_feature (185)..(186): n is a, c, g, or t
  misc_feature (189)..(189): n is a, c, g, or t
  misc_feature (192)..(192): n is a, c, g, or t
  misc_feature (211)..(211): n is a, c, g, or t
  misc_feature (225)..(225): n is a, c, g, or t
  misc_feature (450)..(450): n is a, c, g, or t
  misc_feature (480)..(480): n is a, c, g, or t
  misc_feature (518)..(518): n is a, c, g, or t
  misc_feature (528)..(528): n is a, c, g, or t
ttacttggggggcaaggactggaaaaaaggccgcatgtcttttggctcactagtgtttaaggnncccngcttcctttgnttggatccacagaatatnttcctcatcctatttantgcagcaaatctntccttagntgatgagactgngnttntntccccttnaaaccccacccatcctgaaaggnntgncantgtttgcccttaaaaaccntcctcttttttccncccctatttttttaaaaaagatgggggttaggtataccccaagctcccttttcaaaatattttctccgggctttgcaaaaaacccccaacaaaaaagccctttttaaaaaggggggtttttttttttaaaaagtaagcccccccaaaacaggggcaatgttttttgtatgttttattgggcctaggaccccgtaaaagccccataaaaatttattatggggggcngtgagtttttattataagggggagaaactnaaatccccaaccctgttttgttgcttgtttttttatgncccccaattnaattggggaaaattggccccttttaaaaattgtccccaatatttccttccaataaaagggccatggggaaca

SEQ ID NO: 601901 - DNA, 349 bp, Homo sapiens
ggcaaaggggggcactctcttttttgtgtgtattctgcacggttcctttaaaaaaaaggggtgcccggggggttcccccccttgggttggggttaaaaacaccccccaaaatttaggggcctttgggccctgggtggtttttccattaaaaccgctttgggcccgggcccttacttgtttttttagttttttgggcttttccggttggccccggtccccccccccctttaaggttttttgggggaaacattcccccctccccttttcttttttccccctttttggggcccctccggggctgttgttttagggcctccttttttgttttttaaccccgggtttggcccca

SEQ ID NO: 601902 - DNA, 970 bp, Homo sapiens
  misc_feature (1)..(1): n is a, c, g, or t
  misc_feature (193)..(193): n is a, c, g, or t
  misc_feature (242)..(242): n is a, c, g, or t
  misc_feature (299)..(299): n is a, c, g, or t
  misc_feature (326)..(326): n is a, c, g, or t
  misc_feature (400)..(400): n is a, c, g, or t
  misc_feature (419)..(419): n is a, c, g, or t
  misc_feature (446)..(446): n is a, c, g, or t
  misc_feature (463)..(463): n is a, c, g, or t
  misc_feature (471)..(471): n is a, c, g, or t
  misc_feature (506)..(506): n is a, c, g, or t
  misc_feature (528)..(528): n is a, c, g, or t
  misc_feature (639)..(639): n is a, c, g, or t
  misc_feature (693)..(694): n is a, c, g, or t
  misc_feature (705)..(705): n is a, c, g, or t
  misc_feature (714)..(714): n is a, c, g, or t
  misc_feature (723)..(723): n is a, c, g, or t
  misc_feature (726)..(726): n is a, c, g, or t
  misc_feature (738)..(738): n is a, c, g, or t
  misc_feature (760)..(760): n is a, c, g, or t
  misc_feature (764)..(764): n is a, c, g, or t
  misc_feature (788)..(788): n is a, c, g, or t
  misc_feature (796)..(796): n is a, c, g, or t
  misc_feature (799)..(799): n is a, c, g, or t
  misc_feature (821)..(821): n is a, c, g, or t
  misc_feature (824)..(825): n is a, c, g, or t
  misc_feature (840)..(840): n is a, c, g, or t
  misc_feature (852)..(852): n is a, c, g, or t
  misc_feature (882)..(882): n is a, c, g, or t
  misc_feature (890)..(890): n is a, c, g, or t
  misc_feature (958)..(958): n is a, c, g, or t
ngagggggctcgaagggctggggcaggctctgggagtggacattccagagacgggcatgacagttcagaagagcatgggctgcgctaccccctcagctgacagggctgtggggcacactgggtcccagggcccagccccaagggtcccccaccagccacacccctctagcgcgcgcgcgccccgcgcgcgccncacacacacacacacacacatcacacatcacacacacacaggcagccancctcaaacactctcaaaaggccaggcctcacccggggagagggcgccagcaggtgantggtccggggagaattcagctccaccncttcaccccaatcggacacaggctggtggccgcggggtggtgagaaagggctggaaggcgtgccaggggccttnggctccagcaggggctccnccggactgaaggggactccgtgggccntcccaccgtcagggganccctggtngggggcagcctctggggctttggtggtcttgggcnggttcctcctcaacaccttctnccacctcgatccccccctcttcctcatcctcatcttatgttctcccattcttcatcctcttccccctcattctcttccccctcgtcttcaggaggccggtgggcaggagcngggatctcgggtggctgcatgggtgtctccttgggggaagtctcgggggaagtnngctgtggagtntcaggggcnggggatgcngcnccttcttttgtntcccagcggtcatcatggtcantgtnggccctgggcgctgccttggcctnggggccgnctnctctttctccttctgcggctgntgnnctcagcttttgtgcngggacaggaacnccccaaaaagtaggggggcttcggggggcngggcccanggcctgggtcatcatagcggtgggatggttcatgggcagggactgggccatccttgaacatcccatcngtcttctcggca

SEQ ID NO: 601903 - DNA, 514 bp, Homo sapiens
aacccaagggcgctattccacatgtctcaaatgattggcagggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacatttggtgtacgggattgatcaggattttaaagtacagttgacacacttccattcatcatcatcaattaaggaccctaagaaaccccgtccgcaaagccaatttttccccaatccgcaataacagacattacatggacaatgcacaatggcttattagagcaacgattcctgctcagaaaaatttccttataaacagctccaaaccaggggtgcctgagctagatta

SEQ ID NO: 601904 - DNA, 899 bp, Homo sapiens
actctaggatctcagcacccacttattgagacgctttttgttgttccaagtgctctggtgcacagacggggggtgttggctctgaggagagctgcggttgcgtgagcattagtgtgagcgctgggacatgtgcatatagttaagaggcgagagaatgaaggaggctaaggtcgtaaggggccggggtctccttgttgcgcatgagacggctccagtccctcgtcatcctgccgatgacctcctcacattcgtagagatcttggagagtccgaggtcgaggagatagttgcgtagttgtgatatttaagattcattgtattgaagtaaccgatcaagacatctgaaaaaaaaaaagagggggaggggaaaaaaaaagataacccaagcgaggggcggcgccagcggcaataaaaggtatccccccccgggagtgggggtcggtaccaaaattggggggcccccccacgtgaggaggctcgttcgttggtagaaagagggcggaccgcagcaggggcgagagcggcagtagataaacaacacccggatcgaggagctggggcgaacccattgtgtgcaaagccagctgggggacctactgtggtggcaacagcgaccgcataccatggagcgggtgtgggaggacaaaaggactgcgccagacaacagcaggcggggggaggacgacaattagaagggggccccaagagggccctagtagatgaacaattttaacagcgtgtggtggagggtggtttttaaacaatttgtgaagatggtatatgtgcggggctagcaacagttgtggcatacacgggggcatggtcattggaagaaaggtttataggagaggattgaggagaaacaaaattttatcccgaagggtgtcaataaataacggc

SEQ ID NO: 601905 - DNA, 156 bp, Homo sapiens
gactagccgaaggtagcaggctggaagaacaggctgtgcaggccttctttctgcccttcctccccagagagcctgtcagaaaggtgagtagcagccccatcttgtcggccctggactgtcgggggggggcagtcggggctgtcgggctagtcgggg

SEQ ID NO: 601906 - DNA, 949 bp, Homo sapiens
tcccccccaaaaaccggggggggggggccccccccggggccccccagggagggggcgcccccccccggaaaaaaaacacgccggcgggggggggcccaaaattctgtctcgggccccccgcggggggggggggggagagagaaaacaccgaggggggggtcgagtggagcaaaaaaaaaaaaggcggtgggggggggcccccgcggaaagatgatatatgagcgcccgggccgtggtcagaggagggcggcgcgcccggggtgatgacacccccccccgcagggatgggggggggcgggcgcgcgcgggagaggaagaagggcgacgacgacggccgggtactcacagacagcagaggaggggtggagcaaggacggggaggaggggggggggagggctgcccgccagccgcgcgcgagcagcagctagcgaagaaggaagaagcggggtgggcgttctcacacccacccgggggagagcaataaaaagaaagagggagccgcccaactgggggtggagagcagccccccaccctagtgtgagcggggagctagtgtgttggcacgaagaaaaacccccccaggaaggacgggcgacacaatggagcggcaggagtctaaagccgggcagcaactacgctatctcggccgagacagcgatcttggagcagacaggagatgattgtcgaccacccaggtgagagacagcccgccgcaaaataggtgggcaccccctgatgaaagggaaagacgcgcgctggtgtttggtgagggaaccccccgctggtgtgagaacaacctgtggggtgaccaaagcaggcagcagaagagagacccccggtggtagaaagaggggccgcgcccacccctcgagggagaaaccggacgggggagcgcggccgatcagagtaacaccagaggagggggagggatccaccacgtgtaggaga

SEQ ID NO: 601907 - DNA, 435 bp, Homo sapiens
aattttgtgaggcagtctccatacatacggccaacagatcacgtgagaaatgctcagcatcactgatcaccagagaaatgcaggtcaggaacttaatgagacaccatctcacaccagtcagaatggctatggttaaacacgtcaataaaaataacagatgccggtgaggctgcagagaatgagggcatgcttattcactgctggtgggaatgcaaattagttcagcccctgtggaaaacagttaggagatttctcaaagaagcaagaatagaattaccattcaacccagcaaccccatgactgggtatacacccaaaggaaaataaatcacaaaagacacctgcccttgtatgtttatcacagcactgtacgttgggtagaatacgtattggtgacgaggtgactaggcaggagattcttggctgaataacatgt

SEQ ID NO: 601908 - DNA, 419 bp, Homo sapiens
  misc_feature (171)..(171): n is a, c, g, or t
  misc_feature (253)..(253): n is a, c, g, or t
  misc_feature (282)..(282): n is a, c, g, or t
  misc_feature (292)..(292): n is a, c, g, or t
  misc_feature (297)..(297): n is a, c, g, or t
  misc_feature (304)..(304): n is a, c, g, or t
  misc_feature (375)..(375): n is a, c, g, or t
  misc_feature (385)..(385): n is a, c, g, or t
  misc_feature (402)..(402): n is a, c, g, or t
  misc_feature (413)..(413): n is a, c, g, or t
attagccgggcgtcggtggtgtgtgcttgtagtcccagctactcgggaggctgaggcaggagaatcgcttgaatccgggagcagaggttgcagtgagccaagatcaggccactgcactccagcctcggggtcaagagcgaaactctgtctcaaacaaaaagaaagaaaggnaggaaggaaggagggaaggaaggaaggaaagagagaaagaaaagaaagaaagaaagaaagaaagaaagaaagaaagaaaganagaaagaaagaaagaaagaaagaaagggnaaagaatttnctttnctatttngtataaaattggaatttttaccagcttagcctcctaggagagttactgaaccgtggttaccttggggaatnttaaataganctgccaaattttaaaantggacttgggnccactt

SEQ ID NO: 601909 - DNA, 101 bp, Homo sapiens
acgctctcacccacccctgcggggagtatgacaccagccacacgtcatcccgctgaggagctcggctctgggatgttgtggtggctggtggtcaaccgtcc

SEQ ID NO: 601910 - DNA, 458 bp, Homo sapiens
ctcgaggccaagcaacgcgctggacaaccccgagccgttcctgcacaccaatgtggtgggcaccttcaccattctcgaggcggtgcgacgcaacggggtgcggctgcatcacatctcgaccgacgaggtgtacggcgacctcgaactcgacgacccccagcggttcaccgaatccacgccgtacaacccgtcgagcccatactcggcgaccaaggccggcagcgacatgctggtgcgcgcctgggtgcggtcctacggcgtgcgtgcgacgctgtcgaactgctccaacaactacggcccgttccagcacatcgagaagttcattccgcgccagatcaccaacgtgctcaccggacggcgatgcaagctctatggcagcgggcacaacgtgcgcgactggatacacgtcgaggaccacaacagcgcggtccggcggatcctggagaagggcgagtcgg

SEQ ID NO: 601911 - DNA, 427 bp, Homo sapiens
aggtgggcaggtgtagcagtgcaagccatgtggttaaggcccatcgtcgggtcaagggggctgttcgcaaggtatttgaaggccactggtgttctcaggcgcatgttgcttacaggccaaggctggttcccttagaaatcttcaggcactacgatgggttccgtcccttgcctcagcctttagacttccggctttatctggtcgattgggtcctcctatgctgactctccggaggatctgtgcttctatcagggtttgaggcacaagttctgacgccctcttattacagctagttccttctgcatgagaccactccgcgcgccaatgcagtttctgggccaacgattcaaggctctgagtctgcacgggtcgctgtgacacagagacacccgctcatctgccccgatacggatcctctcatgcgcct

SEQ ID NO: 601912 - DNA, 300 bp, Homo sapiens
atttttcattgttgatgttgacctccattacctggctgtgtttacagatttctccattgtaaagttactcattttttccttttgccatgctgtactctttgggaggaagtcactaagcacagtgcatacttaaggagtagggagttacactgccttcattgggggtaggaatatctacataattaatttggaatttttctacacaggcaattcgtctcttctccatttatttgtttgtacaatctatatgatttatatcagtatggactcatggatattcattcatacttaagaaccgtt

SEQ ID NO: 601913 - DNA, 552 bp, Homo sapiens
  misc_feature (7)..(7): n is a, c, g, or t
  misc_feature (15)..(15): n is a, c, g, or t
  misc_feature (51)..(51): n is a, c, g, or t
  misc_feature (160)..(160): n is a, c, g, or t
  misc_feature (166)..(166): n is a, c, g, or t
  misc_feature (303)..(303): n is a, c, g, or t
  misc_feature (456)..(457): n is a, c, g, or t
cactatnccatattnccaactcgaaattaccctactaaggaacaaaactgnagctccaccggtgcggccgctctaaactagtggatcccccggctgcaggaatcggcacgaggtcgtaaggctgaggatttttggtcgcacgtcctgctcctgctcaccntgttcnctcgccgagaacaagcggtcagaacccgcgcgcacaccatgcttttaaggataccggaaaacacccgtggagcggaggtggaattaccgaatcgaataccctaacaagcgcaacgtaaaccttggaaaaggtgtgtntgcttgataagagcgcaaaagaaaagaatctcaaagtaaagaccagtcgaatcctaccaagctttagaatcactacaagaaaactccttgtggtaaggtctaagcgtgggtcgttccagatagaattacaaggctcattgcttgacagccttnnagattgtaagcagattctccatcagtattagccagagttgaggtgaagtaccattgagatcttaagtaactattttaataaattgatgaccagcg

SEQ ID NO: 601914 - DNA, 264 bp, Homo sapiens
ttgtcatcggggataatcaaccgaggtgtgcgtgggagtgagagatggtgcttcccggctgccccattcgatttcgttctgcactgtaattagcccagtgtggctcacttgcttgcttgtggtaattgcggccagaagaattgtttctgtcgccagtaaccagcttgtaccgcaggaggagacataggcgaaaggggagcggttggtgaggagcagcctttgaaataagcatatttttgagacccacagtctttggcagggctc

SEQ ID NO: 601915 - DNA, 370 bp, Homo sapiens
  misc_feature (14)..(14): n is a, c, g, or t
  misc_feature (49)..(49): n is a, c, g, or t
  misc_feature (100)..(100): n is a, c, g, or t
  misc_feature (172)..(172): n is a, c, g, or t
cctcacaatgttgncaacaaatcacagttgtgttagcaatacttatttngtcaccaacagaattagaatacatattaattacagattgggtgtggtggtntgggcctgtagtcccagctattgagaggctgtggtgggaggattgcctgagcccaggaacttgaggttgcantgacagagggcctgggtgacagagggcgactctgtctcttaaccacaattagccgggcgtagtggcacgtgtctgtagtcccagctacttcaggaggccaaggcaggagaattgcttgaacctgggaggcggaggttgcagtgagctgagatcacgctactgcactccagctcgggcaacagagcgagactctgtctc

SEQ ID NO: 601916 - DNA, 408 bp, Homo sapiens
  misc_feature (92)..(92): n is a, c, g, or t
  misc_feature (154)..(154): n is a, c, g, or t
  misc_feature (157)..(157): n is a, c, g, or t
  misc_feature (187)..(187): n is a, c, g, or t
  misc_feature (228)..(228): n is a, c, g, or t
  misc_feature (374)..(374): n is a, c, g, or t
  misc_feature (408)..(408): n is a, c, g, or t
atcatgaaaaacatacattgttctctcaggggaaaactgtcctttatcccataaaggacaaatatttacaaagtactcccagtttaatgtgnccctaattagacaaaggctaaaaaactttaaaatattaaattttccttcaggctgggcatgngtntaacgcctctaatcccggcactttgggagnccagggcgggtaatcacttggggtcaggagttggagaccancctggccaacatggtgaaacctgtctctattaaaaatacaaaaattagccgggcatggtggtgggcatctgtggttccggatgcttgggaggctgaggggggagaatggcttgagcttgggaggcagaggttgcagtcagctttgntcatgccactgcactccagcctgggtgacagagn

SEQ ID NO: 601917 - DNA, 795 bp, Homo sapiens
  misc_feature (22)..(22): n is a, c, g, or t
  misc_feature (32)..(32): n is a, c, g, or t
gaagcaggggagccccatgagnccatggaaancagagagagagagaaagggagaggaggatggaaacatgaaagccaagaggagagaagaagaggaggggggaagaggaaggagagggagggaaaggggggaaaggaaggggggaaaggaggaaggaggggaggagaaggaggggaaaagggaagaagaaggggggaaaaagaggaagggagagagagggggaaaaggaaggaaaaggaggggggggggaaaagaggaggggagggaggaaggaagagggagaaggaaaaggaaagggggaagaggagaagaaaagagagaggaagaagggaagaagggagagaaaggggagaagagagggagaaaagagggggagagaaggagaagacaagaaaaggagaaagggggaggagagggagggggaggaggaggagaaagggagaagagaaggagacgaggaggaagagggagaagaaaggggagaaggaggaggagggaggagaagaggagggaaggaggagacgaagggaagaggggagagggaaagagaagaggggaagaaggaagagagagaaaaaagggaggaaggaggaggaagaaggggaagcggagggaaagggagagaggaagggagcgaagagagaaggggaggaagaggaaggagagagggaaaagggagaaggggaaaggacgaagaaggaaggagaggagaaggggaaggaaaaaaggaggaaaggcaggagggaagggaaggagagagaaagaggagaggggaaggagagagaagggggagag

SEQ ID NO: 601918 - DNA, 765 bp, Homo sapiens
ccactcccctccctctaacagcaggctgtgtgggtttcaattcccatccttcccaccccggtctcaagtgtcctaccgcggtgagatccagggttctcgaatgtgtgctgtgcgaggccccttgcaacttgtatgggctgtcacgttcgtctcacgtctcctggcttcaatccgtgccctgtgccctgggcttagcgctttgagttactcgattctggtgacttgctttggttgggaggcgtcgtgaagggagacaaactcctcatagtctctggttgcgctcttgcaccacttttgcataggggaggtcgtggttggggaaaccaggaagcgtgtggcactttagtgtcaccccatgtgcttgatcagctggaggtggtgccgcgtgcgttgtcacctagtgcgccttgcttgtgtggtaacctgttccatgtcgcagtttggttgccccagcgttgccttgcgtccttaacaatccatagagaagaagactgtacccagaacctctctctcccaaatgcgggacaccccaggcaacatccgcaaatgcacgcccaacgtcttgcggaggggacacagacgaggcttgcgcgcataggcgaagcacaggaaggcatggacattgaaacaatgaggatggaagggttgaacccgtgtaaagacccaaacgtttcctacttgaggctgcgatagacatggtaacattgtttcagcgtaaacaccttcttttcacagaagaaggcatgccattcccaaaaattttgg

SEQ ID NO: 601919 - DNA, 420 bp, Homo sapiens
ggatagcctgttaatcgtctctagaggtatcccacgccggaggctgtgcacgtcttctgctgcaaaatggcgccaatccacatattacggatatctttggaatggactgctctgctctacgctgtgtacagtgaatatacatccattatagaaaaacttctttcatcatggtacaaatatagaagaatgcatgcaaggtataggtcaatccaatgttattttcaccctattctgaatatgtcatttattttaacattgatcagcatgtaagggtcaatttaccataatttggcagctcatacattccttgaagtgagaatcattttgaagtgccttaactgtttccgattttactttaaatattggaacttttaaagaagtcattatagggaacagtctcatgtcatgcacttatggtaa

SEQ ID NO: 601920 - DNA, 606 bp, Homo sapiens
atggtctcgatctctgacttgtgatctgcctgcctcggctccccaaggtgctgggattacaggcgtaagccaccatgcccgatggccaagaattttctagaatgggtaaacatttgagaagctatgattcctgatcgggatatacaagaaaagaatctttacctagaacaagagtgaaaaaaactcaacaattgaaagtcaaaaagaaaatatgaaacagtctcaggtctcctccattttttctgtatgactgtttcaagccactcactttactgatgttgaactgatactcatcactctaagatttatagaccaaaactattaattaggcttattaattggtagctatttatagacaaagccacaagtgggaacccggtatcccttatgtccagtgcaccagttatatgtgatattctggagacaataggcaaatgaatttttatataaagaaagtagttcacttttcaaacttaaaagggaaatatataagaatgcagtcatcttttacatggttcaaaataatgagaacaatatttagcaaatacttagaaacgtgtcccaccagctaaacgtgttaggcaacaaaaagtagtagaaataaga

SEQ ID NO: 601921 - DNA, 201 bp, Homo sapiens
tcagggaaatggccttcccgccggaggccagctatttgcctgacaggctgtgacttttttttcaaccttggccttttccccttttttgagcaagtgggttgaattttttttaaggcttaagatttgtttttctcttttcccagcaacattttcttgaatttttttcggcccagcttttccaaaataaaacccttccaaaca

SEQ ID NO: 601922 - DNA, 483 bp, Homo sapiens
  misc_feature (25)..(25): n is a, c, g, or t
  misc_feature (34)..(34): n is a, c, g, or t
  misc_feature (64)..(64): n is a, c, g, or t
cccctccgtttggaccagataattnattaagtgncctacctgtgtgcccatcccactgttcctnggttactgggcccttgtccagtgaagaacagccaaaagatccccccacttacttagaggcaataacctaatagataactaagatgttagaaagtgtgataaaggctgggcatggtagctcacacctgtgatcccaagcactttgggaggctgaggcgggtggatcacttgaggtcaggagttcgagccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaagatcacaccactgcactccaccctggtgacagagcaagactgcctcaaaaagaaaaaaaagcgtgataaactctgtgaatatat

SEQ ID NO: 601923 - DNA, 208 bp, Homo sapiens
cggctatcacataatccaataggtttgatccaaaacatgaatagatcccactgcttattttaaggcatattaaaagggaactaattggaccatttctaattgtctattttattaccaaaagggtacctaattggtacactttattcagattaccattaattgagagtggttatgagttaattagtggtccacaacattacttcattct

SEQ ID NO: 601924 - DNA, 210 bp, Homo sapiens
gggagatctgtgcgaaactcaagagataagcacccagtagacgtagacaagcagtgctgagctcaagccgcaagaggttctggagcaaaggagctggcgttacagccaaagatgatattgtagacgagcaaaatggagatacctgagagaggttttctatgatcagcttttctattatggaggtgttagtggctgtatgacttaggccag

SEQ ID NO: 601925 - DNA, 223 bp, Homo sapiens
gatataatgtagctccagtaacctaaaagttttgggttcctcaaagccgatatttaaaacttggatgttaaaagcttgtcaacttatgtacctgtaagaattttgagcttgtttattgtaatattaacagaattaccatgcctttttcccccatttttaagaattcctgtatctatgtgtatggctatgggatgtaggccttgacatgtgacataaaaaaaaa

SEQ ID NO: 601926 - DNA, 506 bp, Homo sapiens
cgcattgctagctgacatgtctgctcgtcgtctctatcacagatcctcgcgctccttggttgcagacattcagttactgaagacgaaagtcactgtcaagacgataaggtcgccacaccctcattcgagtgcacgaggagtcatacttcgaggtctgacttgtaaaagcccatggtgtcagtaaaccgcatgaccagaaccaatccatatcttctagtttcttggcgagtataattgccactacatcacagttgcttctaagcatctttatagaaaggtggcaactgaagccatgaaattctcaggcaatcagcattttaaattactctttctaggctgggtgcggtggctcacatctgtaatctcagcactttgggaggccaaggcgggtggattatttgagaggtcaggagtttgaggctaacctggccaacgtgacgaaaccccgtctctactaaaaatacaaaaattagctgggcatggtggcgcatgcctataatcccagc

SEQ ID NO: 601927 - DNA, 348 bp, Homo sapiens
tctcccatggccggggctcctgtctactgcctcctaccccgcacttaaaaaaactctaatcgtaggctgggcgtggtcgttacgcctgtaatcctagtactttttgggacagaggcaggcaggttgcctgagctcaggagtttgagaccaggctgggcaacatggtgaaaccctgtctctactaaaaaaacaaaaaattagctgggcatggtggtggatgcctgtaaatcccagctactcaggaggctgaggcaggagaatcacttgaacctgggaggtggaggttgcagtgagacgtgatcatgccactgcactccagcctgggcgacacagtgagactctgactca

SEQ ID NO: 601928 - DNA, 822 bp, Homo sapiens
  misc_feature (289)..(289): n is a, c, g, or t
tcgcagccatccaaatcccatgtgggccgcttcaccgcgtccctattacccggcgctcacccccggccttgtcaaatggcctcctttacgggtattccctcttgtttccctcccagaaatttttcttttccccagagatttttttccaggcgccctgtaaccaaactgcgcgctgggtcgccctctcccgccccatttattgggggcgcctctgcgctccccaccaataggcgtctctccactcccgcgtttatctcccctcgatagtgtctccgcccctccggaaaanaccaacccgctatttttatctgcccctcagggttgcctcaaactccccgggcgccctccccaaatttgttaaagtagaacacctcacgggcgtaccacctagtatattctcggccgccgcgcgtgtaatcaccagcagtatatttcagtgggtgtgtcttattgttgtcccacctctcctaccaaccactcccgggtatcttcagtgctttctctccctttacaccactttgtcctcaggatgttcctctgcgccgttgcccttttgctcacaccctccgtccctcgccgttatacccctgattactgtggatccagccgtatccacccactttatcgtcgttctcccaccccactgaaccatgtacgaatcctcgtcaatcacccaccaccacctataggcgctgtctaaaactcccccccactgcactgaacgagccctattgtctgtcaagaagatgtcttgttgaagccgacttgttacttcgacccgcaccacatcttttcgtattaagcagtgctttacccaaagtc

SEQ ID NO: 601929 - DNA, 945 bp, Homo sapiens
gcctaaaagcgtacgtgcacgtgggcgtactcggcaccctaggaaatcctgtgtgctggagtcacatgctgggatctccccctctaataccataagcctgaagctgtccgatcgatgctgagcaactccagtatgtgtccctgtcggtcctatcctcgtgtgtcgatctacaaggcagtcaccgccgtaagctcgaagatctacatatttacggtccactgtaccgagagtaggcattccaagttgggtcaatctttgcattccatttctttgctatctaattacatcagggttttccaatacgtgttggccaaaaggtgactttcatttaaggatggtcaacctaagatcacaatcgggctccttgccccaaaaaatccctactagatgcacatttttaatcaccacgttaggaactacaaatccgggattctatacagaggacattaccattttagggatctggccatagcacactcttgacgctccatctccttgaccacctgtgggtgcgcatttcctggaaccagccaccaaagacttatcctttatcgttgtaaccctcaagaacaacacagaggctgtggttatctggcccatcagagactcgtatgagagttggtcatgtgctcaattgctctggacagttgttcctctcccccacagatacctttacggtggactactcttgcttataagttgtcaacctccaacaaaaggagaaccactgctcttcaaatattgtgggctcctcccctttaagtttcccttaactcctaatatttgctttatacgcatttaaatattaactaaagtcaggaccttattacgttactatagatgtgctgtatgtaatataggataagttattcagatctgtttccccacaagatataagaccttagggagagaccttttgtggatccactactcttgatatggccg

SEQ ID NO: 601930 - DNA, 175 bp, Homo sapiens
cacggcacatttgcagagtagccatgaaaatggacacattatcataatacttaaaaaagtaatgattgatgagaacaaaatatttaggactcatctggtctatatctactgacaatagcccttcaaagtttcttagttatacttggtaagggctatttcagtaggtatgagccga

SEQ ID NO: 601931 - DNA, 283 bp, Homo sapiens
cgtcgacccgtgactgacccaccgccaaaccggtcatgatgggggatgttgcaggcagcagaacgttctccacggtgtctccagacactatgtcacatgctcagtgtgaacctgctttcatctgtgaagagtacagggtgccagtggcaaatttgccaatcttagtgttctctggcaaatgccaaacgtcctccacagtgtttggctataagcacaacccccacctgtggacgtcgggccctcataccacgctcatggagtcgtcgacgcggccgcgaattta

SEQ ID NO: 601932 - DNA, 224 bp, Homo sapiens
  misc_feature (185)..(185): n is a, c, g, or t
ttgctatattatgcttcgtataatttttcatctttcccttgcggaactatatctattgcgccaggtttcaatatctatcgcctatactctatttagtggttaatcgttatggctaacggttgtctggttattacggaggatgaggggctctcagaagggtaccgagcatctcaattcgtaagcantacgtcattgcgtgtttccgtgttgttgaaaacccatgg

SEQ ID NO: 601933 - DNA, 268 bp, Homo sapiens
agtggctcctcactgtctcctctaagaggagtccaggttccttcatgtggtttttaatttttttttatttttgagacagggtctcactctgtcacccaggctggaatgcagtggtgctatcatagctcaatgcagttctgacctcccagaatcaagcaatcttcctgcctcagccttctcagtagctgggactagaggcttatgccaccatgcctggctaatgtttttttctctctctcctttttttttttttttttttttttttttt

SEQ ID NO: 601934 - DNA, 701 bp, Homo sapiens
gaccctgagcagactggggaaccagacacgagtgctgctggaggagcagtgctcggcacctgctgaactgagcagtgaacactgccaccatggcctactacctgtgatgagtaccgtggctgtgcagcgtctctgtgtgatgtgccctcgtcatggccctgttcaatgctgctcaacacccactgccaatgttctcactcctctctgagtgtgagagtgcaccatttccccgcaagacctagaactgcttctgaccacctggtgcttgagtgctgtgatgatttgatgtccagtggagaggctgctggacatgacccaccatgtgcaccctgtgtgtgctgtggtgacacctactccatggtctcctacagtgacacggtgttcatccacagtgcatgccacgtgcacctccaccacctgtcatgctctgtgccagtgaacactctggacctggagtgaaacttggcgagtgctgtccatgggcaatatcaactgccctcccagatgtgtcctgtggatgatgtcatgatccaccctccctgggtgtgtgtgctgcgtttgccctgcctacgtgccgtcgccacgagcgactctcgtgtgcctcaccggggcggatcgtcctccctaggcctgccccgggacgtgggcgggagacggacgtcgactcccgtctgcatgcctgctgctctcccctgttctcg

SEQ ID NO: 601935 - DNA, 478 bp, Homo sapiens
cctggggtctgccggagggccaagtcgtggcttacagaagagacgaaatgtggtctgagggacgatatgaatagtgaaagaattccgagcagaacgacgcacactccctcgaatgtcctcccagctgatgaactctggctctagtacgactggacaaagacgacgactcacttctgcaagcacggcaaccgtgaactacagggcacatgagcacgactggcattcagcaaccaacaacgtttctacctcttcccagttactgcgacacagacgcccggctctcccttactacaacacgcggcacaactaccttctcttctcacgacgaactcaacccctgctcgcgcccgacacacggacttctccaccaccacgcacgactctgggttccacgctgtccacgctaccgcacgacagcttacctcctccacgaccaaggacgcaaactcactacctcttttcccatcagctctcaacc

SEQ ID NO: 601936 - DNA, 138 bp, Homo sapiens
tgttagtttcgggacgtaattttggctgagtctttcgctatcttcacgccaactggcgcctccttattctttatctgccgtcttcctaacacgttcgggtcgagtgcctagattatcggctcattgtctctactctga

SEQ ID NO: 601937 - DNA, 174 bp, Homo sapiens
tgagcctgtcccccagtgaaaacggcactactgctgttacttgcaagagctctgccactacgaggtgcagtgattgcctcatctgtatgacctgccttcttgtgaagtaacagcggtagtgtgccgttttcctgggctgtgatgtttgtgtattaccacggcctccccctctgt

SEQ ID NO: 601938 - DNA, 83 bp, Homo sapiens
gtgtcaggagagatcaagagctagcaaatatttctagcataatcacacatttaactccagactcagccttgtagtataattcc

SEQ ID NO: 601939 - DNA, 508 bp, Homo sapiens
ctcctcctgcagttatctcgtctggaagaagtctgtggtagccaatatcagcccagaattagtgattccatcatatctgttagcttacacatatgcatctgccactctcctcccaagacagctccctcctcaaactactgctcactgtaagtccggcgtccagatacccccccttactggtgcagtcctgattctaagcccttcctcgtcctgtataactcagctcacagggccctgtactagcactatagaccattactcactactagatatccagtttatgaccatagcctcagtgggtccccagctgagtacctgcagccttcactatctgtccaacgtcttctcacctctagcctctctgtaccggtgcccactcccatccccaggacgcgatgccaccgcgggttacctgtcactggtgcagtagcagggcatagccttgaccgaacagctgaaacaagaagcgcagctgtcctagacgtggaatctcctctaagctccgttg

SEQ ID NO: 601940 - DNA, 303 bp, Homo sapiens
ctatgcccctattaaacgacaaaccgccctttttagcatgatcaccccagcgaacccggtccctgctgtctgtgtctagtggatctgcctcttctgggtatttcataacaagcggaatcaaaacacgtggcctctgtgacagggctcattctttccgcagtggtgcatgtcaggacagtgtcctgcatagttagcgggtatcaagcacttcactcccagtggccagactcaggtgctggtagtgtgagatggactgaagtgctggtgtgtgggtggataaggtgctggtgtgtgggtggatga

SEQ ID NO: 601941 - DNA, 161 bp, Homo sapiens
acatcaacccactaaaaatattaaacaaaactaacactaactccctcaacacaagccacataaaaatcaacaattataacaaacactgagaaccaaaatgaacgaaaatctgtgcgcttccttcattgaccccacaatcctaggcctacccgccgcagtca

SEQ ID NO: 601942 - DNA, 312 bp, Homo sapiens
  misc_feature (83)..(83): n is a, c, g, or t
accaaatgcaatatgagatttgacagctgaagagctcatgaatgcctagtacagattggcatggttccaaattattatgaganagctttggtcatccaatgcctgtgtctaccaaagtcaggtacgttcctgagggttggggatgatgtcaattttcagctctttaccactgtccaacttcgaaaggtctgtcaggctctcatagcgaatcttgtccaaggcatcagaagcattggagatcaactcccgaaggaaaatctccttgttggaatagaaggtattgatgatgagggacatgtgttggggataaca

SEQ ID NO: 601943 - DNA, 801 bp, Homo sapiens
catgtggggcttaatacctaggtgatgggttgataggtgcagtaaaccaccatggcactgtttacctatgtaacaaatctgcgcatcccacacatgcatcccggaacttaaaataaaataatgctttttaaagaaaaagggcaaaagatatgaatagacacttctctaaagaagacatacaagtagccaacaaacatatgaaaaaatgctccacatcattaatcatcagcgaaatggaaatcaaaaccacagtgagataccatctcacctaagtcagaatggctgctatgaaaaagttaaaaaaaataacagatgctagtgaggctgtgaagaaaaaggaacacttatccactgtggtgggagtgaaaattagttcaagccactgtggaaagcaacttggagatttcttaaagaagttaaaacaaaactaccattcaatcaagcagtcccattactggggatatatacaaaagaaaacaaattgttctaccaaaaagacaattcacttgatgttcatcacagcactactcacagtaacagagacttggagatcaagttagatgctattcaatggaggcttggatcaaagaaaatgtgggtccatatgtaccatggaatacctatgtaggcataaaaaaaagaactaataggcgcggggcagggcaatgcctgtaatcccagccttgggaggtggcggggggggcccagggggggggggccccccccacagggggaccggtttttaaataaaaaacggggggggcccgtcccaccgagagggaaccgacggggggcgagccg

SEQ ID NO: 601944 - DNA, 113 bp, Homo sapiens
  misc_feature (39)..(39): n is a, c, g, or t
tctagaggatccattggagaatgtgcatagatactgcantggtttctcagcagaagaagaagaagaagaggaggacatcagtgaagagtcacctactgagcacatcttccaat

SEQ ID NO: 601945 - DNA, 139 bp, Homo sapiens
tgcaaagaaatataacccatgtccatcaaaaaataattaattaattaaaaacactgtagtcgatgagaagaatggtgccaaagtcccaggctcctgaccgtggatcacgactctcttgacctcgtgatcgtgcccgcct

SEQ ID NO: 601946 - DNA, 193 bp, Homo sapiens
  misc_feature (192)..(193): n is a, c, g, or t
aatcgagccggaccccgaatccttttctctgtcgaatatgcttgggctagggagcgccgaaggatactatggatagtgggatagtcgtagagaaaacgcgccctgcttctttcaattggaatttgatgtaatgggtggtagtcgaccgcggctatcaacatttaacatttagcgcgcgagtgagtaggggann

SEQ ID NO: 601947 - DNA, 188 bp, Homo sapiens
ccatgagttacatgaagaacggagctgagcctggacatcaacaattactggggagaactgggccgagttgtgcatattatcccagccagggagcctctttacgtgattcaacccagaagaattgagattgattttgaaacactctagccattcacacttaaagaagcttgagcgctatgtcctttcct

SEQ ID NO: 601948 - DNA, 380 bp, Homo sapiens
cagcaatccccttcagaatatgtctaaaagaattgaaaccaagacctccaagagagctcacaccctcgttcatagcagcattattcacaatagccccgaggttgcaagcaccccaaatccccatcacccactgaatgcctacacaaaatgtggtctatatatacaaccgaatattcagccacaaaaagaagggaattctcatacaccctactacatggatgaatctcaaaggcattaatgctagctaagtgcaataagccagtcacaaaaagcaaaaattatgtgattccatttatatgaggcatccagagtagacaaattcacagaaacagaaagtagacacatatacctataatctcaccacttaaggaggctgagtc

SEQ ID NO: 601949 - DNA, 189 bp, Homo sapiens
ctctccaactcagttcttcagaattggcttttttattatggtagaaataagtcactccagcccgcactcaagaggagggaagatgggctctacgtagggacggaggtgtcagagaattggtgaacatattctaaatctctacaatacactcttcagccacagattatttacattcatcccacgtgcaga

SEQ ID NO: 601950 - DNA, 304 bp, Homo sapiens
  misc_feature (48)..(48): n is a, c, g, or t
  misc_feature (87)..(87): n is a, c, g, or t
  misc_feature (143)..(143): n is a, c, g, or t
agaaggaaagaactgcatccagattggctataggtacagttacttccnacagaaatgcgtctttcctatggcttcttaaaactaagnaaaatattcagttatgagaaaagaaaagaacttttatctgaggaacacaagtcctnttaattattgggcccagagaggtattaaaaaacaggcagcaattgttgcagaattttgctccttagttcagttgtaagtgggttcttttcacacaaccaggaaatttaggcacgcagacacattaaagggtgagtagagcaggattttattgggtgaaaag

SEQ ID NO: 601951 - DNA, 344 bp, Homo sapiens
tcggtttacctgacggaaacagactttaagactaggtatgggctgaacgcggtggctcacacctgtaatcccagcacgttgggagggttgacgcaggcggatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtagactctgtctc

SEQ ID NO: 601952 - DNA, 135 bp, Homo sapiens
tctcatggacactgtgactacatagttttaatgcaaagtcacaagtgagccgtaaagtcacttacaggctcactttacaatctcatctgtaaaaaaagcaccgatatcttacacgatgttgggtaccggagctcg

SEQ ID NO: 601953 - DNA, 927 bp, Homo sapiens
taagggaatgaagggatttattgaaaatgaaagtacactccacagggtgggggtgagcctgagcataggagcacaaaagcccgtgtttacagaacttcagaagagtttaaataccctctagggtgattccatgtggttactgtggggcacacgtttatgtagcatggagagccgtgttacagaaacttcgtgagaagtttaagacacccttctagggtgatctccatgtgggttacttgtggggcacacgtttatgcaagatggaagaggatgaagtttacaagagtcattgtgctgtgggcctagtgttcctagtgggaaaagggtatttcgctatcaataactgaaggtggtgaatctagcctagttttcccgtggcactcagaacccatattttccgtggcctccataccttacaggctggtggtggatccgttagacgtggtcaccgtctttgcccttgtggaagcctacagggttccatacatgcgggtacaaagtggagggccgcacattagctcaacgtgcgtgaacattgtgctgggagactccggaacaaacctcaaggtgtgctactaacatgtttggtaccgtggtgtttctgggcgccctcgtgtaaggccctctgcaggggcatggccccagggtgtgaacacctacttcacattattctgtgggagacactggtaccatggggtttgcagccaaagcgcttaaaagtgggttccgtggtttcagcccttgcctgtggaagcattcaggcgtggaacccttagggctagggaaaagggttcggagaaggggaccctaaacgcccaatgttgcccgaacctgaggacacaattccacgagaaaaagcataccttggtaaacttctgggccacgtattgtggacccagaatcctagattgaaaagctctaggatca

SEQ ID NO: 601954 - DNA, 484 bp, Homo sapiens
ttgattgtacatttgcctctgtgtcccgcttgtccgggtcctagtggcgagtctcggggcccgtgcggagggtgcctcgctttctccgttcgttgcgtgacgttcgtctgccaggctatgtcgcacctcggcgcagggacacacgtggatttgtttcgtggttgaaggcgacgctatgatgtggtgccctcatcttgttcgcttgttatgtgcttgtcaaaagctgtatctttcccttctccacgatgctacacactgctaggtttctacttatgatgtagtacctttatgtcgaacatgtttccaggctggctgatctgtctgtcgggggtggggccagggcccccctagccgcgaaggccccggccgttcatcatcttgtccctcgtcccccataccacactccccctcctagacccccgcccctttaaacaaccatctggaaattaataaaattcaaaatgggtgtttaacttaaactcca

SEQ ID NO: 601955 - DNA, 877 bp, Homo sapiens
  misc_feature (23)..(23): n is a, c, g, or t
  misc_feature (30)..(30): n is a, c, g, or t
  misc_feature (38)..(38): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (67)..(67): n is a, c, g, or t
  misc_feature (79)..(79): n is a, c, g, or t
  misc_feature (81)..(81): n is a, c, g, or t
  misc_feature (87)..(87): n is a, c, g, or t
  misc_feature (102)..(102): n is a, c, g, or t
  misc_feature (134)..(134): n is a, c, g, or t
  misc_feature (150)..(151): n is a, c, g, or t
  misc_feature (153)..(153): n is a, c, g, or t
  misc_feature (508)..(508): n is a, c, g, or t
  misc_feature (553)..(553): n is a, c, g, or t
  misc_feature (576)..(576): n is a, c, g, or t
  misc_feature (663)..(663): n is a, c, g, or t
ttaaacccccaacagctgggccngggggancactaccntcaanacncananactggtagtggccccnaatggctgggcncnctgatntttattgcatacaanacaagggggggcagggtaaggagggtgaatcntctaagtgattgacanngngaagcaagtcacatgatcataggacagggggcccttccctcttaggtagccgaagcagagagagaaggcagcaaacgtcagcgttttcttgtatgcacttacaagaaagatcaaagactttaagactttcactatttcttctaccgctatctactacaaacttcaaagaggaaccaggagtacgggaggagcatgaaagtggacaaggagcgtgaccattgaagcacagcaccacagggaggggtttaggcctccggatgactgcgggcaggcctggataatatccagccttccacaagaagctggtggagcagagtgttccctgactcctccaaggaaaggagactccctttcncggtctgctaagtaacgggtgccttcccagacactggcgttaccncttgaccaaggagccctcaagcngcccttatgcgggcgtgacagaaggctcacctcttgccttctaggtcacttctcacaatgtcccttcagcacctgaccctatacccnccggttattcctaggttatattagtaatgcaacaaagagtaatattaaaagctaatgattaataatgtttataataatgattgataattgtccatgatcatctctatatctgatgtgtattatgactattctgattctaactattttctttattatactgaaacagtttgtgccttcagtctcttgcctcggcacctaggtaatcctccaccaa

SEQ ID NO: 601956 - DNA, 804 bp, Homo sapiens
gcaccgctgtcgtcggccagaagccaaggagtcctcagtgacggtgggatccacaacatctccacagtcgctgtccccacccagccaggcagcgccagcactagctcagacgcaaggacggaaccgctggactccagtgttccttgcctgggagtagtgagaaatccacctgctggtggtgctgagtgtggcctgagtggatatgtgccctgggtcccgggatgcccctgccctgagcccatgctgagcagtgagggtgagagtgtgaatgtgccagccatggagccatcccccaagccaggcacagaagtcatccctggcagcccccagtgaatgcccagaaatgttctccaaactggtcctgctcacagcctccaaagacatgcaccaagtgtggctggggtgccaagcgcaaggtgtgtgcactgtgtcatgtccctgtgggtgtgccctggcccctgccacccttgccaatggccctcctccagacccaccccgaggcccatgctgggccattgaggcagcccctcagtgagcctgagcagaaacggagcagtgcagtgacccagtgcacagacagaacagaaagacagtggattagcagcggggcctcctgaggctgctggggagaactttgccccctgctcttgtggcgcccggcatgtccctgtaaccttgacaacagcgcattctcccaggcaccaaccaggcttaggctcttctctgccgcaggcttctggggccatgggtgatcttggctttacttgttgttccttcttttttagacagttatctttggcggaa

SEQ ID NO: 601957 - DNA, 452 bp, Homo sapiens
attcacaatagcaaagatacagaatcaacctaagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaagatgggaagagggagaggagcagaaaaagtacctattggtgatgaagtactctgtacaacaaacccgtgacaagagtttccctatataacaaaccttcacatatacccctgaacctaaaagtttttttaattgtaaataaatggatcattaaaaaaaattttattaata

SEQ ID NO: 601958 - DNA, 188 bp, Homo sapiens
tttttttttatttgaatctcctccagacttgttagagtaactggacaaggggtcaatgcctacttcttgttcttctggctgcagaggatgtctagtttcagataaggaatgatacattgtgggaactggacagcgtcaccaaaagtaactacctgtggcgcagaagggctccccagctcctgtcgacg

SEQ ID NO: 601959 - DNA, 1279 bp, Homo sapiens
tgtggtagtggacacctgtgataccagctacatgggaggctgaggcaggagaattgcttgaacccgggaggtagaggttgaagtgagctgagatcacaccatggcactccagcctggacaacagagcgagactccatctcgcctgtaatccacactttgggaagcaaggtaggcagatcacctgaagtagggagttcaagaccagcagggccaacatggtgaaaccctgtctctactaaaaagataaaaaaattagccaggtgtggtggtgcatgtctgtaattccagctactcaggaggccattgcactccagcctgcgggacaagagcaagacttcgtctcaaaaaaataaataaataaataatggctgcgcgcagtggctcacacccataatcctaacactctaggaagccaaggtgggcggatcagctgaggtcaggagttcgagaccagcctgggcaatatggccctgttggactaaggcagtcctttcacttccactcaatcccaccaggggtgaggcaaaacctggcctctactaaaaatattacaaatagcagggcaatggtgcattgtgccttgaatccaagttattggaaggctgaggaagggaatcgcctgaaccaatggagattgcctgaacccggaaggcaaagatgcaatcggcccaaattgcccatccactccaatctggtgaccagagccaactttttctaaaacaaacattcatatccacatcaccttgtggacgctctgcccatcgtcttaaactcggccagcttaccagcgtccgtatctggcctaattggcacaattccctaatgggggcgatattcaatggcgccgttataacagtcggccgcgcctcggggtcccacttacctccttgctcatcccctttctcctcgcggtatatcactcggcccaccgtctgctttctatataatgccctcctcatcgctccgatatatctctcttattttcttcacaccccgcaacttctctacatcgttctttttcacccagccgctagacccactcctctctgcacacaccacacctagcggccgttcttcccactctctcctcctttcttacactgctgccccgccttcgtctgctactacgattgctcccttctacacctctcctccaccgcttctacctctctccacactacgttctgtcagactctacctttccgctacatctactcatatacctattatctctacactctagtactgttctcctaccatactctccgctgccgtctcc

SEQ ID NO: 601960 - DNA, 1006 bp, Homo sapiens
tctgttttttttgaccctcttgtttcccttactttgggctccttgagggtcgtgtgcttatttctccatgctggtggtaacgcacctggtaagactgctccctgtatacccaagatggtgcgtcccatcggttctggcctgttcgtccggtttgctctcccttatcgtttcttacccccactggttcactcttggccccagttgccgtctccagcaagccctttggacctcctggataccagcgtgcctggcggcgctcgtggcccgccgcccgggtttctagattttcagggagtgcaagcaactgctcagccacagacgacgtcaagccagtcgctccggctgcatccacatcaggtggacggccatacccatgttcagcctgtggcaaagctttctgtcagagtacccacttgaaagaccacaggtcgcctgcacagcatctgagcggccctttgcctgtgaagtgtatgtcaaggccttttgccaatctccatgcgcctggcagaacatcgccgcatcccacacaggcgaacgaccctgacttcctgccctgactgtggcaagagcataccgctccggtcatccaacccatctggaagcaccgcaagacccatcagcagcaagcatcaggcagctgtgcaggcaagccagctggcagaggcggaggcacggaccggtggcctaggccgtcatagggaagacatgcgtgtgggaggcgctacccccctggtggtaagtccattgagatcataccctctggccgaggctgacgggggtccagatcagctggtctgacttctgcccgacttcctctttggcactctccattccctgttgactgaaggccctgccagcatccccttaagcatctgtacatactgtgtcccttcctcttcccatcctcaccaccttgtaagtttctaaattggatttaattctctcgtgaggggggtgctctggggtcctgacacacataaaggtgtaacccccaccgttccacctc

SEQ ID NO: 601961 - DNA, 930 bp, Homo sapiens
  misc_feature (266)..(266): n is a, c, g, or t
  misc_feature (284)..(284): n is a, c, g, or t
  misc_feature (290)..(290): n is a, c, g, or t
  misc_feature (298)..(298): n is a, c, g, or t
aaacccttgctttttaaaggttatttttactatttctttatccctttattggatcatcccccttgggttcataatgtaaatactatatgttggaccaatttaatgtccaaattttttttttccatagtccctgttaatagtggggctttcaggggtttaaagattttttttgttggtgttaaccttccttgccaaagtactagatgggggataactctaaagttgaattttaagggattccctaatatgtatactatctttttatntgaagtaataaataaacnatgatnttgaaagngcctgaaaaaaaaagaaaaaaaaaagagaaagaaaaaaaaaagaaaaaaaaaaaaaaaaaaaaaaaagaaaaaaaaaaagaaaaaagaaaaaaaaagaaaaaaaaaaaaaaggagcggggggcgggcaacatcctacaagcaggaggggcgagccactgatcaggacagccgactgttattagtaagaaaggaggggccacacacaatagggaggagataataaaaaaaagcagcgaggggccgagcacatcaaaacacaacgctagcagaacgaagagagaagcaacaagcagcggacaatcacgtacgaagaaaccacaccaccacaaggaggggcgaggaacagacaacaaagggagggcaagaacacaaccagacgaagaagaaggcaggaaaaacgaagcgcaccagaagagacagataacactacacagacaaggagcgactgagaatgagcgcgagagaccacacacacacagaactactcattcaatgtacgaagagagacgaaagagaaataactaacactgaagcgacacgagagtgagttactaagaaaagagaacgaactaacatcaacacgacgaggcggcggaataacacatacacaaccaagcacgagagagcgaac

SEQ ID NO: 601962 - DNA, 139 bp, Homo sapiens
aagactttgctcttttgggtctttgctcttttggggactatgctcttttggggtctttgctcttttggggtatatgctcttttggggtctatgcccttttggggtcttatgctattattgaagactatgctctattggg

SEQ ID NO: 601963 - DNA, 152 bp, Homo sapiens
ggatctcgacgagtgtgctagatgaaaaagctctggagatctgttacataataaagtacatttaacactactgaactgcacatttaaaaatgattaaggccaggtgcggtggctcacacctgtaatcccagtactttgggaggccgaggcag

SEQ ID NO: 601964 - DNA, 253 bp, Homo sapiens
attatggaacaaaggcaacttgatagaggctgaaagtttagtagttgcattacgcaggatgcagcagggcaactgggattggggcgtgacagttcctggttggaggaatggtgtgggtgggtccaaactccgccaaatttgctggtggtgacggttgcctaagcctttgtgtagctaaagaacactggaaacactaaactggcgaaatgtgtggtttgtgaactttaactcaatagagctgtttgatataata

SEQ ID NO: 601965 - DNA, 230 bp, Homo sapiens
tgcagtgtagctggaattctgtgctttgaggcagacactgagagcagccagtgtcaacatggctgaaacccagtctctacagaaaataaagtagtgttggcattgtggcacactgcctagttgtcccatgctgcttgcagaggctgagtgtgggagggttcacttgcagctccagtgaggcttgagtgcttgcagtgagcctgatatcacaccacctgcactccagcctc

SEQ ID NO: 601966 - DNA, 643 bp, Homo sapiens
  misc_feature (193)..(196): n is a, c, g, or t
  misc_feature (199)..(199): n is a, c, g, or t
  misc_feature (203)..(203): n is a, c, g, or t
  misc_feature (213)..(213): n is a, c, g, or t
  misc_feature (284)..(284): n is a, c, g, or t
  misc_feature (293)..(293): n is a, c, g, or t
gtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacnnnntanctcnttccgaaagncaacatctgaatgttaagtccattttccccatggaagaagcccgtagttccatgaagtatggattaccatntgtattttncactaacagtaaaagtatttttcttattaattgcttgccttacgattgatgaattacattttttgttcctttcttaccataaacattttgctttactaagtcagccttccttggatggtcgtttcttaataaatggttgagctgctgatgccagttttgccaagctacaagacacaatatcttaaaaaggaagccggcgccgtttggcatccgagaggacacttttgcaggacactgggccaagacaggaaatattcaacttttatgctgattaaaggagttttggaaagaatacaaaggattcctaatgggggaacaaaatccatttatgatttagatggtctttcggg

SEQ ID NO: 601967 - DNA, 1021 bp, Homo sapiens
  misc_feature (520)..(520): n is a, c, g, or t
ttttttttttaaattaaaaaaatatttagacaggggtctcactctgtttgatcattctggttttaaactccgtggcttcaagtgatcctcccatctcagcctcccaaagtgctgggattacaggcatgagccattgcacccggccacaattatttatattatatttatactttattttatatttatttttgtgagagggggctcttgctcgtgttcgccaagcgtggagttacaggtgtgcctcaactctcagctcacgtgcaaccttacactttgccaggttcaagagattcttccgtgccttcagccttcccgagttagcttgggacttacagttgtgcgcaccgccaaggcccagcttaattttgtggtattttttacttagagattggggttttcacccatgtttgtgccaggaagtggtcctcaatcttgtgtgacctgcggtgaatctgccgtgttctgcggcctcccgaaagtttctgggcattaccgaggcttgtaaccacttgttacccgngtcgttattaagctatttaaaaatctcagacagttaagcatttaatctaaatccctgctgcctgggaatgatgtctgactgacttcttgtgaatacattatgctaattttataccatttttaggatttctaaacaataacagctattttaatatatcttggataacgtggtatttggacactaagtctaaaaagcgcgggaagcctttggggacaaaagttgccctgaattttaggttcccagcgcatatggctcaagtttctttaacctttgtgcttttttttaatcatttttctcaatcaggggagaagaggttctcacaggtttctccggaaccccaaagtttccactgggttctgcatatttcccaatcccacattttggtgtcgcgtgtgccccttaaaccctgtttttctttgggatttcgcactagtgttttcacaaaatcggtgccgaaatttctcaaaaaacagtttgggggtccataaagagagttatgaa

SEQ ID NO: 601968 - DNA, 317 bp, Homo sapiens
aaagggttaaaagctgttcttatgcataccccagtaggaccattctgccagaaaaaatgattaatggccatttcccatataaagttcattgattattggtcataaaaacagaatttagttttccttgcatagttgggcatagagaatttaataaagtgttttaattatttacagtaagctgttcagctctttaatgacaatttttatgtatatggcatatgttttgagactgttaagatgaatcttccttcatttaaacaacagtgttttttacttgaccgttttaaagtcataaatgtcttgctttttaaacttaa

SEQ ID NO: 601969 - DNA, 1135 bp, Homo sapiens
  misc_feature (529)..(529): n is a, c, g, or t
aatctaggctcactgcaacctctgcctcccaggttcaagcaagttctcatgcctcagcctcccaggtagctgggattacaggcacccgccaccacacctggctaatttttttttttctcttttttttttgtggtaaaaacagagttttccccatgtgtgtggccagggtgtggtttttggaaacctcctgtggccctcaaaaaggtgactcgtgcgggctctcagccttcccaagaggtgcggggatttacggggtgtgagccacaggtgtcgggccgtctcgtgagcagtgtttgcatatttcaattattttagaatttggagacattattaagtcagggactcattaaggaactaaattggagagtggtccgtggtgaattgcaatagagtgtaactctcttttaaacattttaagactgctatactctcaaaaatataatctccaggaaccaatttgtacttagtgaccttataaatttaattcattaagagacagaggggatgtattacctcgtgtgagagaccnttgtgtggtcacaaaagggcccgtgtaaggcgtggttgtttaccaacattaggcgccagagaaaccctttttcgctcccgtgtggctaaaataactctataggagaagctcggcttaaggcgtttaaacacagaacaacaattttatctcccttttatcggggcaaaataccgggggtgccccacaaatatatgtgtgagagaactctagaagacatttgtggtggttcggcctaaaattgtagaaaggggaagaaattcatttgggagagaagaactactaatttctgggacctggggaaacatatttccgggggggaggttattaccaagtgtgcgacccaaattttacctttttgggaaatgcggggaccatggggggagctcctccacaaggcgtgcacctccgttgtggtgttccccttctccccgtataattttttccgccggggacgggtgaaagataactgcggcacgtaatgggcgaggacccagtgtgcgcgcttatttcaaaaacgggcttgagggaaaaaaacaacaaacccaggcaccggggcttccgagtatacccaaagaagtgcatttaagggaccccacccaaaccatt

SEQ ID NO: 601970 - DNA, 842 bp, Homo sapiens
aaggctaggtagaggccgggtgttggaggactcgtgcctgctggagctgcaggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgccagccgcagccggcgcaacgcagagccccgacacgagcaggtcagcgatagcacaggtgcccatcaagcaccaccaggggcagcggccatccatcatcacggaatcccaaacaaacagaagcaagaagacacaggcccgacaaacagacacaaggaatcaacgaacatccagaagacaacgcaagacatacaggggaagcaaactaccaaaagagcaagacggaaaaaggcaagcaaaagaaaaacatacaagcagatacagagactctgcacatgaagacataagcactacgtaaccagaacaaaacacaagacaagacacatacacagaacaaacgaagacaagagatagcacggaccacgcaacgaaagaggcgcacaagtgcacaaacgagaaaaaacagaacacctgccagagccatggacatgacaaaaactgagaaacaacaggaaaaggcaaaacgggacagaaacaagaaacaaaaacagaaacacaaacagga

SEQ ID NO: 601971 - DNA, 347 bp, Homo sapiens
agtgcagtaaagaatttttaaatttctctcttgatttcatagtgacttaatgatcattcaggagcaggctgtttgtttccatggtattgcatggttatgagggttctggatggaattggagaccactattcaaagtgaagtaacttgggaatgaaaaaccatacatcatatattctcactcataagtgggagctaagctatgggtatgtacaggcatcagaatgatacaatggacttaggggactcgggagaaagggagggcaaggagtgagggataaaaaaattacaaactagatacagtgtacaccgctcgtagcgacagaaggcagggtaccgcgctcgaatac

SEQ ID NO: 601972 - DNA, 369 bp, Homo sapiens
  misc_feature (33)..(33): n is a, c, g, or t
  misc_feature (63)..(63): n is a, c, g, or t
  misc_feature (70)..(70): n is a, c, g, or t
  misc_feature (77)..(77): n is a, c, g, or t
  misc_feature (95)..(95): n is a, c, g, or t
  misc_feature (107)..(107): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (133)..(133): n is a, c, g, or t
  misc_feature (151)..(151): n is a, c, g, or t
  misc_feature (159)..(159): n is a, c, g, or t
  misc_feature (179)..(179): n is a, c, g, or t
  misc_feature (219)..(220): n is a, c, g, or t
  misc_feature (226)..(227): n is a, c, g, or t
  misc_feature (229)..(229): n is a, c, g, or t
  misc_feature (236)..(236): n is a, c, g, or t
  misc_feature (243)..(243): n is a, c, g, or t
  misc_feature (247)..(247): n is a, c, g, or t
  misc_feature (263)..(263): n is a, c, g, or t
  misc_feature (265)..(265): n is a, c, g, or t
  misc_feature (290)..(291): n is a, c, g, or t
  misc_feature (299)..(300): n is a, c, g, or t
  misc_feature (344)..(344): n is a, c, g, or t
gaatctagtcatagtctttgtgtctcaaatcangtagtccaatatttgaagacaaaatcagtncctttcncagggtnggtccagttttgcgggtncgccttctccanccccctcanccnctgcngctccgggnggatcaggcacatccggngaggagcngacacgcggcagggtcgggncggggcgctccatttgaccaccgtgagagggttcgggcanncagaanntntagtatnatttgcncggngcatgtatcccaaatnantgcccttctcatcaaataagttatnnctcgctgnntaatttttcttccaacgttacttaaagctgtgttattctttttngtcttttttccttcattctgggtgt

SEQ ID NO: 601973 - DNA, 182 bp, Homo sapiens
gtagcagctctgtcacatgctaacttattacgcatgatcgctctactattttttaagccaaatcaacaacaatcctatttagctgttccccaagcttttcctccgaccccctaacaaccccccacgctgctactgcagacagccggacccccactctattcaatgtcacaagaaatgacaca

SEQ ID NO: 601974 - DNA, 162 bp, Homo sapiens
tgtttgggcgatattaaaaatggcaaaatttttgcctatttagtatcttcaaattgtagtttttgtaacaaccaaataaccttttgtggtccctgtaaaattaatatttggtagacaaaatccatgtccctttgctaaggttagaatgaataattttttgta

SEQ ID NO: 601975 - DNA, 142 bp, Homo sapiens
gctggaattcaagcttctaacgatgtacggggacatgagtttctagtcccacctacttgggaggatgaggtgggaggattgctttagcccaggaggtcgaggcttctgtgagctgtgattgtgccactgtctcaacgaaaaa

SEQ ID NO: 601976 - DNA, 815 bp, Homo sapiens
  misc_feature (50)..(50): n is a, c, g, or t
  misc_feature (69)..(69): n is a, c, g, or t
  misc_feature (80)..(81): n is a, c, g, or t
  misc_feature (98)..(98): n is a, c, g, or t
  misc_feature (160)..(160): n is a, c, g, or t
  misc_feature (173)..(173): n is a, c, g, or t
  misc_feature (182)..(182): n is a, c, g, or t
  misc_feature (185)..(186): n is a, c, g, or t
  misc_feature (193)..(193): n is a, c, g, or t
  misc_feature (198)..(199): n is a, c, g, or t
  misc_feature (202)..(202): n is a, c, g, or t
  misc_feature (214)..(214): n is a, c, g, or t
  misc_feature (224)..(224): n is a, c, g, or t
  misc_feature (236)..(236): n is a, c, g, or t
  misc_feature (244)..(245): n is a, c, g, or t
  misc_feature (256)..(256): n is a, c, g, or t
  misc_feature (263)..(263): n is a, c, g, or t
  misc_feature (270)..(271): n is a, c, g, or t
  misc_feature (301)..(301): n is a, c, g, or t
  misc_feature (355)..(355): n is a, c, g, or t
  misc_feature (371)..(371): n is a, c, g, or t
  misc_feature (382)..(382): n is a, c, g, or t
  misc_feature (386)..(386): n is a, c, g, or t
  misc_feature (443)..(443): n is a, c, g, or t
  misc_feature (459)..(460): n is a, c, g, or t
  misc_feature (468)..(468): n is a, c, g, or t
  misc_feature (540)..(540): n is a, c, g, or t
  misc_feature (542)..(542): n is a, c, g, or t
  misc_feature (801)..(801): n is a, c, g, or t
ttaccttccttgaaagtgagagagctattcagcataggaaaatatcagtntcaaaaacacagcttaggngtaaaaggggnntttacacagtatttaanaaaaatgatctacaaaatgacaaagtaagtgttgaaatctgatttcatataaattataaaanctgggtacttagngtaaatgtnatnnggttggnaaatnngtncaatcataagcnttccttaggncaattctttaanatattaanngcatacgaaanattttcnataaatnncttttaagagtgtttcttagaagtgctgcngggaacatcattcgcatagcaaggtggcagtgttctggggacaacatgcaatcnttctgttcctaatggnagcctcatganagtnaggagactataatcatttgctcaaggatccagaagttttaagacaattctataaganagcgttaaagtgctgnncaaaatgncttaatttcagtaccccctgtcatgtaaaacttactcaaatactcagacatttctgagccacatccaatacngnaactatcattctgaaaagtgttaatatacttaatctttcattccacgataggagggttcctttttacactttacaaggattggtttaacatcaagaatcttgcaatgcaaaatataattataataatacagttgaaacaatacacatacgccactgggaaagcacaagttcttttctgcaatggtaaaggtatcaatttttaaaatcacaaatcaaacactgggtaataagaaaaatttccaaatgctgcatgccacanaactagttaaaaaa

SEQ ID NO: 601977 - DNA, 775 bp, Homo sapiens
  misc_feature (3)..(3): n is a, c, g, or t
  misc_feature (72)..(72): n is a, c, g, or t
  misc_feature (82)..(82): n is a, c, g, or t
  misc_feature (143)..(143): n is a, c, g, or t
  misc_feature (150)..(150): n is a, c, g, or t
  misc_feature (196)..(196): n is a, c, g, or t
  misc_feature (343)..(343): n is a, c, g, or t
  misc_feature (355)..(355): n is a, c, g, or t
  misc_feature (377)..(377): n is a, c, g, or t
  misc_feature (381)..(381): n is a, c, g, or t
  misc_feature (388)..(388): n is a, c, g, or t
  misc_feature (390)..(391): n is a, c, g, or t
  misc_feature (555)..(555): n is a, c, g, or t
  misc_feature (584)..(584): n is a, c, g, or t
  misc_feature (597)..(597): n is a, c, g, or t
ggngccgggagcagaagaggcccagaaggaacgccagcggcagaaagagcaggagagcaataaccgccgggngtggggctcnccaggtggggagggcacaggggacctggacgaattggacttctgagaccaacactacactngaccctncacggaaaccagactctacctggactggcttgccccccccccaccnccccaccctggaacccctgagggccaaacagcagagtggagctgagctgtggacctctcgggcaactctgtgggtgtgggggccctgggtgaaggctgctgcccctgctggcagccaccttgagacctcaccgggcctgtgatattngctctcctgaantctcactcaatcctctgcctcncctntgtggcntnncctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgtttnaccctcttctattgaattgccttgggatntccttctcccttnccctggcccaccctgtcccctacaatttgtgcttctgagttgaggagccttcacctctgttgctgaggaaatggtagaatgctgcctatcacctccagcacaatcccagcgaaaaaggtgtgaagcacccaccatgttcttgaacaatcaggtttttaaataaacaactggaccatca

SEQ ID NO: 601978 - DNA, 754 bp, Homo sapiens
  misc_feature (3)..(3): n is a, c, g, or t
  misc_feature (72)..(72): n is a, c, g, or t
  misc_feature (82)..(82): n is a, c, g, or t
  misc_feature (143)..(143): n is a, c, g, or t
  misc_feature (150)..(150): n is a, c, g, or t
  misc_feature (196)..(196): n is a, c, g, or t
  misc_feature (343)..(343): n is a, c, g, or t
  misc_feature (355)..(355): n is a, c, g, or t
  misc_feature (377)..(377): n is a, c, g, or t
  misc_feature (381)..(381): n is a, c, g, or t
  misc_feature (388)..(388): n is a, c, g, or t
  misc_feature (390)..(391): n is a, c, g, or t
  misc_feature (555)..(555): n is a, c, g, or t
  misc_feature (584)..(584): n is a, c, g, or t
  misc_feature (597)..(597): n is a, c, g, or t
ggngccgggagcagaagaggcccagaaggaacgccagcggcagaaagagcaggagagcaataaccgccgggngtggggctcnccaggtggggagggcacaggggacctggacgaattggacttctgagaccaacactacactngaccctncacggaaaccagactctacctggactggcttgccccccccccaccnccccaccctggaacccctgagggccaaacagcagagtggagctgagctgtggacctctcgggcaactctgtgggtgtgggggccctgggtgaaggctgctgcccctgctggcagccaccttgagacctcaccgggcctgtgatattngctctcctgaantctcactcaatcctctgcctcncctntgtggcntnncctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgtttnaccctcttctattgaattgccttgggatntccttctcccttnccctggcccaccctgtcccctacaatttgtgcttctgagttgaggagccttcacctctgttgctgaggaaatggtagaatgctgcctaaaacaactggtcccttacttggggcccggttggaaggccccaagagggttcaggcggctcctactttta

SEQ ID NO: 601979 - DNA, 129 bp, Homo sapiens
tgtgcactgcctatcatactagagagtagtaccaaataagccaagcccagtgtggttagtgggtctctgctaagggtagacggtcgtgagtcttccaggtactgttcgctgcaggtttaaggcaggact

SEQ ID NO: 601980 - DNA, 302 bp, Homo sapiens
tcttgaaaaaagcttaaaaaagcagatagcatcaaaacaatgcaagactctatagtcttcccaaaagtaatgaaaatgatgctttaaactaagagaaaggatatgttagtttcttctttatgctggaaatgttggctgtcacgacattttaaatctctactattgggaaaaagtccatgattaaattccttacttttctggtatagagatgttatcatatatacttttatatcaactctctccttttttttttttacttgaaaaggaatttagccctgtcaccccggcgggatttcatgggc

SEQ ID NO: 601981 - DNA, 487 bp, Homo sapiens
tcgacgatgcaatcatcttttgttttggaggacataggcaagaaatgtttcaaagctttctcttggggcctgaacaattgttaggcgtaagagttgatgctgatgtttagggttatagattcggctatcagcactgagtgttgaattctgagagtcagaacccatatgttttttaataaatgatatttatgatatgtgagactcttaaaaacttatgaccctgaccaaggatttccttttgcctaggtctatgggcaacaatagggaaaatgtcaattttattttttctagtatataagtgaataaattgatctattcattttatcattctatttttttaattgttcaatattacctgtaccatggagaacatagtcacacttataaaggctttattttcagagaaatagttgagattcatttcaaagagtgtgaagttaagcagaatttgatgataaaatctgatttttccctcctcatttccatt

SEQ ID NO: 601982 - DNA, 264 bp, Homo sapiens
tcgagcagtgaaagctatcatttgtatttgctattagtagatataaatatgtatatacatatcacgttatcaagaataaaaaatgacaataaagtggttcctaccttctaacacctagttaaaccaaaaaaaaaaaaaagccaaaaaaaattatccccctgttttggaggccccctatattttcgatggacttaacacatttttttatctcaaggggggaaacagggattataacggggggaaccaggggggacccctctatag

SEQ ID NO: 601983 - DNA, 861 bp, Homo sapiens
gactttgtcttctccgcacgactgttacacgaggtctccagtagccttctctctcctgtgcgaagagggtgaactcttaattgaagaactcattgcaccacgcttgcggaataagagggctatcacgttccacatgcaataagaatcacctgtgagctgggatgttggcacacacgattgtgtatgcgacgttgtgctataccagcattctgtgcgcagaagtactctgtgcctgtatggaactatgctcttgctggagtggttctaggcataggatcacagcctttaagagggagcatacatgactggagtctgcccatgcaatgtgtgtatgcgtctactctttgcatattccacgaagcatcgcttgacaaacatttttgtcggcgccaaggattgagataggcaattgaatatcgtcgctgggagcccggctcagattttactgagacggagttgggtggattgattgggggttagacccatgggcaggggtaggttctcggatcaagccagtaggcaaaaggggggggccacgggactgtgcctgggcgcttgctagaactccgttgggggggttggcacgaaaagaaaacggggcacattaagaaagacattggggtttgttcaagaacttttgtggggttcccgcggtagttcaggagcatagcgaataaagttttttttttccccccaaaattttgggttcacaagtttgtttcccttccccgaattgggagatttcccggtcctacaacgattgtaccaaggatcccacgtttcgcgaaattttgtgtggcgccacctttcctcagttttacccacttttctcggttgggcgggttttttacccccgcagaa

SEQ ID NO: 601984 - DNA, 200 bp, Homo sapiens
  misc_feature (181)..(181): n is a, c, g, or t
gacccattatcagtgaacctcttgctcccgtggttaactagttctcctgcctcagcctcccgaatagctgggattacaggcatgcaccatcacacccagccaatatttgtatttttagtacgagacagggttttaccatgcttggtcatgctgtgtctccatattcccgaaactcagtgantcgcttcttgacggtggac

SEQ ID NO: 601985 - DNA, 915 bp, Homo sapiens
  misc_feature (42)..(42): n is a, c, g, or t
  misc_feature (45)..(45): n is a, c, g, or t
  misc_feature (61)..(61): n is a, c, g, or t
  misc_feature (102)..(103): n is a, c, g, or t
  misc_feature (109)..(109): n is a, c, g, or t
  misc_feature (145)..(145): n is a, c, g, or t
  misc_feature (150)..(151): n is a, c, g, or t
  misc_feature (153)..(154): n is a, c, g, or t
  misc_feature (157)..(158): n is a, c, g, or t
  misc_feature (168)..(168): n is a, c, g, or t
  misc_feature (186)..(186): n is a, c, g, or t
  misc_feature (290)..(290): n is a, c, g, or t
  misc_feature (296)..(299): n is a, c, g, or t
  misc_feature (303)..(303): n is a, c, g, or t
  misc_feature (324)..(324): n is a, c, g, or t
  misc_feature (357)..(357): n is a, c, g, or t
  misc_feature (398)..(399): n is a, c, g, or t
  misc_feature (497)..(497): n is a, c, g, or t
  misc_feature (501)..(501): n is a, c, g, or t
  misc_feature (506)..(506): n is a, c, g, or t
  misc_feature (528)..(528): n is a, c, g, or t
gtggaaaggtaaatatcgatgtcggcggagccgaacaagacnganatccagactcttttcnagaggcttcgcgcagttccaaccaacaaggcctgtttcganntgcggngccaagaatccgagttgggccagcatcacgtacggngtttnncnntgnngcatagactngttccggggtgcacctgntccctgggcgtccatctgagcttcatcaggtccacagagttggattccaactggaactggttccagctgaggtgtatgcaggtcggcgggaatgccaatgcganggcttnnnntcgncaacatggatgcacagccaantgatgccaacaccaaatataatagccgagctgnccagatgtaccgggagaagatccggcagctggggagtgcgnncctggctaggcatggcactgatctttggatagacaacatgagtagtgccgttcctaatcactccccagagaagaaggactctgatttcttcacagaanacantcaancccctgcctgggatgcgccagncactgagccttcagggacccagcagccagacccgtctacagagagcagtggcctggcacagccggagcatggcccaagacagacctgcttggcacctcagccaaagcctcactggaactgaaaagctcatcattggcaagaagaagccagcagcagctaagaaagggctgggtgccaaggacagcgctaggggcccagaaggtgagcagcaagagcttccagtggagaatggagcgggagggctcaggggggcacgagacagtccgggaagcaggaaggcaagcgatgccaagaaggcaggcggaggaactccatggtcggctacatggagattgggccaacaggggctcccaatggacgaaaaaagaggaacaaagctacaatcgc

SEQ ID NO: 601986 - DNA, 562 bp, Homo sapiens
  misc_feature (7)..(7): n is a, c, g, or t
  misc_feature (29)..(29): n is a, c, g, or t
  misc_feature (75)..(75): n is a, c, g, or t
  misc_feature (77)..(77): n is a, c, g, or t
  misc_feature (89)..(89): n is a, c, g, or t
  misc_feature (97)..(97): n is a, c, g, or t
  misc_feature (109)..(109): n is a, c, g, or t
  misc_feature (123)..(123): n is a, c, g, or t
  misc_feature (157)..(157): n is a, c, g, or t
  misc_feature (177)..(177): n is a, c, g, or t
  misc_feature (189)..(189): n is a, c, g, or t
  misc_feature (191)..(191): n is a, c, g, or t
  misc_feature (194)..(195): n is a, c, g, or t
  misc_feature (198)..(198): n is a, c, g, or t
  misc_feature (206)..(206): n is a, c, g, or t
  misc_feature (223)..(223): n is a, c, g, or t
  misc_feature (243)..(243): n is a, c, g, or t
  misc_feature (248)..(248): n is a, c, g, or t
  misc_feature (262)..(262): n is a, c, g, or t
  misc_feature (267)..(267): n is a, c, g, or t
  misc_feature (274)..(275): n is a, c, g, or t
  misc_feature (277)..(277): n is a, c, g, or t
  misc_feature (291)..(291): n is a, c, g, or t
  misc_feature (303)..(303): n is a, c, g, or t
  misc_feature (308)..(309): n is a, c, g, or t
  misc_feature (317)..(317): n is a, c, g, or t
  misc_feature (319)..(319): n is a, c, g, or t
  misc_feature (328)..(328): n is a, c, g, or t
  misc_feature (339)..(339): n is a, c, g, or t
  misc_feature (373)..(373): n is a, c, g, or t
  misc_feature (408)..(408): n is a, c, g, or t
  misc_feature (415)..(415): n is a, c, g, or t
  misc_feature (417)..(417): n is a, c, g, or t
  misc_feature (441)..(441): n is a, c, g, or t
  misc_feature (445)..(445): n is a, c, g, or t
  misc_feature (448)..(448): n is a, c, g, or t
  misc_feature (456)..(457): n is a, c, g, or t
  misc_feature (461)..(461): n is a, c, g, or t
  misc_feature (485)..(485): n is a, c, g, or t
  misc_feature (520)..(520): n is a, c, g, or t
tagaaanaaattttattttttaggaaaanagccaaaattatcttaaatgtgaaaaaccacaaccaaaaaactgananaaagttttaggnacaagggnatatcttattgncacgcattcacagngaaacaccattttaatgcagggccagagccaacngcagtcctgtccaatcccanagggacaagggncnggnnccncttcctgngttctgcccgacttccncatcttactggggccagcanaaagnagaggtccactgtnttccncacatgnngngatcttgggttagngggagggacagngccgnnccagcagngngggggtcgngttacttaggnacagcagcccttttttcccttcttctgtgggggntttctcatgtggaagccaattgttttccaaaaaanactgaananaactttcaaattcctttggggtanagtnggnaaccaggnngggnataaaggggtccaggggatcaaanccttcctttcccagcaactcctgggggagaaaggntttccgggggttaaagagagaaccagtctggctcaaagccga

SEQ ID NO: 601987 - DNA, 112 bp, Homo sapiens
cacgaggtcgatgacaatcgcccagatcactacttgaatccccattgttacctcctgcaatacacaattaacctctagacatctaaatgagaccttttcccatggcgccaca

SEQ ID NO: 601988 - DNA, 1106 bp, Homo sapiens
agcacctttatggtcacatataataataacgctacaggcggggggtcccgcccgcctcggaccaccccttccagtgaagacagagacgtggctctccagaaccgtgcctcaagggccagaaagaagatcccagggcccagagggaccaggccacagccaaacaggagtaccaagagcacgggagacagtcactccgggcgtggtgaagacagaggtgccccaggggtggcgccagcaccttcaattctcgtgagttggcgtgccggggcgtgggtcccaggtcccagcccagcaagagaggaacaccaggggctgagcgtgatcagcggaaacccgtggccccagaaggccttgacgggcctccagtcagagcgtggtcggggcgtgcatagggaccgtgggtgccgtgccagggaagccgtgccaggcccccaacttcgggaagggtgggaggcaggagcattctcttcccagacaggccggggactcgtggtttccctctcgtggcagctggcaagggggacacggggctgcgggtgtcatgcaaaagtagcaaacctatagagtccacggagagacaaactcggggggcagaggctgcaagtcccacctcggatagacttgcccatgaaatgttgctccccgggctcagggatgggatggacccagagagagcgggtgggctcagcaagactgggaggcagtggccagggatgcctatctggtttggggggacccttgtacccccaagggtacctctcaagggctctcaaaccgaaagagtggaaagacacatccaggggggtccctgggcgtttgaagagctcggcgccaagtggtgccacgaacatggggaaaagggagaacaaacagaggggaacgcctggagaggtgtgagcagcgcgaacacccccagggggggggggcgaaagcccacgaaacgcgagagcaaaaaaggagcgacaggtgcgtggtgacgccggtgagtgacattactaagagacgagcagactctaacggggaatgcactgctcggcacgcaacgcagcaccccgaagcacaagccaacacgaggaaccaacgaagcagagccgccgcggaacacc

SEQ ID NO: 601989 - DNA, 1047 bp, Homo sapiens
gtgacgcgtgggccgcgttcgtcccgctgagcacatgagcctcgcctttgccgattccgccgcccgtccacaggctcgacggtcagctcaccactggattgagtgactatctgcgcggcggctctgtctgtcgacaacgtgctccgtgcatgtgcaaggaccgggcattactgtcgtgggcgacgatgcgccccgggcctgtcttcccctccatctgggggacgctcccaggacatcaggtcgtgatggtgggcatggtgtcatgaaggattcctatgtgggcgatgaggcccatgatgctacgagaggcatcctcatccctgaaacttacccccgatcgaagcatcgggctatccgtacaccaagcttggggaccggatcgactgggacggacaagatctgggctaccagaaccttctatggatgaatgctcgcgtgtggcggtcccgaggatgcagcccgtattctgctggaccggaggccccccttggatacctcataggcttgaacctgcgcatgaatgatgacccagatcgatgtttgaggacccttcaacacactgcaagaccatgtacgtatggtatccaagggcttgtgcctatccctgtacgtgctctggcccgtttgcattggcaatccgtggatgcgacgtccggtgacgggggatcaaccgatatctgtggcccatctacgagagggtaatgtccttcgccacatgctgatcactgctgtcttgtgatgtggtttggccgggacgcctgactttgagtagcctcatgaatgagtccgtcgaccgacccggcggattacatgctttcgaaccctacccaatgtggccccggagccggggagaactcggtgggcgtgaagcccttcatctcgcgtggacagcctgaactgcctcccttctccccctgtgcactttcgcacagccacggacgcattgcgccaatggcctaggctttccacgcctcgctcctacgggtggcaatacggcttcgacacctggccttgcgtggccaagtgtcactccaccttgcgcagcgg

SEQ ID NO: 601990 - DNA, 328 bp, Homo sapiens
  misc_feature (322)..(322): n is a, c, g, or t
cgtcgacattgtaatttgaataaagtgtaaccattgtgtaccctttttgtataaaatagacaaatagaaaatggtcccattagtttcctttttaaaaagcttaaaataagcaggtggatttatttcatgtttttgatcaaaaactatttgggatatgtatgggtagggtaaatcagtaaaaggtgttatttggacccctgttttggacagtttaccagttgccttttatcccaaagttgttgtaacccgctctcaaacgatccttcaaacaaacctgccgcctataaacaatggttcagaattaaacctttaattcctttgnaaacca

SEQ ID NO: 601991 - DNA, 1361 bp, Homo sapiens
  misc_feature (51)..(51): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (111)..(111): n is a, c, g, or t
  misc_feature (127)..(127): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (176)..(176): n is a, c, g, or t
  misc_feature (198)..(198): n is a, c, g, or t
  misc_feature (201)..(201): n is a, c, g, or t
  misc_feature (228)..(228): n is a, c, g, or t
  misc_feature (250)..(250): n is a, c, g, or t
  misc_feature (274)..(274): n is a, c, g, or t
  misc_feature (297)..(297): n is a, c, g, or t
  misc_feature (300)..(300): n is a, c, g, or t
  misc_feature (376)..(376): n is a, c, g, or t
  misc_feature (435)..(435): n is a, c, g, or t
  misc_feature (479)..(479): n is a, c, g, or t
  misc_feature (495)..(495): n is a, c, g, or t
  misc_feature (519)..(519): n is a, c, g, or t
  misc_feature (556)..(556): n is a, c, g, or t
  misc_feature (597)..(597): n is a, c, g, or t
ggttttttctttcccaattccctttctttaactggcccctggtcgctcctngcgctttggggaaggagggcttttgggggaatnangttcnatgagggggaaaggggacgnaacgatggggaagganaacgaggnggattttnaaaatttngtcatttggaaacgagggggggatnattaaaaaatggcgatttcgtngtnaccgcgtggggtcgtgggcggataatnagggtttcgaagaaaacgtggngaagtggggggggagtggtcgcgnatcgtcgtgtgagtttgagcgtnacngtattaacgtggtcgcgacgcgcgttaacgtcacgcgtggtgggggaatcgggttgcgcgtggggttttcgtcgtntcgtcgttgtggtcgcgtggggagcgaaagagcgcgagtttcgcgtaaaaaacgtaaanaacgtcgcgatttcgtaggtcgtttggggaaaggagaaaaggtnttcgtacgtcgagggnacgtggggggagagggaggtgggnacgtatattagagcgttcgggcgcgtcgtagggcgtngtcgtgtgtcgcgcgcgtcgaggcgtcgcgcgcggagcgantgcgatttactgtctggcgcgtgggtgctggcagtcgttgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaaaaaaaaaaaaacaaacacaaaaacaaaccattggcgggccgcaccgcggccaccgaaaaaagagctttttaacaccaactgaggatgtgggccgcccgagggaaccccagattaggataagttcaacaggtgtacaacacggcggaaccacgaaggaagaacccgggacaacgaacaaaaggactcggggcactactcccccacaaaaaaaaaaagcaccggtggtaaacagcgggcgctttcggacaacatcccaaaacggagtccgaaggcacaaacggggacgcaacacacagggcacccacagacgcgctcaaaattaaataaagcgccaccgga

SEQ ID NO: 601992 - DNA, 1013 bp, Homo sapiens
  misc_feature (71)..(71): n is a, c, g, or t
  misc_feature (75)..(75): n is a, c, g, or t
  misc_feature (83)..(83): n is a, c, g, or t
  misc_feature (85)..(85): n is a, c, g, or t
  misc_feature (89)..(89): n is a, c, g, or t
  misc_feature (94)..(94): n is a, c, g, or t
  misc_feature (104)..(105): n is a, c, g, or t
  misc_feature (113)..(113): n is a, c, g, or t
  misc_feature (120)..(120): n is a, c, g, or t
  misc_feature (127)..(127): n is a, c, g, or t
  misc_feature (133)..(133): n is a, c, g, or t
  misc_feature (140)..(140): n is a, c, g, or t
  misc_feature (144)..(145): n is a, c, g, or t
  misc_feature (151)..(151): n is a, c, g, or t
  misc_feature (177)..(178): n is a, c, g, or t
  misc_feature (186)..(187): n is a, c, g, or t
  misc_feature (192)..(192): n is a, c, g, or t
  misc_feature (208)..(209): n is a, c, g, or t
  misc_feature (223)..(223): n is a, c, g, or t
ttaattttattaccaggaaaaaaaagccttgggaccttgttgggaaatacttaaaactgcagggagagtgncatntttagtancncttnactgnccaccctacnnctgtggancgtgccnggttgtntcttgngtcggancaanncagtcntaaactaaactcattcagtctggaannaaagtttnnctcanactgggaggagtgganntatgacttggcctntaggctgtctctgtcccctcagctcccggacatgcattactctctgccgtgggtctgcagtcgttgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaaaaaaaaaaaaacaaacacaaaaacaaaccattggcgggccgcaccgcggccaccgaaaaaagagctttttaacaccaactgaggatgtgggccgcccgagggaaccccagattaggataagttcaacaggtgtacaacacggcggaaccacgaaggaagaacccgggacaacgaacaaaaggactcggggcactactcccccacaaaaaaaaaaagcaccggtggtaaacagcgggcgctttcggacaacatcccaaaacggagtccgaaggcacaaacggggacgcaacacacagggcacccacagacgcgctcaaaattaaataaagcgccaccgga

SEQ ID NO: 601993 - DNA, 81 bp, Homo sapiens
tcaagcttctaacgatgtacggggacatgatattgtcaaaacagtgaggaaacattaaaaaaaaagccctaaagctaaaaa

SEQ ID NO: 601994 - DNA, 852 bp, Homo sapiens
  misc_feature (512)..(512): n is a, c, g, or t
  misc_feature (659)..(659): n is a, c, g, or t
gtctatttttgtgggggtgtaaatccccccgcgcccagagagaggaaaatatataggcacacactcttccccctcaatatcgctgagagagaaagagaatctcggggataattggcgggcgcttttcacacacgacagaccctctcgtcactcttctctccccccagagaggaatataccccccgcaggctctcctctttctccccccaggaggaattacccccgcggtgggctttttgtccccgcaaccttctcccacaaaagagggtgtatatctttaaataggccccaatatctctctctgtctctctctctttagacccctctgggcgcacctcttttctcccctcgggatatcctcgccccctcgggcttctcccagcaccactatagatgtgaaggagcccacgcccctcataggagagtgtctgtcgaggaggccactctcctctgtgtgttccacttcgctgagaaagcccacatataacgcacgcgggatgtccctcttgcgnccactagccctcctgaggcctcatagagggggccccttctctggagatgccccacactcgagaggttgtctcgttggctttaatttgctggccacaacgctgacaattcttctccacggggttctaggaggggcacttttggagacntgcctgacacccaccccctatccccttcgcctccccctctcacgaagagggtggaagatgaaatgtgaagctatgggacttcttggaggataccccctgtctatttctgggttaaaagaaagtgcttaattaaaggggtttttctaattaaaacccaatgcccccctacaacaaagaaaaaaaaactcgagca

SEQ ID NO: 601995 - DNA, 354 bp, Homo sapiens
caatggtgataccctctaagtaatgtgtcatcagacaatttcagcattgtgttacacattataaagtatagttacataaacctagatggatagcctcctgctcacctaggctatacggtacagcctgttgccctaggctacaaacctgcacagcatattactgtactgaataactgtaggccggttgtaggacgatggtaagtatttatatattctaaacatgacaaggggaccttaaaatatggtataaaatatttacaatggtgcacctgtataggggcacttaccatgagtggaagcttgcaggactggaagtggctgtggggttgagtcagtgagttagatggtgagtga

SEQ ID NO: 601996 - DNA, 1018 bp, Homo sapiens
  misc_feature (1)..(1): n is a, c, g, or t
  misc_feature (76)..(76): n is a, c, g, or t
  misc_feature (80)..(80): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (99)..(99): n is a, c, g, or t
  misc_feature (109)..(110): n is a, c, g, or t
  misc_feature (118)..(118): n is a, c, g, or t
  misc_feature (125)..(125): n is a, c, g, or t
  misc_feature (132)..(132): n is a, c, g, or t
  misc_feature (138)..(138): n is a, c, g, or t
  misc_feature (145)..(145): n is a, c, g, or t
  misc_feature (149)..(150): n is a, c, g, or t
  misc_feature (156)..(156): n is a, c, g, or t
  misc_feature (182)..(183): n is a, c, g, or t
  misc_feature (191)..(192): n is a, c, g, or t
  misc_feature (197)..(197): n is a, c, g, or t
  misc_feature (213)..(214): n is a, c, g, or t
  misc_feature (228)..(228): n is a, c, g, or t
nacaccgtttaattgatgaccaggcatataaagcatctgaccccgatcggcatatgctcaaatccagtgggagtgncatntttagtancncttnactgnccaccctacnnctgtggancgtgccnggttgtntcttgngtcggancaanncagtcntaaactaaactcattcagtctggaannaaagtttnnctcanactgggaggagtgganntatgacttggcctntaggctgtctctgtcccctcagctcccggacatgcattactctctgccgtgggtctgcagtcgttgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaaaaaaaaaaaaacaaacacaaaaacaaaccattggcgggccgcaccgcggccaccgaaaaaagagctttttaacaccaactgaggatgtgggccgcccgagggaaccccagattaggataagttcaacaggtgtacaacacggcggaaccacgaaggaagaacccgggacaacgaacaaaaggactcggggcactactcccccacaaaaaaaaaaagcaccggtggtaaacagcgggcgctttcggacaacatcccaaaacggagtccgaaggcacaaacggggacgcaacacacagggcacccacagacgcgctcaaaattaaataaagcgccaccgga

SEQ ID NO: 601997 - DNA, 1309 bp, Homo sapiens
  misc_feature (51)..(51): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (111)..(111): n is a, c, g, or t
  misc_feature (127)..(127): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (176)..(176): n is a, c, g, or t
  misc_feature (198)..(198): n is a, c, g, or t
  misc_feature (201)..(201): n is a, c, g, or t
  misc_feature (228)..(228): n is a, c, g, or t
  misc_feature (250)..(250): n is a, c, g, or t
  misc_feature (274)..(274): n is a, c, g, or t
  misc_feature (297)..(297): n is a, c, g, or t
  misc_feature (300)..(300): n is a, c, g, or t
  misc_feature (376)..(376): n is a, c, g, or t
  misc_feature (435)..(435): n is a, c, g, or t
  misc_feature (479)..(479): n is a, c, g, or t
  misc_feature (495)..(495): n is a, c, g, or t
  misc_feature (519)..(519): n is a, c, g, or t
  misc_feature (556)..(556): n is a, c, g, or t
  misc_feature (597)..(597): n is a, c, g, or t
ggttttttctttcccaattccctttctttaactggcccctggtcgctcctngcgctttggggaaggagggcttttgggggaatnangttcnatgagggggaaaggggacgnaacgatggggaagganaacgaggnggattttnaaaatttngtcatttggaaacgagggggggatnattaaaaaatggcgatttcgtngtnaccgcgtggggtcgtgggcggataatnagggtttcgaagaaaacgtggngaagtggggggggagtggtcgcgnatcgtcgtgtgagtttgagcgtnacngtattaacgtggtcgcgacgcgcgttaacgtcacgcgtggtgggggaatcgggttgcgcgtggggttttcgtcgtntcgtcgttgtggtcgcgtggggagcgaaagagcgcgagtttcgcgtaaaaaacgtaaanaacgtcgcgatttcgtaggtcgtttggggaaaggagaaaaggtnttcgtacgtcgagggnacgtggggggagagggaggtgggnacgtatattagagcgttcgggcgcgtcgtagggcgtngtcgtgtgtcgcgcgcgtcgaggcgtcgcgcgcggagcgantgcgatttactgtctggcgcgtgggtgctggcagtcgttgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttagataacggggcatatttaagggggcatctttgtgtaaaagatgcatggagtcaggagaaaaccaccttcataaactgctctgtgcaaagaggaataaaacattttttccaaaaaaaaaaaaaacaaacacaaaaacaaaccattggcgggccgcaccgcggccaccgaaaaaagagctttttaacaccaactgaggatgtgggccgcccgagggaaccccagattaggataagttcaacaggtgtacaacacggcggaaccacgaaggaagaacccgggacaacgaacaaaaggactcggggcactactcccccacaaaaaaaaaaagcaccggtggtaaacagcgggcgctttcggacaacatcccaaaacggagtccgaaggcacaaacggggacgcaacacacagggcacccacagacgcgctcaaaattaaataaagcgccaccgga

SEQ ID NO: 601998 - DNA, 408 bp, Homo sapiens
ctcgaactcacgagttagaggatgtagtgagctataaacacgccactgtgctctagagcttgcagaccagatagagtctgtaccatcataaacgtcactacagatatacctactgccatacacacacagaaggctatacagaaacacctaaagacactgacagtgacagtgcagtgccatatggccacatgtgcatgtgaacttggcagacatgagtttttgcagccaagtgatccgtacaggcccctaattagactgtggtgggttattgatgctatgacaagtacatttggttatagaggccctgtgcagatgagttactgactatggccatgccgatgccttgactatagctgacaaggaagggctattggcacattcaggtttactttgtggggtctgcttggg

SEQ ID NO: 601999 - DNA, 182 bp, Homo sapiens
ctctcgaagtatgcacatgtcatcagcactcctgcggctgtgtcacatgtgctgcattcccaaccttggcccaactacactttctatcattaactgagccctgtctcagattttccgagttcccattttggtcaccacagcgggcttctgagtggcggtacccctggcctttggacctatct

SEQ ID NO: 602000 - DNA, 952 bp, Homo sapiens
ggggaagtgtcaaggtgcaccagcccaagagggtacatttgcccgagggtgtaggaattgcgaggccaggtatattggaacttggaagcttagtgcaaaagtgacttgtgctacagtgggtcactgtcttctcggcgttcacaaaaaagggtattggcaaccaagtgttgtatctgatagttaccaaggtggtatgctaggggaaattgtgcacgctttgtcacatattgggactcggtaggcttgcaacttatgttcttggggcggtgtgacacttgtgggggtctatttagagcttcggtgcccttccttgacatgtgcaaggtgcacccagatgagacacgctgtagtaataggtctcttcacctctcagatgcctgtcccgtgcttcgagctgttgtcttgtgcttgggacatgggccttcctatctgtgtctttctcaaagtcaggagctgaccaggagcacacttaggtgtggtcatgcatcattaccacagtcactcatccgggacatttcttaagatacatttaaaaatcatttcagcagtagtacttccgtatgtgctgagagtttacagagctctttgacatacgcgattcttagtctttacaaataaggaaacagctcagtttgggaaggtatcagagatgggattcaaacccaggatcctctggtcctagttgtatgtgcactggactaatcaggcaggaaacagcccagccactgtctcacagattgttttttgtatattgtagcataatcctgaaacaaatggggtcattccagtctcatcatacgaatggcaatcttggctgggtgcggtggttcatgcctataatcccagtgctttatcaggctgaggaaggagctctctgagaataggagtttacggcccagcctggcactgcgacctgccgctgctcccctgcgcggcgccctgtggggtctgc

SEQ ID NO: 602001 - DNA, 138 bp, Homo sapiens
tgagataggctccacgacttatatcctcctttggggacaggcttggacacagcaggctttcaagaagtgccagttgatccatgaataaataaacgagcctatttctctttgcaaaaaacaaaaaaaattcaaaaaaaa

SEQ ID NO: 602002 - DNA, 381 bp, Homo sapiens
cgtggccagtacggattgggcagatcacgaggttaggattaggagttcaagaccagcctggccaacatggcgaaagcccgtctctaccaacaatacaggcgtgggcacggtgtgctcacacctgtaatcccagcaccttgggaggctgaggtgggcggatcacctgaggtcaggagttcaagaccagcctgaccaacatggagaaaccccatctctaccaaaaatacaaaattagccaggtatggtggcgcatacctgtaatcccagctactcaggaggccgagacaggagaattgcttgaacctgggaggcagaggttgcggtgagcagagatcacgccattgcactccagcctgggcgacaagagcaaaactccatctc

SEQ ID NO: 602003 - DNA, 941 bp, Homo sapiens
  misc_feature (729)..(729): n is a, c, g, or t
tatcccacaccagagtggtacatttgttacaatcaataaacctccattgacacatcattatcacccaaagtccatagtttacatgaagattcactctggtgttgtacattgtatgggcttagacaaatgtatgatgatatctacaattatggaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggttttgttatacagattatttagtgacccaggtactaagcctagtacccaatagttacttttctgggtcctgtcccttttcccaccctccaccctcaggtaggccccagtatgttattcctttgtgtccatgttatttcactcccacttgtgagaacatggaatatttggtttcctgttcctatgttagttgttaaggataatggcctccagccccatccatgttcctgcaaagggacatgatctttctttggcaaccacttttactgtcgccaatagtccttccttttctagaatggtctatgggatcatatagtatgtaggctttcagactggttcttcacttaataatatgcaataagcgcccccggcagatacggggtaaaagggccgatttttaagcccggaatattcaccgtcgtagagaaagtatcanctcccattgagacctagtgcgtcgagttggaccgaaaaacggtggcgcccacaaaaaaaaatggctgccggaaaataggcgcggcgctgcagcccttctgcgcgaccgccaccctgctgctgcgacgcaaacaagcacaccgaggagctaggaaaagacaagcaggaagagtagaaagcgccaaacaagaaagagaaaacacaaacacacca

SEQ ID NO: 602004 - DNA, 408 bp, Homo sapiens
  misc_feature (230)..(230): n is a, c, g, or t
  misc_feature (305)..(305): n is a, c, g, or t
tactttccgttattcatccataacagtttattctacatttgtacagcagcaatatgctcggtggtaacttaacacgtttatagacggtaacaaatgatgtttccaaggatttaataatctgatcaagttcttgattatttccataatagaatggactcggtctgattaaggagctaagtgtgaagaggaagcataaggttcaaatagttgttaactgacccaaacattcnttaagagaaatgcaaagaaaaaagtttattttcaatgccttcggaactatttaagtgaaagcaaaatcatttccntaaatgcatatcatttgttgagaatttctcattaatatcctgaatcattcattttagctaaggcttcatgttgactcgatatgtcgtctaggaaagtactatt

SEQ ID NO: 602005 - DNA, 129 bp, Homo sapiens
tcaacatgtagtgcccgctacctcagcctcctgcagccatgtcagatgcggcatgccagatgtcggcaacagcagcggttgcagcagctgcggctgcagccgcgggccccggtagccctggcgcggccg

SEQ ID NO: 602006 - DNA, 391 bp, Homo sapiens
taatcctgtttcttttccataagtcgtgtagtttttagcatgtaattatgcagaccataaggtttttcaggaatactaatatggcattagattagaaatgctatattaaaaattcttattaaatctactgatagtaaccaaaaaatagaagattcagaagaactagcaaatgtggagagaacggatgaaatggaagcagtgtgaacctagtgaatacttgccaagctgtatctcccctgaatttgtcaaaacatcatctccagcatctgagctagaccaaccctcagtgctaacattgatgtgattaaagagtctgaactgggagcagaattccttcaggtattttgttaataaaataaagctctccatctctccttaaattaaacaaaaa

SEQ ID NO: 602007 - DNA, 826 bp, Homo sapiens
ggagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatcggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaacgtaccaccctggtgaaagatgtttataataggggaggttatccatgtatagcggcagggagtacataggaaatctctgtatcttctgttcattattgctgtgaaccaaaaactgtgctaaaacacaaagtctatttcttaaaactgcatagacataaatacatgggcatatgtgcataaacagacacgcacacaaataagtgcaggtaaaacaggaaatttgaacaaaatctgtggattataactgtttcaatatcttaatgttgatgttgcactatggttcgcaacatgttatattaggggaaaattgacttaaatagtaccgggatctctctgtaactattcctgcctgtgaatctgattatctcaagttaaaagtttaaaatttaaagttcctatcaaattaccaaggatgggatccctagatacataccctttccggcgc

SEQ ID NO: 602008 - DNA, 251 bp, Homo sapiens
ccgagctggttttattatgttgttaccatgagccagtgattctgaacaattttagtgttcacatattcctccctgaagggtcgttggtgtcctatgtccaccctccttgttaagccattgtctggcaccccacccaagtgggaagatgtaggataaacctctgactttgatatataagggttgttaaacattatggactgattctctagggttaggttggtctattggtgttgtctacctgccaccgttct

SEQ ID NO: 602009 - DNA, 130 bp, Homo sapiens
  misc_feature (77)..(77): n is a, c, g, or t
agaaaaagaaaaaagaacatcaataaaaagaagtcagatttgttcgaaatcttgaggagtcttcaggccagctcccntgtcggatggcttttatgaaaaaatatcttcttcccattcttggggctcttca

SEQ ID NO: 602010 - DNA, 108 bp, Homo sapiens
ggatttgctggtgcagtacaactaggcttaatagggacatggttagtaaatatttgtgcaatataaaggttggacttctttgttactatcattacagcttcaaaaaaa

SEQ ID NO: 602011 - DNA, 583 bp, Homo sapiens
  misc_feature (165)..(165): n is a, c, g, or t
gggggtatcgtggttcagctgggcgtttaacccagtggaattttggtgcttactttattgtggggggggtgtttgtgtgtctgttggagtacccctgggggaaaaggaaaaagggtttctctatggagtgctggggataaaagtaaatcaccgccgtggtgaacntgtttgggccctttaccaggaattactatgttcgggccgtcttgtatttcttgcttttggtgcccgccggcttcttgttggccaccatccttgggaccgcctgcttggccattgcgagcggcatttacctaatgggggttgtgggtggcgaacagtggacgcccattgagcccaagccccgggagcggccgcagattggaggcaccattaagtagccgccccatgaaaccccccgccggggcccccggccgaggcccgcaaaaagcccagcaaggaggaggttgcggcggcgggggggggacccccgggaggtccccaggtcaaccccatcccggtgaccgaagaggttgtgtgaccttgccccggacctgccctcccgccaggtgcacccacctgcaataaacgcagggaagccgga

SEQ ID NO: 602012 - DNA, 411 bp, Homo sapiens
catcactgaaaccttaaatatatacccttactctctccatatatattgtctctcctgtattcacataatttcctatgcctacttcttttatctttgagttagagccctactctgtcacccaggcaggagtgcagtggtatgatcttggctcacggtagcctccgacttccgagttcgggcggttctcatgcctcagcctcccaagtatgggcgtgcaccactgtcactggccaatattggtatattacgtggagacaggtatttgccgtgttggccaggctggtcttgaactgttggcttcaagcaatcttcctgccttgacctcccaaagtgttgggattgcaggcgtgggccaccacgcttcagccactgaagtgggtgtacacccccccattgctaaatttgactggc

SEQ ID NO: 602013 - DNA, 312 bp, Homo sapiens
ttcccagttttgtccttacccattccaaggggtttgccagcccctgtttatccaagttttaagtccccccccctgttttaaaaaactgttccaacggctttgggcctcaggggtcatttgacccccattgtttcaaaggtgccccctttgtgtgtgtcacaagcggcctgagtcacaagtacattttatttttgcctctagttttgtaagctcctggaggggggaaaacattttatactacttttgtattttcatggcccctagggcaggggtgggcccaaattaggggctccacccacacttgttgaatga

SEQ ID NO: 602014 - DNA, 179 bp, Homo sapiens
ctatgtagcccaggttgtctggaattccggggctcaagcagatctaccgggtcttggcctcgccaaagtgctagggattgacaggcgtgggccaccatgcctggccactcgagggtacatactggtttatcgaaattgaagggtaagtcgtaatccttagcttttgactttgaccataa

SEQ ID NO: 602015 - DNA, 549 bp, Homo sapiens
  misc_feature (10)..(10): n is a, c, g, or t
  misc_feature (77)..(77): n is a, c, g, or t
  misc_feature (109)..(109): n is a, c, g, or t
  misc_feature (127)..(127): n is a, c, g, or t
  misc_feature (149)..(149): n is a, c, g, or t
  misc_feature (152)..(152): n is a, c, g, or t
  misc_feature (156)..(156): n is a, c, g, or t
  misc_feature (175)..(175): n is a, c, g, or t
  misc_feature (184)..(184): n is a, c, g, or t
  misc_feature (188)..(189): n is a, c, g, or t
  misc_feature (214)..(214): n is a, c, g, or t
  misc_feature (221)..(221): n is a, c, g, or t
  misc_feature (228)..(228): n is a, c, g, or t
  misc_feature (231)..(231): n is a, c, g, or t
  misc_feature (236)..(236): n is a, c, g, or t
  misc_feature (270)..(270): n is a, c, g, or t
  misc_feature (313)..(314): n is a, c, g, or t
  misc_feature (316)..(317): n is a, c, g, or t
  misc_feature (328)..(328): n is a, c, g, or t
  misc_feature (335)..(335): n is a, c, g, or t
  misc_feature (391)..(391): n is a, c, g, or t
  misc_feature (453)..(453): n is a, c, g, or t
  misc_feature (459)..(459): n is a, c, g, or t
  misc_feature (502)..(502): n is a, c, g, or t
aaaaaaaaancaaaaagagaaaaaagaaatatgaaaagatgggggggaggggttaacaacccccaggggggacagtngggacgcgaacaaagaccaactcctgcccctngccgtaccagagaacacntaaaacaaccaccagtaccaancancaanaaaaaaaccccagggaacngctggatanaagnngggccaagcctacctggccctgacnccaggcnggggtanccngaacngtatccaccccgcccccaactcccaactgcatcncctcgccaccccaaaccccccagaacaaatgaaccaggaaganngnngggagatgaanaatacanaggaacaaagaaaaaaaaaaggggagggaaagggagccctccaaccaagggctgcnaagggacaaaggagagcagaaaaggacccccccacggtcactacggtgtggaagaagggtanaaaacnagtggtctccagagcattgggtgtggtggaaacccccaaaganaataaaggtagtaactggtaggtagtcggtgttctaaagtttccgta

SEQ ID NO: 602016 - DNA, 128 bp, Homo sapiens
gggggaattacctgccctaacccctccctcaattaaatacattactgtactctggagtttaggcaaaaccttaaatctccaggctttttaaagcacaaatataaataaagctgggaaggtaaccaaat

SEQ ID NO: 602017 - DNA, 338 bp, Homo sapiens
  misc_feature (18)..(18): n is a, c, g, or t
  misc_feature (25)..(25): n is a, c, g, or t
  misc_feature (53)..(53): n is a, c, g, or t
  misc_feature (56)..(56): n is a, c, g, or t
  misc_feature (61)..(61): n is a, c, g, or t
  misc_feature (81)..(81): n is a, c, g, or t
  misc_feature (85)..(85): n is a, c, g, or t
  misc_feature (100)..(100): n is a, c, g, or t
  misc_feature (145)..(145): n is a, c, g, or t
  misc_feature (203)..(203): n is a, c, g, or t
ttcttccccagaaaatgncctttcnttttctaccacacagctgggctgcaaanttnccaanatttatgctctgcttctctnttanatataaattccagtntcagataatctctttgcacatgcatataagcatacactgttagangcacccactgttaaatgctttgctccttagaaatttcttccaccagataccctaaatnacctctctcaagttcaaggctccacagatctctagggcaggggcaaaattccaccagtctctttgctaaaacgcagcaagagtgacctttgctccagttcccaataagttcctcatctccatctgaaaccatctc

SEQ ID NO: 602018 - DNA, 104 bp, Homo sapiens
gacctctttcctaatgaggaggaagaggagcccagcaatggcttgtcccgtggtacaaggtgctacagcagctcagcagggtggatatgagatcccagcaaggt

SEQ ID NO: 602019 - DNA, 245 bp, Homo sapiens
ctaacaggtgagacactgttggtagccctgaagtatacactctccttctcctccccttaactgactgacttaaacttgatccagtgatgggaccacgaacttcaaaaggtgggtcgctggagtagatgtggtagcccagctcttccaacaggtggctcagcgactcggccgtggcaacactggggcatgcatcctacaatctctcttcctacacttccacatccactttcctttagcttcttcca

SEQ ID NO: 602020 - DNA, 325 bp, Homo sapiens
tggatatggagtctcactctgttgcccaggctggagtgctgtggtacgatttcagctcaatgcaagctctgcctcctgggtttaagcaattctcctgcgtcagcctccccagtaggtgggactacgggtgtgcaacacaacatccggctaatttttggatttttcgtagagacagggtttcacatgttggccaggctggtcttaaactcctgacctcagttgatccacctgcctgggcctcccaaagtgctgggattacaggcataagccactgtgcccagctgcattgttgctgttttttattgttagttaagagaggtcgacg

SEQ ID NO: 602021 - DNA, 803 bp, Homo sapiens
ttaggctctggctcgtcggctgcggcgagtcgggacactgaccagtacttcaagcataagaagctggcgtcggacgcgtacatcttcttcacccggtcggtgcagttcactggaggagaaatttgcgccaggctgagaagactgagcttgatgcccactttgaaaaccttctggcccgggcagacagcaccaagaactggacagagaagatcttgaggcagacagaggtttcttctagcgagacacaatcccaagtgccctgatgtggagtgagttcactgtatggagaatgctggacagtgaaggtcccccttcaatgggttcacctaacgtgggagcttgctggctacagataccatggcagaacgcggcccagtgagtctgggagccgaaccattccccatagtgggaatcacactgcactcaagggtggcagacagctgacaacacgcaacgtgggaatccggttgagagcagggacttttaatccaccacggcactccatcagctttgctcacacccttgcgccaacttcctggacgggggactggacagaccatctcgaatgagaggcggctccatccaaaaccggcgatctgagacttggactgcctgcacaagcgaggcttgaagaaaggccaaggcttgcagaagccaagagccacgctctggaatcgatgaagtggaacaagggcgacgcagggagctccagcgattggcccaagaccagagtagaccggcaagacagcaaaggaaccggactcttgctggagggaaatcaagagacactcacgtgaaccaca

SEQ ID NO: 602022 - DNA, 393 bp, Homo sapiens
gggatctcggcatgagaatgtaattatcttatggaactcatcttcatgacactggagatggtaacagaaaaagtctatacacacagccagaagaacctctcagtctgtttaggggtgagagagtctgcaaagttccatgacacactcagcatggggctgccttagacacacagtggtgacttgctctttaaagcatctccattggccttcttgactcactggtctcacctcttccttgccctactggaacttcctgggagcacctcccagataagccctgtgcattcaaatcctgacctagagttgccttctagggattcatgttggtggggagcacacaggactgaaagtggactgaggccaatgacttggctaagtaagggatgctgtgca

SEQ ID NO: 602023 - DNA, 133 bp, Homo sapiens
tcgcaggtcagttgatctctctcggccgcacgggcctgctggccaagtcagttgctgctcaagtaccacacgatgttgcctcattccctgacgtacctggtcattccagtatcaagaacgttcatcctctcgg

SEQ ID NO: 602024 - DNA, 1608 bp, Homo sapiens
  misc_feature (1149)..(1149): n is a, c, g, or t
  misc_feature (1214)..(1214): n is a, c, g, or t
  misc_feature (1333)..(1333): n is a, c, g, or t
  misc_feature (1372)..(1372): n is a, c, g, or t
ccagtcgataaggtagtgtagtattacctagacctgttagtgagcttcgtgaagtatcaagcagctccgcgtactagcataattcgtcgtttgtaattgattgtcgccggacattattatcgtactgcgtcgctcgtggttggtacactagcaggagtatttcttatgagtcgtcgcgtttttgtcgttgtagtactatccgcccgcctcgctctacatatgtgttgggttctcgggagatggttggttgtccataaagttgcgcacccctatagaggcccccgtttctctcggcggagatagaatctgtgtgtctgcgccacgaacggtggtagtcgtcgagccctttttttggcgttccattattatgtggttgagaagcccttctaccactgtttacagggaccccgcggttttgtgggcatgggtaaaaaatacaggtatttacaacccggtgctagtaagatgagaggcttctctctcccctggaagaggtttaaccccaccgttcaacccgagttgaagtgaaactcccctcgggtgagggaccccccatcccccctggatgtgggtcgagctttccccaaaaaggaagttattgattgcaacatgtgttgcaagagttttttggagaaaattccacaaaatagcccctttaatattggccctcggtggtgtgtaagaaaaaccacgcatctttgggtgaagaaattgtttgtttgataatatgtgagtatgatagaaactctgtgagtattttgttggaggaaccggggaagattttttctgcgcttcttttggtgtgggcccccacgagtgcttggggaggtgcacccactagggagcgccggaatatctcccgcggttttctaacaaccgcccaaaacctgcacagacactggccccctcggggtgttctcacacagtgggagttgttcttctccctctgcctctctcacagccctctcccgcaggttatagttctcgggggagttttaaccacacggcactctgtgggccacacccacacggccccacaaactaatattgtgtgatttttctcaagtgaagagagttgtggggtgtttcttcccacactgtgttgtgctcacaggcctgtggtctctctgagaactctccctgagctcntcacaggggtgagatcttgtcccacaccctctggcgcctctccccacaggtgtccttgtgagatnttcacagggcacatgagagccacaccacatgtcccgcgccacacatgagacactatactctatctttatgagacgccacgtggtgtaatatagagttatacttatatcttatgagaaanctataatatgtgtaacaaggaggagagaaaatatggagncacgcttgttataaaggggagtaaccacgagaacactttgaatttttccccaccactgaaagagagaactgcctatttgtgtaaagggggcacctagggcttaaaattcttaatgggtataaattagtaaccggagaagaaaagaatttctgagtacccgtgaccctggaaggtaaggtggctgctgacatggacagatagaaataccattaaatatatatttaatgaaatgacca

SEQ ID NO: 602025 - DNA, 783 bp, Homo sapiens
  misc_feature (206)..(206): n is a, c, g, or t
  misc_feature (248)..(248): n is a, c, g, or t
  misc_feature (261)..(261): n is a, c, g, or t
ggcgagccccagctctccgagcaccgggtcggaagccgcgacccgagccgcgcaggaagctgggaccggaacctcggcggacccggccccacccaactcacctgcgcaggtcaccagcaccctcggaacccagaggccctgctgctctgaagtgttgacccccctgtgggaggaatggctgattgtgccccgtgcgatggactganttgccctgctgccctgcctctgcccctgtgcctggcatcccntgcctgtctgccnttgtggcttcttgtgcacgctctgtgcctccatgtggcacccatggcctgggccacctgcccgctgccccctgtggcttgccctgctgggagccgacttgcctgaacagctttacctgccggtggtgcctggcttcgtgcttggacaccaactgcctcggtcagcaactggagctaccttcctggatgtcccccacctgtgcgcctggggctgggactgctgtgctgcgcctgctgcaccacccagaactgcaacttggcgctagtggagctgcagccctgaccgctggggaggacgccatcgccgcctgcttcctcatcaactgcctctacgagcagaacttcgtgttgcaagttcgcgccagtgtagggcttcatcaactacctcacgagggaagtgtccgctcctacgcagctgctggccaggcttgggggtctggatccccaggctggcaggcttacttgaaggccacccggaacctttgcgggtttgacccgttggccatgggtccgttcggtcggc

SEQ ID NO: 602026 - DNA, 482 bp, Homo sapiens
agtaccgagagaagagtgaatatatgtgcactcgtatagtcttgcaccgttctagagtagggcaaactttgtgtaaagaagtgcagtggcgccatctccagctcactgtaacctccgcctcccgggttcaagcaattctctgcctcagcctcccaagcagatgggattacagatgcccaccaccacacctggctaattttttctatttttagcagagacagggtttcaccatcttggccaggctggccttgaactcctgacctcgtgacccacctgcctcggcctcccaagtagctcagattacaggcatgcgccacccagcccagctactttttgtatttttagtagagacacggtttcgccatgttggctgagctggtcccaaactcctgacttcaagtgatccgcccaccttggcctcccaaagtgctgggattacaggcgtgaagcaccgtgcctggcccagaaacaagtttatggtc

SEQ ID NO: 602027 - DNA, 590 bp, Homo sapiens
  misc_feature (2)..(2): n is a, c, g, or t
  misc_feature (15)..(15): n is a, c, g, or t
  misc_feature (33)..(33): n is a, c, g, or t
  misc_feature (62)..(62): n is a, c, g, or t
  misc_feature (79)..(79): n is a, c, g, or t
  misc_feature (127)..(127): n is a, c, g, or t
  misc_feature (215)..(215): n is a, c, g, or t
  misc_feature (502)..(502): n is a, c, g, or t
cntcgaccggtcacngggtcagggaagttctgnggtacccctcactcaagctccaggcgtcnggaaaggaacattccangaagtccatctggaagacggtcctttccctgctgccccccagcttctngaacattccctggaaacacagcaagtgttcagtattgttcatggagtgacagatgtctcagccaagaaggctcagcttagggaccgtnacctccaggaagccttcccaacctgccactgatcacttcttcttcttctctttgggattatcacttgtattgtaataaaatcttgttttttttctttaaaaaatattatttgcattcagcaaaattcaccctttttgatatacagttctgaggttttttttagttctataagttttgtcaaatatgtaaagttgtaatctccaacacaatcaaaatataaaacaatttcctcacccctccccaattcccttatgctcttttgtatccaacacttcttcccactccanccctggcaaccacggatttgctttctgtctgtacaacactgcctcttccagaatgtcatatataaaatcacgctgtttataaccttta

SEQ ID NO: 602028 - DNA, 551 bp, Homo sapiens
gccctggtgccagtgcgctcagactcgggcatcccctgtgctcgcccggctgccacactcattcgacagcccgtgccttcgatcgccgacagactcccctgcttgctcctcctcctttccccagccacgcactgcggaccatggctggacagcgcccagcgacgagcggaacaccggaccggaggccggggtgggcaacaacgcaggcacgctcgtgcctgcccacttgccggtccggtccgtgactccgtcagaccacctacaggggcgggcgcgcatggtgagcgtaccgggtccgacggctggcagcgaagagtgaggacacgtcaagaggcagaccactaggtacagaattactccgaacccggatgccacgaccccatggaaacgcgaacgctcagcgacagacgccgaccatgaacacatacggcgagggagaggcaaaggaagcacaccacacgagttggcgtggaaagagaaatacgaaagactgggagcaccgctcacaaccactgggaacggcttgcacagggaaagttggcaaggcacga

SEQ ID NO: 602029 - DNA, 1162 bp, Homo sapiens
agtggctgtgcccagagaggccgctctccttcagtaaattgtaacacatgtctgatggcactgtcatctgtggcatgccttccctagtgtgccaactgccatgccttcgtcttctgaagaccaacactccatgcctgctgccatgtctggtgacttgtgtcgccctggctgctgccgatgaactgctccactttgccatgcctgtgcccctctcttgcctctgtgtttcaccttcttgtttatgttggctgatcacatggcactccatgcatttagtggtgttgtgtagcttgactgctcccatgtggtgttgccattggaagccacattggtgatcatgtggttgacagtgctacccatgatctcgcatccatcgatgtgtgccctagcatcttcccatagtggtatgccttcttgtgcccaatggtcctgtcattgacggtggatcttgcgtcctttaaccccccccatgttgcctttgcgctgatgcggcatgtgttccacatgccatcactgactgcctttgccctgatgttggactcttgctggaccatgtcccctgtgtgcctctccttggccccttgcttgcccatgttgatggcgctctctacggcgtgcggttcacttgtgccttgggccccgagtcaatgcccccaccttgcattcggaccttatgtgcccatagcagacgggcctggtcccggttgctgccccccagtccctcggatcctggtccgctgccccagggctggacttgatggcgcacgagtctgcccctgtccgctggactggtgaccaatctcctgattgggggccctgaccgcttcgcgatcctgagggaatgcctgccgattacaagcgtatagcacctccaagcgacctgcatttggcaccgcatttgggccttgcgcagctacactgctagctccttgtccaaggtagcttcaaatgtccacaatacttccttcaggaaagagtgcctcaagtgtgcccagtggccactccgtaagggtgacaacactctatgctggtgccccacgaatattcctgcaaggtatgattcccccactgttcatgtcgacacctttagcagattatgcatatgacctctccctcattatatacagatacaatgcaacacgagccacgtctacatacctaa

SEQ ID NO: 602030 - DNA, 507 bp, Homo sapiens
  misc_feature (3)..(3): n is a, c, g, or t
cgntttacattaaggaggtgtagataagggtgttagctccttcatcagtctgagggtagcaaggacagttccactgcagaagcagtggcagagaggctttcagttgcccctggaggctctctccagggagtggctgagttgctactggctcaacagttctggtagggggggttaggtagaggtccaggcctgcaagacttgcctagtgagaagatataggaatgggaacccaggtaacagtctggccacttttccatagggctgctgcagtatgcccagggcccgctccagtctctagtagcctcagattttccagtacctggagttatcatcagtgaagcctgtgaaacagcaaagatggcagcctaccgctccctttggaagctttgccctagggaggtatgaatgaacttgttgctggcccaaacacacctgtaggaggtggctggagaccccagtttggaggttttgcccagcgaggaggaatggcattgggaaagtgctcaa

SEQ ID NO: 602031 - DNA, 196 bp, Homo sapiens
tacgtttcgcaagtctagaggatcgccatgagaaggactctgagagtggtggtggcaaggactgagtcaggcctgtgaggtgcagagtgcccagaaggggagtcaggatgcccaggtgcactctggctctggctgcattctgcctgtgtgccctcgggctgcagtcaatgcatttcctctggctgtcagtttgcct

SEQ ID NO: 602032 - DNA, 336 bp, Homo sapiens
ttttttgagccgtagtcttgcgctgtcacccaggctagagtgcagtggcgcgatcttggctcactgcaacctctgcctcccgggtcaagcaatgctcctgcctcagctgcccgagtacctgggatcacaggtgtgcaccaccacacccagctaatttttgtgcttttggtagggacgggatttcaccgtgttggccaggctggtcccgaactcctgacctccagtgatctgcctgtctcggcctcccaaagtgctgagattacaggcatgagccaccacgcgcgtggccaaggatgctcttcagaccgctcctgcagcaggctttttcggtcgacg

SEQ ID NO: 602033 - DNA, 323 bp, Homo sapiens
  misc_feature (77)..(77): n is a, c, g, or t
caagcagttaatacagactcaactgggaatcaaagtttcaaatcccaatggcaccactggaaagaatatacccttanacaagtcactttaatctctagaagcctcagtttcctcaactatgaaatggcagtaaaatttatacaacctcacaaggttctgctgacaattcaagacaaagcctgggagagtgttttgtaaacaataaagtgctatacaagcaagagacatttactcctccgtgcataaccctgaacagcgactggtacgtcatggccgtttaataaatgttttatgagtgataaatggtctgtattaactgcttg

SEQ ID NO: 602034 - DNA, 275 bp, Homo sapiens
tgatgtccttgagttgtgaataattcgttgtacatgagaacatttctatgcatttaagccagaaacgaggtacttggctgtgtgctcttctgtcaatcaatgataatgtgttttcacatgtgtgtctgtgcaagtaatataacacattatttgttttattcaggcattatactgcaccaaagtgtttgtacatattctatcggtatatatatcttttcccctgttaaaggatttatcccattgcttctttttaataaaatggttacaatatatca

SEQ ID NO: 602035 - DNA, 403 bp, Homo sapiens
  misc_feature (5)..(5): n is a, c, g, or t
cgtantggcgaaaccccgtctctactaaaaacacaaaagttagctggacgtggtggtacgcgccgtagtcccagccactgagtagaccgaggcaggagaattaccccgaactcggagtgcggaggttgcagtgatgctgaaagcacaccactgcactccagcctgagcaacacagcgagaccctgtctcaaaaaaaaaaaaaacgcggcaataagagtctggggatgtcgcacatttggttgtgtgtgcattcagagaaggcttcccttgggaagggcaccctgtaagggcagacctgcagaagttgaggcaggagccatgtgaatatcggggggagcatgactcaggcagaggaaacagcctgtgaaaaggccctgaggcagaatgtcttcgctagagtggg

SEQ ID NO: 602036 - DNA, 957 bp, Homo sapiens
atggtacatgcagcgcaagtaggtctagaagacgcttacttcccctatcatagaggagcttatcacctttcatgtatgcacggcccttcataatcatttcccttatctgcttcctagtcgcatgtaatgccactatttacctggacagctcacaacaaaaacataattaagtagtaagcaatctcagaggctctggaattagacgaccgtcttgaacaatcgtgcccgtcatcatcctgagttcctcatcgccttcccggattcgcctacggcagtcctgttacataaacagatcgatggtcaaacgattccctcccttaccatcaagattcaactgggtcatccgaatgggtcctgaactcggagcgattacaaccgtactagggtacgaattaatcttacaagctgccatacaattactgtgccctcatttaatactctagagacaggtgacgttgcgtactccttgggtgtagaccagtccgatgtaggtagtccctgattgatagcccccattcgtgatacatgttaccatctgccaagtacgtcattgcattctaatggagcttgtgcacctggattagggttattaatcagattgctatctcggacgtttacctccataacatttcaccggtaacacgacgggggaatactacggtcaatgtctgaatctgtggagcaaaccacagttcatgccctccgtcctagaattattgccctagatcttgagtaggggccgattactatagacgctttaaccctctagagaaaaacgccggaaacagagcactgggggcgcgctagaaggctcaaacatcggggggcaaagggagaatgccggctgcctgacgcattctcggggttcccaaaccggccgtcaaaacaggtcggcggtcaaggccagtccccggcggcctcaacgcaaccaaagagcagcagcagccactcctcccc

SEQ ID NO: 602037 - DNA, 103 bp, Homo sapiens
aattcaagcttctaacgatgtacggggacatgtttgggtctccggccagggcctagggctaggccatgcacccaatgggtgcacaataaataacaggtcaaca

SEQ ID NO: 602038 - DNA, 810 bp, Homo sapiens
  misc_feature (39)..(39): n is a, c, g, or t
  misc_feature (75)..(75): n is a, c, g, or t
  misc_feature (81)..(81): n is a, c, g, or t
  misc_feature (86)..(86): n is a, c, g, or t
  misc_feature (101)..(101): n is a, c, g, or t
  misc_feature (157)..(157): n is a, c, g, or t
  misc_feature (160)..(160): n is a, c, g, or t
  misc_feature (163)..(164): n is a, c, g, or t
  misc_feature (180)..(180): n is a, c, g, or t
  misc_feature (219)..(219): n is a, c, g, or t
  misc_feature (242)..(242): n is a, c, g, or t
  misc_feature (253)..(253): n is a, c, g, or t
  misc_feature (282)..(285): n is a, c, g, or t
  misc_feature (287)..(288): n is a, c, g, or t
  misc_feature (300)..(300): n is a, c, g, or t
  misc_feature (309)..(309): n is a, c, g, or t
  misc_feature (323)..(323): n is a, c, g, or t
  misc_feature (341)..(341): n is a, c, g, or t
  misc_feature (441)..(441): n is a, c, g, or t
  misc_feature (523)..(523): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (541)..(541): n is a, c, g, or t
  misc_feature (548)..(549): n is a, c, g, or t
  misc_feature (648)..(648): n is a, c, g, or t
  misc_feature (685)..(685): n is a, c, g, or t
  misc_feature (699)..(699): n is a, c, g, or t
  misc_feature (701)..(701): n is a, c, g, or t
  misc_feature (705)..(705): n is a, c, g, or t
  misc_feature (713)..(713): n is a, c, g, or t
  misc_feature (717)..(717): n is a, c, g, or t
  misc_feature (720)..(720): n is a, c, g, or t
  misc_feature (724)..(724): n is a, c, g, or t
  misc_feature (732)..(732): n is a, c, g, or t
  misc_feature (782)..(782): n is a, c, g, or t
tttaaaacagcttgtctttcacagtagtaaagctttggnaatacagtataaaaaataatcacccaccataatgtngtgacnaaatncctcttatcaactgnatactaagaattttaaatacaattaaaaaagtataaaaatactaaaaaaaattaanaantannaggtaagagcaaaganatttctagcgcgcaattactaggcctcatttgcgcccancgtgagttttgtggatattttanatatcacagtngcgggatcatgcttgttcctacagttttnnnngnnggggggttaggnggggggggnggtgtttgggtgantttcctatttaaaatttnggtcatatcatttcaaaacatttgcatcttggttggctgcatatgctttcctattgatcccaaaccaaatcttagaatcacttcatttaaaatactgggnggtattgaatacttcgaagcagaacaggcaatgtgcagccctcatttatgagaaaaccctcaggaaactcccagggtgatgnttggngangcngtgggtngggctgnngctggagaacttcctccagagcaaagggcttaagaaagaaagaagaactctaagctgggtctgctaacatcactccagtttagatggatcttggcaganagacatgcttgttcctctggattggaagatgatttantctcgggaatcttntntgtnagcctgtncatntanaggnttgaagcnctctattgggcaattaacattagtgtttgtactctgatggaatctctganaatactggttgtaggactggccagtagt

SEQ ID NO: 602039 - DNA, 1308 bp, Homo sapiens
  misc_feature (329)..(329): n is a, c, g, or t
  misc_feature (355)..(355): n is a, c, g, or t
  misc_feature (385)..(385): n is a, c, g, or t
  misc_feature (485)..(485): n is a, c, g, or t
cttgctgctggaataagcacaattgctcgtaatatccgcgaaccggaattgcagaatcgctatcccttactgtagtggcgacacactgctgcgctattggactagcaggcaccacacatactaacaggagtactgttggcgtctgccctgagagtagaggagtttggatctcgtagcgacggcgaaacgggtatgcccgcacagagtaggagagcagtggcgggaacgcaggacgctccaggagaggacgcaaacggttgacacccgtacctccgttacaagtgcagctggacacgtacacaatatgactgtcttagtataacccaggngtcacatgtataacatttactagagntgtaatctcatgaacatgcatgtcctcgtntatcgggtggctcgactgggatggtccaatggacctactatgcaggcaattgcctagccagtgctatcgtcgagcgttggtgccgcaacagtccataagncgtcctctggtccacgaggaatgcgagtgccagaaatccgcgcgtcgtgaccgtgtgtgcagtcaagccccagtgaagcctgggtgcacacgactatggcgacaagtatagcggacaacgtatcattcggaagggcacaagtccattgcacttgggcacgacaacgaacgagaactcgcatttctacgtttgttgtcgtggggggcgtttggccccctttggggttgcagggcctatagttacccatactaagctctaatagcgcagttggggtggcgccacggttcccagatccagaaatttgttgcacggaattcgcaaacgcgaggacacatgcattcccactgtggccaatttgcactggccttcgtttagagctacggtttccttttagccgcccaaaaacctgggtagacaggggaacttcctgaagaaaaacgaagctgtcccattggcgcacgggcacggggctttggtgtcccctggaaagcgcaattgtttcgcacttgtggccttccaatttgccgtgggttggaaccacccaggactttgacgccaaattaaggaacctcacccaagggccgaaaataggacagccttggtatggccacagtgggtgaaggtcctttcagtttgccgttaagaaggccaccttggaaggacaactggtttgagcccaaacacaagttcaattaatggcttgaaccaaagtttccaggggcttatatgcacaggcgtggcctaggacaccatgtgtggttgtgcgcccccaggacttcaatgggcgtgcggtccacaagggtgaaagggccaattaccaaca

SEQ ID NO: 602040 - DNA, 327 bp, Homo sapiens
tgtggtatggattgagcaatcttgacaagtgcagctgtaggagcgagtctacaccgatacttggcatcccctgtcgtctaaattcagctagtagagataccacgttaacatgtgcttgtaaaaaatacttatatggttttgaggagtactgtagatcagctcaacattgtatttcagagtgggattgccagagaaagttgttgacaagcaatgtaaggagtgtgagagatgtaaaagaaagtgacagttaaggaggaaaatgaaacagagatcaaagaaataaagatggaggaggaaggaggaaggttggtagggtaggaaggttgt

SEQ ID NO: 602041 - DNA, 206 bp, Homo sapiens
caatgatggtcctcagtctactccggaggctgaggtgggaaaatcacttgagcccaggaggttgccgctgcactgagctgtgatcctgccactgcactccagcctggatagcagtaagagtgtctcaaaaaaataaaaattaaaggctggacgcagcagctcatgcctgtaatcacagcaccttgggaagctgaggaccatcgttg

SEQ ID NO: 602042 - DNA, 266 bp, Homo sapiens
gggatactcattaggaatggtcttttggtgatatcattactgttgagtttggagaatgattaatctttttggtatacaagccattggctggatatatgatggctaatttttaaacaaaattggttcctttttcaattttaatttattatttatttatttatttatttatttatttattttggagacagctggtggcctaggctggagtgcaatggcgtgatctcggctcactgcaacctcggcctcctggttcaagcgattctccg

SEQ ID NO: 602043 - DNA, 441 bp, Homo sapiens
cagaaacggtgcttgcgccaagggacgtggtcctgcgctcgcggggtcaaggaggcgctgccgttgctagccgagacaactccggaccacggtcgtcaccggaggctgcttctgctgacgatactgatgctcctgctgacgactggagctgtacatggctgggcgacagaggataggccacggactcgcgaagaggactgccacttgtacgcggctggacatgagtactcgagagaggcatacccggtatcggtcgccgaccactccctgcgacctaagcaaagccaatatatgcaagacagagtcctactgaggaggaacagttgacagcgatggagatagtaacgagctgtagctaactgaatatcgagggtacatgcttgggttgttatacacagtcgatggcacatatgtgtgctcaactcagattataggtagggg

SEQ ID NO: 602044 - DNA, 132 bp, Homo sapiens
tccataatgtgtgccaggtgttctatctggcaactctaggaactcttaagtattattagtgagaactggtatgcaatgggccaggaatttaaagaaatgggggactacatttgcacacaggtggaaacagag

SEQ ID NO: 602045 - DNA, 260 bp, Homo sapiens
  misc_feature (1)..(1): n is a, c, g, or t
naaggggaggcacgagccaggtcatccttacaaccccgtacggcagccaaactctcaggacataccgccgggtatcaccgttaccaggacaaagagagctcccacctccaatctacggaccggacactacaccaacttctaatcggcatcccagcacatgcctcgggccaaacggagtctgcctcacactccatcccagaagaaacttcacataagtaaatccatccatctttgacaggttctacacctactattccaac

SEQ ID NO: 602046 - DNA, 1231 bp, Homo sapiens
  misc_feature (425)..(425): n is a, c, g, or t
  misc_feature (831)..(831): n is a, c, g, or t
catttaccatctcacttctaggaatactaggtatatcgctcacagctcagtatcctccctaactatagcctaggaagggaagtaagtactatcgctgttcatgtatagcatactctcattaacacctcaacacaccacatcgcctctttagccaatattgtgcctattgccatactagtcttagcctgctgcgaatgagcggtgggcctagccctgactatgtcgtcaatctgccaatcagcagtatggacctagactacgtagcataaccgtaaaacctatgtccatatgctaagaactaactcgtcccaggcaatgtatattactgaccatctgagcaatgagcttgtccaagaaaagcacagtaactttgagatcaatcagaaaccacccatcaggcctgaattagttagtgcatcatcccntctactagtgttgtttaagccagagatcagacaacaaacctatttagggctggttcccgcagagcttttgcttccgaacctcgcctaaggaacccccgctcctaattactagactaacctgacgtcctaaccccatcagcagagtcatggcgcagccaacgccacttatccatgtgaagccattattcactggaaaaaatactctaaccgtcgtctaatactaaatctgcccgtacagaattctccttacttgataaacatttcgccaggccaccgggaaggctcaatcatacttcgggacaattgtcttcctctcgcaaggcccaccgtaattccccaccttgggtatgtctacctctacccgtatttatgggggaaccccagtccttgaaaaagcgccgcatanaggcgagggcgcacttctgtccgcaatattctatacccacggatgtgggccccttaccctaataaataggcggagattttatacccccaaagaccctggggctcccaagacattatcttcagtcacctcacgggcacgcaatataaagcggtcgtgccccactatatagggggcagcaacagagtctttggagagcgcatctgggggcgaacatagtaaaagccactggtggccccccggcggggaatacaggggctacacgacaaggggaagaaccacaaacagcctgcaagagaacactctcgtagtatgaaccagaggaacagaaagtagctgaccgcgcgaacctcttcaaaacaacctcctctctcggcggagcaacacaggagagggggggggt

SEQ ID NO: 602047 - DNA, 405 bp, Homo sapiens
accatgtccatgcgaaatgaaaaaaaacaactttaaaacataagcttgtgctggctgggtgtggtggctcacgcctgtaatccctgcactttgggatgccaaggcaggtggatcacctgaggtcaggagttcaagactagcctggccaaaaaagcgaaaccccgtctctagtaaaaatacaaatattagccagatgtggtggcacgcgcctataatcccagctacttaggaggctgaggcaggagaatcacttgaacctgggaagcggaggttgtagtaagccaagatcgtgccacctcactccaacctgggcgacagagcgagactccatctccaaaaagacacgagtcatctgttgtaggtaacataaaacattgcaaaaagcatgatccagaaatatcacgg

SEQ ID NO: 602048 - DNA, 372 bp, Homo sapiens
  misc_feature (20)..(20): n is a, c, g, or t
  misc_feature (72)..(72): n is a, c, g, or t
  misc_feature (281)..(281): n is a, c, g, or t
  misc_feature (289)..(289): n is a, c, g, or t
  misc_feature (324)..(324): n is a, c, g, or t
  misc_feature (357)..(357): n is a, c, g, or t
  misc_feature (359)..(359): n is a, c, g, or t
  misc_feature (368)..(368): n is a, c, g, or t
ggcttagactcgctgcacangaccagcgtcagccagatttcggtgctcaacggcggcaaggccaagtgctcncagttttgcaccactggcatggatggcggcatgagtatctgggatgtgaagagcttggagtcagcctttaaggccctcaagatcaaatgacctgtgaggaatatgttgccttcatcctaactcctggggaaacggggaaaggggtcagggaggctaatggttgcttttctgaatgtttttgggggaccaaaacaagttcccctaggggntgctcccncaaaaaaggagggggcaaatggggagctttttttncctattcaaggaaaacgggccttttttttaaangntttcctttnttga

SEQ ID NO: 602049 - DNA, 140 bp, Homo sapiens
ccccgcttatctaaggatccctgttacccacaggtagcaaaccagtctgccaccaagccagccaccacttaagcccagggtttaatgatgtcctcgtgaagtcctaggtgtttgaaataacagaagaacagcgccgaaac

SEQ ID NO: 602050 - DNA, 404 bp, Homo sapiens
tgaggcaggatctgtttatgtctcctggctggagtgcagcagcatgatcaaaactcactgcaactttcgcctcccaggctcaagcgatcgtcccacataagcctcctgagtagctgggactacaggtgctcaccataatgcctggctaattttttgtatttttttgtagagatggggttttgccatgttgcccaggctggtcttgaactcttgggctcaagttatctgcctaacttggcctctcaaagtgatgggattataggcatgagccactgtacccagtcaggatgctgaattctattaaatgctttttcagcatcaattgaaatgatcatatggtgtttgtccttcattctgttattatcatgtatcacattaattgattgatttgtgtatttgagtta

SEQ ID NO: 602051 - DNA, 155 bp, Homo sapiens
agtcaagatgaagaaccattttcttttcttggggagtcctggcggtttttattaaggctgttcatgttaaagcccaagaagatgaaaggattgttttttgttgaccaacaaatgtaaggtgtttccccgattatttccaggatgcatcctttctt

SEQ ID NO: 602052 - DNA, 218 bp, Homo sapiens
ccagctgctgctcgtggtcgactcgtagagcatcctctgctgcttgtctcctcggaaagagtgatttgatatctggaaattcccatcatctcagcctcacaatatgccttaagctgattacgcaacttcagcatagtctcaggatacataaatcgatgtgcaaaattctacaagcattccatcacaccaacaatagacgaggaggataagcagcaggc

SEQ ID NO: 602053 - DNA, 298 bp, Homo sapiens
atgctgtggcgatcctagaggatcccccgacggtgcttacaacaatcaagaataaactgtctttataagagcacagtgaccagaaattaaaactcttcaatccctctagccctggggactacttgctgaagtaggtgggcacgtgaaattgtaagggccgattttgagacataacaatagttcagagcttatctgttaaactagacgttaatatcagaagcacactgctgcaaggccagcatctgggcccccgtgtcacgaataccaggctctcgttagaatattgatccactcttta

SEQ ID NO: 602054 - DNA, 186 bp, Homo sapiens
  misc_feature (36)..(36): n is a, c, g, or t
caatacttgggtcatgttactgctgtcagatgtatngttccttacataggacatcaatgcccagatgcaactagagattctcatactaagaagtaagtcagacaagagaaaggcaaaaaacatgtgatattacttatattgtgaaatctaaacatatggcacaaattaaatctacccttacaaaac

SEQ ID NO: 602055 - DNA, 246 bp, Homo sapiens
gctcgtacctgctactgggcgtatggacagacagatggagtaatgaggaaacatatttctcactcttttctttgttctttttttcttccttccttggtctttcttttctttttttcctttatttgtttacttatttatttatttttttgagacagagtctcactctgtcgcccaggctaaagtacagtggcgtcatctcagcttactgcaacctccgtctcccgggttcaagtgattctcctgcct

SEQ ID NO: 602056 - DNA, 91 bp, Homo sapiens
tcgatacgactttttcttcttccacctcagccacttcttcctcctctgctacttctactactttgtcttcactcccttctgtcgtcttctc

SEQ ID NO: 602057 - DNA, 1163 bp, Homo sapiens
  misc_feature (1152)..(1152): n is a, c, g, or t
tgtgcgggcagcaaacttctcagacatatatatgtgagatccatagcgtctgatagtctcaggctgctggagggaagagagacctgtgtgtttggagcgccaggcatcacagttgaggataggcgttgtcccaatagctgatgagagcgagctacaataacaacggagacgcaactttgcctcccatggggctgtacaatcttctgcagtttgtcgagttggtatcagtcagtgaggttgcccagaagagtgtcgtaagagttgtaataaaccatatttggctgcggagatttacaaagggctgtatcacgactatgagttgtttcaccaagaatacggggacagtggtttgactccgccagtttgcaatgctagaggggcctttctggactctgtaagtagttcacgttttggtggctatatacgccgccgattgacctgagggatacactgtgccaggtccttggcaaccaatgggaacctattagaggctacccaggactatatccgtgctctgctaagggaattagtggctatctgtgcacccttctttttaacaagtcacatattgcagacctgacactcaaagagtggctaagctacacaagagtcccatctaattttgtgcaacttccgtgtggccagtgtgtattaccccttccaatatcttcacagatagtcaccagcgtcccattctcataggtctgtctccctcacatcctgttaggtattggcaccagtcacagacaccacaaagcccatccgggtgcctcatggggcagggacatacttctaccccctgggtcactgtttcccgtttttcccgaggagagccctttttcttggatctttggccagcttttatgcagtttatttcccgccatcctgggaacagttgtcgagtggcaaaatgtcctgcggagaatacgtgtgtgttttaacaccaccctcatgggggtgcgaaggcgtgtcaaaaaagcgtggtgctcggtgaaagaaaaaaagcaaggaaggcaataatgagcgtgacgacgaaatactactcgcaagaaagacataaacgtagtggagtacgatcagcacgtattcgtctgctgctgctttcccgctttgccgttatcaactgctagatatcattattctctcgctggngggggggtttg

SEQ ID NO: 602058 - DNA, 397 bp, Homo sapiens
  misc_feature (24)..(24): n is a, c, g, or t
  misc_feature (42)..(42): n is a, c, g, or t
  misc_feature (52)..(52): n is a, c, g, or t
  misc_feature (105)..(105): n is a, c, g, or t
  misc_feature (128)..(128): n is a, c, g, or t
ccccaatattatgtccatttgaanccaaaaatatacctccantttgccgccngcatttggccatgaaatacttgacacaattaattagtcagaattaatttttantgcctatgttaaagacttttaantcttcctttgttttcgtttctcaagctcatcactgcagtggtgatgaagaactggaaagagattgttgagtcttgtgatcttaaaaattggagagaggctttagctgcagtattgacttatgcaaagccggatgaattttcagccctttgtggtaagagatgtgctttatatttaactgcatttacatacgtggcagggtatattgtaaataaacttaaatgacaaattttattagaaactttttaaaatctacaaatcacaaaaaaaa

SEQ ID NO: 602059 - DNA, 393 bp, Homo sapiens
  misc_feature (93)..(93): n is a, c, g, or t
  misc_feature (103)..(103): n is a, c, g, or t
  misc_feature (127)..(127): n is a, c, g, or t
cgtatacatctagatgagtatatattaaaacattttttaaaaatgagatcaaaataggccaccacgcccggccataatctgttcaagtttctnagttgtagtngcctccatttctttataaaatgangccattcaacattttaagtataaggtttagtgcaatgagatagggcaagttcttaggttaaaagttaatgttcaaatataacatctattttttctttcctgcagcaaaccaagaggaagctagatgatgccagcaaacgtttggagtttctgtatgataaacttagggaacagacagtaagttttggaggaggatttatgataatcatttattcctagttgctagtcagttgtcttatcagcactcccatttagtatgctgggggc

SEQ ID NO: 602060 - DNA, 798 bp, Homo sapiens
  misc_feature (601)..(601): n is a, c, g, or t
ggagatatgctggaaccagggccaaaggttgcagtgagccaagtcgcgccactgcactccagactgggtgacaggcgggaccctgttccgaaaaagaaataaatctggcccaaccttgtcatgatttaataaacccaacacaggcaagatccatctcagttgaataaactggtactaataaatttataaaaccactgaaaaagttctgaacaagacccaaactcaaggataacctaaactggaaaaagagagaacaaagaaagtgaaactgtggagccaatatttttaaagatgttggacaacaatgagaaattgttaagtaaaatatagcataagcatacaatgcaccatacatggccattggaaattgtgttagagaaatggttttcttctccaaatcccaatagggcattttttttcttctgattctatggttgacccaataggccactgtatttgacttgataagataattttagaatgcacctaagctgggcatagtggctcacacctgtaatcccagcactgtgggaaggcaaggcgggaggatagcttgagccttagcctcccaagtaactgggattacaggtgtgtgccaccncgcccggctactttttgtatttttggtagagacagggcttcaccatgttggccaggctggtctcgaactcctgacctcaggtgagttgatctgctcttgcctcagactcccaaagtgctgaggtggcgaatcacttgagctcacgagttcgagataagcctgagcaacatggcaagaccctgtctctataacaaagt

SEQ ID NO: 602061 - DNA, 309 bp, Homo sapiens
  misc_feature (18)..(19): n is a, c, g, or t
  misc_feature (23)..(23): n is a, c, g, or t
  misc_feature (29)..(30): n is a, c, g, or t
  misc_feature (33)..(33): n is a, c, g, or t
  misc_feature (35)..(35): n is a, c, g, or t
ccgactctatgaggatcnnccgnctcagnngtncncagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaactcagactgtccaagacgaccctcctgttttgaacggagctcagaaagagaggaagaagcctgaagacttgatgcgtgctgc

SEQ ID NO: 602062 - DNA, 630 bp, Homo sapiens
gcttcggtgctgacgtcaatcgcgtctggttaccagcgcgccgcgggcctgaactcggggggctggcattcggtccggggaacacgcggagcaagtctgcgaggctagagtgtctccgcggcgcagctcgcggctgaaaatccggaggagaatgcgagagctgctcggataggccctggaaaacgaacagatggagcaggctatgctgaatggagaggactaccggccttcgggaaaggaggtgaaagccagccagcctgctaggaaatcgacggggacaggctcgaccgaggttgcccctagatttatcgatgggccatacccaataggcagatcagtgattggtgattggcgttgtaggatcggccgatggcatttgaggggattcataccagtggtagcggagacttggggaggaaatacaaccatagggaaggacctgaggggaagcgttgggggccggagcgatccagtgcgtagcgtattgcctatccattgtgatgcgtacgcccatcataacattaggagatcgaaacgataagatcgcagtggattgacgcgtcgtccttcgcgtgtttcacacgtagggatatcatccatcgagcataaatgctcgcgagagccgcgggg

SEQ ID NO: 602063 - DNA, 270 bp, Homo sapiens
aaagacaggttctacttttgtgccaggaatttagatgcgtcactttctttgatggcctgctcttcaagcacaggcttgtgtttctatttccttcttttttcatttcccataacactacttgaagtttcaacagacatacaatgagaacagtgtgcaacttagctcatcttctactcgccaaacgctatctgatatatttaaatgtctcgacggtacactactcagatgtcggattcagtggagtgtttcctctaaagcgctctctgcacg

SEQ ID NO: 602064 - DNA, 385 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgacaggcatacagctcaactttagaggacgggcagtctgtagaccagtgttggaccctaacttacgtgataaagtgatgttcgaggccaggatatccaccatactgggatgataggcatgcgctggctggaaccacagatcagatagttcgctcatctcaaagcaata

SEQ ID NO: 602065 - DNA, 1014 bp, Homo sapiens
  misc_feature (57)..(57): n is a, c, g, or t
  misc_feature (73)..(73): n is a, c, g, or t
  misc_feature (128)..(128): n is a, c, g, or t
  misc_feature (211)..(211): n is a, c, g, or t
  misc_feature (215)..(215): n is a, c, g, or t
  misc_feature (228)..(228): n is a, c, g, or t
  misc_feature (241)..(241): n is a, c, g, or t
tggctgttaaataactttaagggttgatgtgggagtcacaagggaggtatgttggcnccaagggttcttcagngccatcctcaaagctggttagtgcagggaggtagggcagagtgggttccagtttncttccaggaagggtttagggaggtcccagcgagccccaggaatgagtccctcggtaccatggcaaccacaatttaaaaggggnttcngcccaccccgtgnagcctaccccagntccagcagaggaacaggaggccagatgtggccaactgtgctatagacagcgccgtatccagagcccaatgtgcgcattgggctcattttctctttgtgggcagattctattgccagcacctttctcttctcacacggggtgactggagccaagtgtgcgaggttgggccttggcgtgaaaaggcctcgggatccggggggaatcgcgtgagagttggaaggggggcaaccgaggcaagccctaggggaggtggttctggggggacagaattccagggaaacaggttcggggtctcccccagggcaggggtgtgggtccagtctggggctggggccactgaggcaggcgacaggggttaggcagggcaggtggttctgtaaacttggccagccagggtgggggtgtctccagccttgcgccctcccgctgggtcaaggatgtctggcaccgatgcgatgttatcaggggctcaatagccatgtcatggtccaaggacccctgttttggcagggctgggggggaaccgggaaccgggagtcacaggcaggatcaacacagccgtggtccatggggtcatgtaaagaaaagggggcaagagcccccaaacgacgctgaagaggccccgagataggcaaaaggggggacacgaaaaataccaaacagggacgggaaaagaaaaacgcgcagaaagagagaaaccacgacgacaacaccacgtgaagcaataaagagacgcacacgaagctacgagaggagagatgctgtagaaacag

SEQ ID NO: 602066 - DNA, 2586 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 602067 - DNA, 1983 bp, Homo sapiens
ttgtcccggttggcttccatgtggactaaagccagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 602068 - DNA, 2625 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 602069 - DNA, 2678 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacaggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 602070 - DNA, 3059 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcctaaaaaaaaaaaaaaaaaaaaaaaaaaaattttgggggggccggggccccgaaaaattttttaaaccctttgtgtggggggcggggccccatgttgtatggaccctggggccaaggggtcccaaggaaacccggtcaggaataggctgggtgttccccccaaaaaaccgcggcggacccgagcgcttttgcgaaccaatgggagtgccggttggggtcccttagggccctcttacaggacccttcgaggccagattcgttcacaacccccgcggtgggtgaaacgcacaagacagagacagtagcacaaccaaagacgaacacgaagcaaaacaagacaaaacccaacacacattacaacgaacaacaacaaacacaacagaacaaagacacaactcactgaagaacgaagagctcgcagatgacgccaaccaacaatagagaagaaagataaaaactctaaactacaagagaat

SEQ ID NO: 602071 - DNA, 871 bp, Homo sapiens
atcctcagggggtggagattttacaattaccatgttttggtgccctctcccttgcttcatcaagcatcagtcatataataccacagatttgaactcctgcccacagagggacctcccatctcctggccctatcataggatcactgggcctacctgcactgtggggccaagccctgtctttttcccaagccctctaagcacacgcatgagtgttcatcccgacttggatagggggctttatcacccttacaagatggcaaaaagattcacattgcttttttaacaaatttgttactttcgtacaaaatcccaaccttggatacgcagggaggtgctgcgacggggtagagtcaacgaaagagttgttgaggaacagtaatttaccaagactgccctctgtgggactgtatttcaagaacaacacactggtggggcttacctctcaattcacaatgtactgccctagcttctccccatctccggattgagctcatccatacctgcctctgttccatacgcacgagtaagaatgtggcagaacagttgctagggattcctccattcaatctttctcagaaaaaagtccggtaagacaatccaaatcaggggaaggttcagcgacgtggtcaccacgattaagtgacgcacacgcacataggcagcaccatcactggcacgctaacgcaacctgcagcccaaagggatccggcagcccgaaaaggaggaacagaaccggcaaagggcagacagagcccccccgatccagaagcctgcgagcagacaacggtgatgcgcggggaatcagaaaggagcacagcccgaggcgcgcaacgacaggcacgcgcaatcccagcgcgagaaccacggggccc

SEQ ID NO: 602072 - DNA, 1007 bp, Homo sapiens
aagagtgcattagaaacacacattcgatgctcatctccagtaggtacttggatcctgaacatagatgaaactgaggtgatctcgctcatccctgagaggctagctggctcaccaattagaagaatgcctcgccggaggatgcgtgacgcgtgactgcggaagcacgtcgcgagattgagagtccattgggcggtcattcactcgtgagtcctaatcaacatggaggttgccaccgcggattctccgatagtcaagagttgtagttcccggcggcctttgtttggcttggcccttggcccccaaatgtgtgggggggtacaagtggttgccttgttcccccaattggcttaaacaataccctgccttaggctcgctttgtccaccattttcttctttttgtattgtccctctataatttctcttcgtacataactaaccctaaaacaaagctgcgcaaacactacgtctcctgccagctgtgtgacacggccagttggtctaccatttgacaactgtcccttcagctacaggtgctaacgaaggggaaccaggggccgggagatttatcccttatagcacacccccccgcagtgcagacattgttgcggcaaggcttaagggcccccttggagacgcgggtcgcggacaggcgaacacgcacggggtgccagaggactgatgacactggtcgaggccggtccaggcaccacaacgggggcactttggaacgcgtgaactgatcgggtctcgccatctggaggtgtggtatgcagctaatcttcttaaccaaggacggctggattggcatctctgtccattccccggggaattcggttggtcagcctaggaataaaagccaggctggagacacgcacggccagagactggaatccttaggcgggacccaccctaggatgagcctatgtccaggagccatgcatttaggacagcgtggctaaaaagctacacacgtcgtcctgctccgagggacgaccacccaaggacct

SEQ ID NO: 602073 - DNA, 3165 bp, Homo sapiens
  misc_feature (2677)..(2677): n is a, c, g, or t
  misc_feature (2679)..(2679): n is a, c, g, or t
  misc_feature (2699)..(2699): n is a, c, g, or t
  misc_feature (2760)..(2760): n is a, c, g, or t
  misc_feature (2789)..(2789): n is a, c, g, or t
  misc_feature (2791)..(2791): n is a, c, g, or t
  misc_feature (3091)..(3091): n is a, c, g, or t
  misc_feature (3101)..(3101): n is a, c, g, or t
  misc_feature (3114)..(3114): n is a, c, g, or t
  misc_feature (3116)..(3116): n is a, c, g, or t
  misc_feature (3122)..(3122): n is a, c, g, or t
  misc_feature (3159)..(3159): n is a, c, g, or t
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcctattttatgtgtgtatagtcttttttgaaacagctgcttaaaatttagtttattttttgtgtcttaggattcctgagtaaataactacatctncnaactgctacatgggttttancagatattaataaaaatgggatcactggctttaactatataggaaaagactggacattttngttctgtagaatgcattgagcttttttcnanttgtaaatgtttcaatattctgtttgagttttaagactaaattgtgtccattttatagctagaaattttttcacctattttgtttaaattacctatagctgtgccaggcatggtggctcacgcttgtaatcccagcactttgagaggccgaagcaggcagaggtcgggagttcgagaccagactggccaacatggagaaaccctgtctctactaaaagtacagaattagccgggcgtggtggcgcatgcctataatcccagctacttgggtggctgaggcaggagaattgcttgaacccnggaggcggangttgcggtgaccnanatcacnccattgctgtccagtctgggcaataagagcaaaactntttttt

SEQ ID NO: 602074 - DNA, 159 bp, Homo sapiens
atatcgtcgacccccgcgtccggaaagaactgctgcctccaagaattcagaaaacccattttttcatatccaaatttgtaaaaagaaaatagataaaatcccgtctgccaaatccgcctctgcgcttaaagaaattaagaaatgttttctcccttttta

SEQ ID NO: 602075 - DNA, 487 bp, Homo sapiens
  misc_feature (161)..(161): n is a, c, g, or t
  misc_feature (479)..(479): n is a, c, g, or t
gtgaagagcgcgatggccttgaggcagccatactcggccgagtcgacctcaggcggccagcttgtcacctgtcctggaggcgcgcacctgtccatgaaacccggcgcgctcgcggccataggcgcggcgtggaggccggcggcggccagtagcggcgccgntgtgcaggggcagcgccgcctgcgccgcgttcagcacgaagagctcgctccagctcaggcgcagcagcgccacctggtcggccaccggcagctcgggaagaagggcccgggaggaaccatttttttattacccttgcagccgcgccgccagctcgcacacgttgtcgatgccagcaaaggagcgacttaaaaccccttgcccgaagtgttctttagcagcaagtaaaatgtcagcgcgcagcagctgcgcgatcagttcggacaccggctgccccgggaagaggtctccgccgctagacactgccgccagcgccgagnccgggggg

SEQ ID NO: 602076 - DNA, 3162 bp, Homo sapiens
acaatttgaacattataaaatcaactttgatgacagtaaaaatggcttttctgcatgggaacttattgagcttattggaaatggacagtttagcaaaggcatggaccggcagactgtgtctatggcaattaatgaggtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaaggggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaagacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtt

SEQ ID NO: 602077 - DNA, 325 bp, Homo sapiens
  misc_feature (179)..(179): n is a, c, g, or t
  misc_feature (235)..(235): n is a, c, g, or t
gaccaccatccagtcacctcccacaaggccccaccttcaatattgggaattacaattcgacatgagatttgggtggagattcaaatccaaaccatgtccttttgcttttttctgttttgtttgtggagtagatttttctccatccctttactttgagcctaagggtgccattgcatgtnagatgggtctcttgaagacagcataccattggttcttgcttttttatccaagtcancactgtgccttttaattggggcatttagcctgcttacaatcaaaggactcagtgacctttgaggatgtggctgtgaaccttcaacccagg

SEQ ID NO: 602078 - DNA, 3393 bp, Homo sapiens
acaatttgaacattataaaatcaactttgatgacagtaaaaatggcttttctgcatgggaacttattgagcttattggaaatggacagtttagcaaaggcatggaccggcagactgtgtctatggcaattaatgaggtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaaggggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaagacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatattttggtatcatgtgcctttgaaatttgacagctgatttgggtgttggatttctgcccagccatttatcagtattatcattatattcagtagctggcaggtgtattagacaaacgagacttaggtaagggaatgggaacctcggggtgatcgcatcaccccgagaaaagaccccatagaagaaaactacacac

SEQ ID NO: 602079 - DNA, 662 bp, Homo sapiens
  misc_feature (345)..(345): n is a, c, g, or t
taatattaaccaaacttagggctcttatatccaggcagtaaagtaaggaacagcaaattgggagggctacaccattcaccatggcaacagaaaagcctcaaaacacattaaagttccctctcgacgttagtgtctcgggtatagacttctttccttagacctcagggagaaacaacacattttataacgtggccttgaaggacacaggccacggcagtcctgtggcgccccacctgtgtcgagaagggcgcgaggctgtgagaccgccgcgggctctcttctgtgtgtctcaaggtctccctgtgagaaggtgtgcttgtggttagaaggggcttctcccaaagncagggctctcctgtgcggttatttttttcagggagccacctttctttttcaagccgcgggtgtagagacccccgggacagagtggccctctcttttctcagagcaatgtgtggcgcccacagcagtgttgcaacactttgttgtgccccccgagagctggtgatcacccccctttgtgatgctgttggaaatgtggtgttggggaggtctcttcttttccgagagcgcttctcctcctcttcctcttcttcctgtggagaaattttaacttcttcccaaacccctttgtgtgtggccccctcttttgtggtggccct

SEQ ID NO: 602080 - DNA, 125 bp, Homo sapiens
  misc_feature (88)..(88): n is a, c, g, or t
tcagttggtaccgacgctctctcggtgggggcagtggtctctggtggggatagccccagaagatggggactctgtgaagtcagcctangggttgacgggggatctgaagccgagttcacacttgt

SEQ ID NO: 602081 - DNA, 3370 bp, Homo sapiens
acaatttgaacattataaaatcaactttgatgacagtaaaaatggcttttctgcatgggaacttattgagcttattggaaatggacagtttagcaaaggcatggaccggcagactgtgtctatggcaattaatgaggtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaaggggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaagacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatattttggtatcatgtgcctttgaaatttgacagctgatttgggtgttggatttctgcccagccatttatcagtattatcattatattcagtagctggcaggtgtattagacaaacgagacttaggtaagggaatgggaacctcggggtgatcgcatcaccccgagaaaagaccccatagaagaaaactacacac

SEQ ID NO: 602082 - DNA, 121 bp, Homo sapiens
cttttttgatcagtgtcctatacatcgaaggtgtgcatatatgctgaatgacattttagggacatcgtgtttttataaagaattccgtgagaccaaatttactaaagcaacacaaattaca

SEQ ID NO: 602083 - DNA, 3139 bp, Homo sapiens
acaatttgaacattataaaatcaactttgatgacagtaaaaatggcttttctgcatgggaacttattgagcttattggaaatggacagtttagcaaaggcatggaccggcagactgtgtctatggcaattaatgaggtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaaggggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaagacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtt

SEQ ID NO: 602084 - DNA, 189 bp, Homo sapiens
ctggcgtgactcatattggggcttaaaatttcaaggaagggcacttcaaatggctttgcttttgcttgtacagtgctagagcgtaggaatagacccgtggcgtccactgtgagatgttcttcagctaaccagtagcatcacagtctctgcatgcaggtcattctatgggtaaacgaaatgacttccaca

SEQ ID NO: 602085 - DNA, 382 bp, Homo sapiens
tgcacgcctggtggcctacttcaacatcgagttcacacgctgccacaagaggaccggcttctccaccagccccgagtccccgtacacgcactggaagcagacggtgttctacataggaggactacctgtaccgtgaagacgggcgagtgagatctgtcggcaccatacggcatgcggcccaacgtccacagaacaactcgggacctgtgacttcacctatcgacctgtgacttcacagggccagcgtgtgctgagcttgtcctcgctccaccgcactaccgcgatgcgctagaggcccgtgctctcccgccctggacgatgcccagggtgctgagtcgttcctatggcggtttcgggagctccccactttctctcgtccact

SEQ ID NO: 602086 - DNA, 322 bp, Homo sapiens
ctcttgtagaggcacggtgccttcttgccataaatcgtgcatgtgcgatactcctcaggaggtgaccccagctttattgtcttccctgacagagaccatttgatgaggagatgctgacgtatgggacgggctagtgtatcaacagacgcgtatgatagcactgtgaccctaggagctccatgaacatatatctggcgctagaaagatcatacagcattgtcgccagcagctatacccgagccataaggcgactaggcaactgaatggaggtccaatcgtgctatacctgagagctcgacgaatggtcatcgctgatgctccg

SEQ ID NO: 602087 - DNA, 183 bp, Homo sapiens
atactgagtggacgaggtatcatcgggatacttatatacatgaggaggcatacgttccacgcggatcttttgttgacatacagcatatctacggtcctaaaggaggtggcaacaggagagctaatgttcctaggatagggaggtgtgggtctggtgaacgcctggttaacattctatggtagt

SEQ ID NO: 602088 - DNA, 415 bp, Homo sapiens
tttttttttgagatggagtctcactctgtcacctaggctggagtgcagtgttgcaatcttggctcactgcaacctccgcctcctgggttcaagcgattctcctgcctcagcctcctgagtagctgggattacgggcgcacaccaccacacccaactaatttttctatttttagtagagacggggtttcaccattttggtcaggctggtcttgaactcctgaccttgtgatccacccacctcggcatcccaaagtgctgtgattacaggtgtgagccaccgcgcctggccctggcgctgttcttagagtccatcacagacctgaactgctgaatgctattcctcatggaaactgaggcatggacatttcggcagctcccccttggatgtggcctggaggagttggagaaatcaggc

SEQ ID NO: 602089 - DNA, 347 bp, Homo sapiens
aacacaaaaattagctgggtgtggtggcacatgcctgtaatcccactacttgggaggctgaggcagaggaatcacttgaacccgggaagtggaggttgcagtgagctgagattgtgccactgcgctccagcctggcgacagaaggagactcagtctcaaaaaaaaaaaaaaattgctccagttttgtaacgaatcagcccaaacctaatgggatcaaacacatttttttggggaaaataaaaacttttttagagcccaggctctggggctcatgcctgaaatgccaacaccttgggaggttgaggagggcggattgcctgaatccagaaggggtcccgagctcgaat

SEQ ID NO: 602090 - DNA, 261 bp, Homo sapiens
actgacactctggaaaagctcgtgtctgttaatacctactaggtcgtggtgtataatagctcttgaataactctaagatccacatgttgaagtccttacccaccccctacccttttaaaagcatatgcacagtcttttcatgatttcctcgtctggctctcgtaaatcctgtgaggtcaggcgcagcatctaggacgtcgtcctctccagcaggagtagattgtttcaggctcatggccttacaacagctattttctgtaa

SEQ ID NO: 602091 - DNA, 819 bp, Homo sapiens
gacctcctggaaccagacccatgcactggacagatgctactcccctcacccgggaaagctggaatactccatgcccgagaggaagcagacggcacagggacacccctgaccaccttgaggatctgactccaagactggtgcagggtatcgagagatggattccagatggaggtcctggtcccagacacgcagcagtcctggatagctctgcagaggagacaggaacccgagcagtagctgaagcagaagccagaccgcagtccccttgccacatagaaggcgggcttctcccagcacatggtagtacccatattgaacaaccaacataccaccacgacacacatccatgcactaccagcgatcggagggtagatgaaacacaatgtagatgatcagaaaaaacaaaaacacaaagaaaactagagaaacaccacatacacatgagaacaacaggcaagcggaggttcccatacagcaccatagcaagcatatgcaagcacacgcacgcggcaagtcgaagaacccccacaaatccactggactcaaagatacatggaacgggaggcccgccacacgaggcaaataaacaaagcacaaaacgaggcgacaacaaaggcacccagaaaaaaggaaacactggacaaagacacgctatgcaaaacatgtgaccacatcaaccttgaataccaagaaggctcaacacgcgcaagtaacatagaaaagcggacaatcaacccccgacaccgcaataatagaaaccacatgagcacaaccacaacaacgaccaggggcaaaacaaagctagaaaaagagagacat

SEQ ID NO: 602092 - DNA, 941 bp, Homo sapiens
gctggctctgcgtgtcttcctgggtctgggctcggagattcacaggcggccgcgaggccgagcgatgggactgcatggccctgagtgctggctgcagggcttggctggggtcctggaggtttgacctcgcccccgagccggcttcgaggctagcctcctccaggcagctctggggcccggcgccctgctgctctgctcagtgctccctgtgttcatgtgcttgcccatcccctccccacctggctgtccctggaccgttgggacctgtgacctgtggcctcgggctgtggcttccaaagcctggcctgcagccctggctgacccccgaggcctctctgcccctgggcccctagacctctcactatgaccggggccgcgctccaacctgggggcttgatcaccgaacatcctgttgaacatgcatctgtagtgggtcagtgtcctcaccatgcccttctgcttcaaacagtgcggcatctgtcctgggggcgctgctcttggtctttctgctcatggatgacgcaccagtcgtgcatgttcttggtgaagtcggcagcctgagcaagcggaggacctacgccggctggcattccacgcctacgggaaggcaggcaagatgctggtggagaccagcattgatcgtgctgaatgcttgtgccaccttgcatccggccttctacgtccgtgatcggcgacttgcgggtccaactttctttggccctggttgttccgcgttccacgtgggctggccacccttccgcatgttcctggttggacgccgtggtcgttgtgcatcgttgcgcccggtcagctgagggacatgatggccccatccaatcttcaaagcatggcccccttctacacccgtgttgtcggaccggcccctctacaacaggcctacgtcgggaggcggcgggcacacaccctgggggtccggccct

SEQ ID NO: 602093 - DNA, 142 bp, Homo sapiens
cggagtaacgtcgctgacagctgacaggtgattaaacgacttgctgcctcgtgttcttcatcccgaaacggttatcacattctttgactctgctctgagcatgggtgccaacaacatcggaacgcttatttacatgctggat

SEQ ID NO: 602094 - DNA, 541 bp, Homo sapiens
ctgtcattgacgatcatatgtacagtggtgagggtgagtactctatcaacagcgacggagactctgaagtggactcggatctacaggaccgtgttgacggggtcaagtcctgcttggcaaacgacaagtcacctttccacggcacgttgtgaggatggcagcttagagagttctagccccaccaggtactggaagtcccttgcccctgatcggtcagatgatgagcactaccttctagacaacacttccagaccgcgatactcacacagttatttgagtgacagcgacacagaggtcattctgacggagactaacacaaacccaatgggagtggtaggcagccacttcaccctagaccctggggtagcttggcacctttcccaaaagaggagggcaccggtcctcaccacccgcttgtctgattgtatggaaacactccgcctttttctgcacggacattttaaagttaagggaaagatgagctccccaatagaacaggtgtggaaaacgattatttttattattttttctttttttattc

SEQ ID NO: 602095 - DNA, 234 bp, Homo sapiens
aggggccagagcctgtttggtgcggccttgccagctgatggccctctttgtaaggcactgcagggcctcgccctcgggcatccgcgcaggctttttttgcagggtgtaccaccattgccaggaaggcctccaggcgcgggcgccttgagcgcatacaccggggatacaagaatttggtgtcccattcccaccaggccagctgtggggatgaggagggattggccctccgaaagc

SEQ ID NO: 602096 - DNA, 134 bp, Homo sapiens
gctggcgacaggtcgcaggagagagggaactccatggtgccgccacactgggtccagctgctgggcatgcaaaggcgcctgacgtgagatgggaaagctggccagggcagcaccagcgggaagatcacgcgcag

SEQ ID NO: 602097 - DNA, 254 bp, Homo sapiens
gacggagatagagtatacagagcggtgagggatagaaggcctgggttcaaatttccagacactgtgcagcttatgtggccatcggaccttcaccctcctgtcagatggagggggtgacttcagaagatcaaaaagaaggtaagtaggccaggaacagtgactcacgcctgaaacgccagcactatgggaggcctaggtgttggatcatttgaggtcaggagttagagaccagcctagccaacatggtgaaaccc

SEQ ID NO: 602098 - DNA, 84 bp, Homo sapiens
aagacagcagcatatatctctgcagcgttgaagcagggggccaagagacccagtacttcgggccaggcacgcggctcctggtgc

SEQ ID NO: 602099 - DNA, 142 bp, Homo sapiens
gcctgacgcagcatcagcgagcagccagtacagcccctaccagtacatctacaccagcagcaagtacagcgggtttgatttatatttgctccttcaaacttacgccggagtggtacccctcagtacaagttgctgagctgca

SEQ ID NO: 602100 - DNA, 352 bp, Homo sapiens
actatgggttgtcctctctgtgttgcaagaagcattcgcttctctcaggctcttgttatgcacagcagtcagccatttcaccataggtttctcgaatagttgcatctgcgcataatttgtctcccataagtgcaaattcagtcacttcattcactactcttacatgatcatcaaatggacactgctgaagatcctgagccaaggcgttcaacaccaaggctttgaaattttcttctcccgaatctttcaaccgatgagccaccgcactcaggtgtgcatctcgacgacacacacccctggaataaaccgagctacacatagtaaggagggaaatacaggtcacccacttcat

SEQ ID NO: 602101 - DNA, 305 bp, Homo sapiens
agaacactatcttgcatttttgtttgttttttgttttgttttgtattgttttgtatgagacaaggtctgtttctgtctcccaggatgaagtgcagtggtacaatccaggctcgttgcacccgcctcagcctccccaagtgctgagattacaggcgtgagccactgcacccggccctcagatgtctttgagcgctgcacatctacaggcttaaagtggatagaattgctttctccgaactagggaggcagcctgaagctctacaaacaaggactatttcagtaccctcgactgaagtgtttcaggc

SEQ ID NO: 602102 - DNA, 151 bp, Homo sapiens
tgactgagcggtacttactaacatattcagctgcttgagagcaggcatagagagaagagctgggtttacctaagaaagcagtttgttgcaagaaagtgggacctaagaaaggagccaggaagtaaggggtgtacacaaggagagtaggtag

SEQ ID NO: 602103 - DNA, 108 bp, Homo sapiens
agagtacagagcctctcgcttttttccagatggagctttcctttatcccttatgtattggacttggcttcctgctggaaatagtgagcttcctactcacggccaagtt

SEQ ID NO: 602104 - DNA, 592 bp, Homo sapiens
actctctaatcagatgtcctaggtcctcccaattcttagaccttttatacctgtttttctccttctgttattccatttagtttcttagttcatccaaaacggtatccaggccatcaccaatcattctatacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccataccaccccccaaaattttcgccgccccaacacttcaacactattttgttttatttttcttattaatataagaaggcaggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcaaaagctccccatgagcacttgttgaccccga

SEQ ID NO: 602105 - DNA, 115 bp, Homo sapiens
  misc_feature (102)..(102): n is a, c, g, or t
gtacaggtcaggggagtgggttatgcattctggaaaaggggatatttgattactgtcccccaagtcccacagcctggggtccatgcagagaccacagtgcanagagacgtggctc

SEQ ID NO: 602106 - DNA, 1579 bp, Homo sapiens
gccgggcaggggcagagccggtctcaccccagcgcctctccccggggcccgcgcgcctatggagagagggagcccactcccaaacccgggctcgaagccggcaggcgagacatcaagcgcacgtagagatcaatcagtggcacataactcagcgtgaccgacccaagcggccgcagaccagatgcggtacacgccacagaggacgccagacagcaccaccgagacacagcgacacacccagatccgcgacgccccagcaggcacaactaccctcaccaacacgacgaagatacagatcaccgggcgcgacacccaagacaactccagtacccagcccctaactgcacgcaacatcaccaggctgggccacaccgagagacccccaccagatgtctgaaccaccacagccactacacacacaacagtgctcgtatgggccccacccacgactcaccttgcacccgcgccgaaaagggaaccgaacacaaccagaacaggacaacgattcgaacacgacggcagcgagcccacagagcctgatccagccacacaacgcgacgcaagactcgagaccccaccgctccgcgccatctccgcgcctgctccggcccccaccactcctgacaccacacccgtcttcccccacgcacccatccatgcgccgcccacacaagcaggcactccacggcccccacttgcccaggacaagccgaatccaccgctcgagacgacagacaaagccaaccacccctccacacaccgctcctccacacagcgtcgctgcgatcggtagcgcccgtcacacagacgcggcagcggtcgacagcctcatcccgctcgtcctgcctccaagcctccgcccacattcacgcccgcccgacgccagccaccgccacgagaccgagctgaaacgcaaacgatgagcgcgcgtacccagactacaaggacacagacgcgcgtcgcggatagcactactgcacaactgacgccagctatccccccgccagtcaccctagcacgccctctctacctcgttccattcatctctaaatctcacccctcattacatatccctatgtcatcaattaaccacgtccttacctctacaagctcttcaacacagcacaatatcaacacacatcacaaaccaaccatacactcatcactcctcctatattcacatactatcaatcttcacatacccctccctctactatcctactacaacatgacttcacatcccctcaccacacctattcagtccaggagtgctagcgcagcaacagcaagcctgacgtcctgcacacgcgcccgtacagcaccctgcgcgcccgcgcagacacgacttgctctcgacagttcatagtactagctgcaaggcgccgcaatactctcgcggcccgccagtcggtatatacacatacagcacttccaccctgcagcttgagctagccggcgccctctcttgccaactcgtcgcacttagcaaccagcggccgcgcgaaccagtgagagagacggtcgtacgagcagacgtcgcgcgcgaccacattcgcaggcggcactcgaaagaaccaat

SEQ ID NO: 602107 - DNA, 367 bp, Homo sapiens
aagatcccttgagggtctggatagtctggatctgaaattgtctataagatacccaccatgacactgacatatcccattcgatcagcactcaggagcaggctttcttcacaacatctcatgtctcacatctttccaagccatcttgtctagtatatctatggaggagcagatggcacggaacttgctttcaggaacaccacagacagcaaacatcccatccacaatccgccggtcatttaccttaatgagaaagtctcccaactgcaatccacttaggatttcacacatgatcttcaaacactctgcatcggggatcatagggtcaaactgaccagcaatgtcaaaatcacactggcagaacaccgcg

SEQ ID NO: 602108 - DNA, 157 bp, Homo sapiens
ggttttccggggtttttttccccccccgggcccccccttttccgggggggggttcccccaagttttttccccccgtttcaaaaccccctttttccccggttggccccccgggtttgggggggggggtttaaaattaaagggggggggttttttttta

SEQ ID NO: 602109 - DNA, 866 bp, Homo sapiens
ctgtcgtccgaccgatatggggaacgggatgaggcagacgccacgcacgatgcgagcaaatcgggtcacagacgcatccatatctggggccccagcccaaaactggctgggaacataagccgcagacctgtgccgattgggcacccatgataccgccatacgaggcccaataaagtgggacaagccaccaacaatgaaaggcgggaaggacacccctttcacccaaaggcgcccggggataaatcggcgaaccccccacttgtggagaatacagacacatacttgctgcatcgcagttgtagccgcagccccccatgaggggataaggacctcagtaccgaaggcccggcgaatcaacaaaacacgtgtctagggagatgcaggattgggcaaaacccctcgagaccatgggctcaaatgcaagggaggtcacggtccacgcgacccccaacccgatgcccatgaaaacccagagaagaatagcccgggaccgcaataagaagctctaagaggcgttgtttgcaaggccaaaggcaccgtcaaccagagtgtaaccagaccaacgcccgggagtgcggagaaaatgtggtcgcacggatccgaaaaccatacgcgaccgaagggctggaaatcccgcgatctttccacggactccctacccgatccacgtgtaggaacaacaaacgccaagggtgacggcgcaaagggaccaaagaattagaccattctccaaaagaagatgaaaatatcaagggcccaccagcaatatgggaaaaagaggtccaccatccacttaaatatccggggaaagccatccaaaaccaaaaaagccaaaccacctcactccccaaaaatggccataatcc

SEQ ID NO: 602110 - DNA, 150 bp, Homo sapiens
atacagatcaactagattatatgcagagtattgtccagtttgagtagcagcaagacaagtccacattagtagtttgcatgcagcagcccaaatgcagtagcatagaagttattgtttactagcctttatatggcccatccaagctgcagc

SEQ ID NO: 602111 - DNA, 982 bp, Homo sapiens
  misc_feature (240)..(240): n is a, c, g, or t
gatccaaatgggcgctgtagtgggatcttccaacaaagccactgaatcaatccaggtctttccgatcactggtaaccagcatgtgcaaattagtcgcccgagtccctgggtggccagtgtactctcagttcgtgcgcgtgcggcgttcttgttctgggctgtgagcggatggttgctgatgcgtgtgacgtctctagtagtgtcgtaactgggtgtgcttggccttattcctagggtgtnacttataggtcattctgtggatattcaacgggctaggactcagtgtgggatcgttgtccacttgttccagatatagagagttttaaaaggttgatcttttgagaactggaaggacttagagaccccttcccattggggcccaggggcgtgacctaacacgtaatgacatttccatgagacttgataatcttggttgtagtaatctcctaatctgaaggggtaaaccggccgagggtcaggcatggagaaaggggcaatgctgtaaagtgacctcagatatccatcgcatagcaagtctcatatcgatgaggtgcagatcgaggttaccatacatgtatacagtcgtctcaaccgtccattcatacttccatggtgttttcctctgagtgccaggtagaccggttctacgatagcttgagcacagaattgtcagacgttgaaattggcacactctgggaggcagcacccactctggtccatgtagccgaactccctagttgaagcctcatggcaattgtacttgttcctggttgtcctgtctggtccgtgtgggaaatggctgggaagaaccccgtttggattctctaacagtcctttatttacaaggcccacggcaatatggggtgttcccacaatttgacaaatttgtgggggcgcagaaagccgggatttgctctttaaaagcacgttttgcggaagatttcctgtttaaaatctcttaaacacaaacggcgggccgatc

SEQ ID NO: 602112 - DNA, 154 bp, Homo sapiens
catcccgttccacagcacgaattacttcttcctgattgggccgccgctgcgtcatccccattgtatttccagtaccagatcatcatgaccatgatctgtccatgagaacttggtggacctggcctgggccgtctgctactacgtccggtctttc

SEQ ID NO: 602113 - DNA, 256 bp, Homo sapiens
aggatccccgatatttaacattaagcggaagtagatcatcaatcataaagatcttcatcttcattatcttcacattgaataggctaaggaggaggaagaggagaggttggttttgttgagagggtggcagaggcaaaagaaaatctacattataagtgaacccatacagttcaaacctgtgttgctcaagggtcaactctgtgtgtgtgtgcgtgtgtgtgtgtaagataattctaagaggataatgttagagata

SEQ ID NO: 602114 - DNA, 220 bp, Homo sapiens
ggagtgtgtactaatcattccctaaataggctgataactagctatacttcagagtcttctttaacaagattgtgcggagtcataacaagtgtcttctgttgcagaataggtcggagtcgggtctcttctcgaaggaggcttaggcttagcagggagcgaaggtgatggaggtggtgtcgcagcaaccctttccttttgctcgtcctccatctgtgcatag

SEQ ID NO: 602115 - DNA, 103 bp, Homo sapiens
gtcgacgccatccaggctggagcagtggcacactcatagctcactatggccctggctcaaaccatcctcccgtctcagcctcccaagtagctgggatcatagg

SEQ ID NO: 602116 - DNA, 173 bp, Homo sapiens
atggaacctgcatgtgcttaggtcaagggcatcttctaccactgctccaaatgacgacggaggggatttctattcagataatccttgctcctgtttcacaatcacactgctgctctaggatacctgtgtatgggggccatgtctttattgtttaccttgcttactctagttat

SEQ ID NO: 602117 - DNA, 1112 bp, Homo sapiens
ggatcttgtcgagaacgaccatctcagataggcgtccaagagcgagcttatttttcacacccagtgagttacgaacatttgagcagacgcgtggacggtactatggcagaggttaccacataaccacgtgcagcatcttcagggcagaccctccttatgtctgcttcagcagaagacagtggcacatggcgaaactgttacggtcaacaattctggggacgtcaacacatcctactgctattgttcttcacaccgcgttcccttggctgtaccaacaggatgtgactggccgagtgtacaacgaccggcttccccatactgatccgggtacgcatcgggatgaacgccatggtacttcacatgctcaactacttgacacttggctaggagctacatgaactctaacaacgtgtgctaatataatctccctcctttcatctcgcacataagatacagacatgggcatcgccggctagcagaagcttgctctgggtggacgttgtcttacaataaagcaaaagtcgaataaataattacatgaagggtgaaaggatgctggaatgggtccaggtcaagagaatatcttgagacaaaagtgagcttgcagaacgtgtacttatggcccttccgaccgcgcacatgggcctaggaaactcgaatccccttaggtttgggacactaacacccatcttccgtttaccacaatttattcccaggtcctaaacaagacgcagcaacttataacatatccgccctaacataccaaatcacctctcaaaccactacgtctaccataaaatgtcccaatgtacacttctatacctcaccatacacaccctgccaacacaacctctctcttttcctttttttctcctcctcccccctatcaactcaacaacaaacaatcacaccaaaaacctatacaaaaaataaaaaacagaaactcgtaattacaaggataacacgaatatacataatgaaaacagaaaaacaatatacagtcatatcatacaacacacaatacagatactcacaccatcaatcctccccaaaatcacacacacactcctacaacctcgaacacaaacccataaccaaccaccatcataaca

SEQ ID NO: 602118 - DNA, 277 bp, Homo sapiens
tacatcactacccaacacgtgtgtctcaacacaactgtgtgattcctcactgcatacccagcaagtctcctgaagtgatcagaatgatctctgcataaagagacagtaagtggaagttaaaacttcaccagaagcaaggaatggtggcgcactcctatagtcccaggtatatgtgaaacagaggtaggagaatcgcatgtgtacagagattccagaccatcctgggaaacatgtgagatcatgtgtcttaaaaaaacaaaacaaaggttggcggccg

SEQ ID NO: 602119 - DNA, 926 bp, Homo sapiens
gcgaccggtctgcatctcccagcagaaggcgcagccatgaatccgttattcggccccaacctcttcctcctgcagcaggagcagcagggcctggccgggccactgggggactcactgggatggcgaccatcttcgccggtgggaggagacttgcccccggtgcctctctctgcctggcgtgcctgctgcctactctgcctgcccgggccgggccctggtccctgtctgccgccatggccctccgtaatgaccatgggctccaacatcaacgtgctcaagaccctgaacctccggttccgctgcttcctggccaaggtgcatgagctggagcgccggaaccggctgttggagaagctaatctgcagcaagcgctggaggagggtaatgcagggccggcggggcctgggtacgtcgacgcacaggcagtgcagaccggcttcgtcaggcccatcggcccctgtgggcttgcagcttggtgcagcccggtctgggcgctgtcttgcagcccttcggcgcgcgtgctgggctctgcccgcgcgctccccggtcggcccctcgcgccctcgctggcagcctctcgtcgtcctacaacttccagctccagcacttatcctcgtcggccgcttcatgccggcacatctggtcgttctcgcacgcccgcggctcgggccgggatggagcccactctggtgcaacggcctggcttgtcggtgggttgcacccggatggggtgggcgtccagatcggagaccatcacgcccgagatccgggctctctacaagtgtttggccaacgtgaagcgggagcgggacgagtacaagcggagatgctttgacaggttaaatgataccaaagaggaggggaagggttcgacaagatctgtatggtgcgggagaaggggagccggattggggatggagtggaaa

SEQ ID NO: 602120 - DNA, 147 bp, Homo sapiens
tgccaggggttaacttgtcctcacaggagctgttcaggctggtcctcaaaggggcgtccaggctgggcttcctgtgcaaacacttggtacccctggttggcaggggaagccagcaggacagcagtgtggcccgatcagggaaaaaaa

SEQ ID NO: 602121 - DNA, 204 bp, Homo sapiens
gtggtgctgagcctgtccctgggcatgtccggttcgctggctgccgccgagctgaacattccggcacaatcgcttgaaggcgccttgcgcgagctggggcaacaatcaggtcggcagattctctactcccctgatctggttcagggcaaacgtgccacggcgctgcacggcgatctggatgtgtcatcggcattgcagaagcta

SEQ ID NO: 602122 - DNA, 667 bp, Homo sapiens
atgtctagaggatctccgagtagtccaaccatacggataaaagtggtggctttacgatttccaatagttatggttccggttttatccaaaagcaatacatcaatatctccggcagtttctactgctttaccagatttcgtaattacatttgcccttagcgccctgtccattccagcaataccaattgcagaaagtaaaccaccaattgttgttggaattaaacaaacgaacagcgaaattaaagcagcgattgtaatcggtgtattggcataatcagcaaatggttttagggtaacgcaaacgatgataaataccaatgtgaaactggctaaaagaatggttaatgcaatttcgtttggtgttttctggcgtgatgcaccttctaccaaggcaatcattttatctaaaaagctttcgcctggtgcggtacttacctgaactttactctcatcagatagtacttttgtgccaccggttacagaagatttatcaccaccagattcgcgaattacaggagcagattccccagtaattgcggattcatcaatggttgcaattccttcaataatttctccatcagtagggatggtatcaccggtttcacaaacaaaacatctccttttttagctgattagatgaaggattatattgttccattataataacc

SEQ ID NO: 602123 - DNA, 692 bp, Homo sapiens
  misc_feature (140)..(140): n is a, c, g, or t
  misc_feature (219)..(219): n is a, c, g, or t
  misc_feature (233)..(233): n is a, c, g, or t
  misc_feature (237)..(238): n is a, c, g, or t
  misc_feature (243)..(243): n is a, c, g, or t
  misc_feature (248)..(248): n is a, c, g, or t
  misc_feature (259)..(259): n is a, c, g, or t
  misc_feature (264)..(264): n is a, c, g, or t
  misc_feature (272)..(272): n is a, c, g, or t
  misc_feature (278)..(278): n is a, c, g, or t
  misc_feature (283)..(283): n is a, c, g, or t
  misc_feature (306)..(306): n is a, c, g, or t
  misc_feature (316)..(316): n is a, c, g, or t
actttctgatatagtacttgaaattcttaccagaagattacttggagtattgaagcctttattaatactacttttaaagaagcagttgttttattgtcaatgttttttttcccccaagcatattttcttgtattctgttnccatatatatatatatatatatatatatatatatatatatatatatatatatatatataatttccaattcggatatgcnctgccaccatgaanacgnntggcnccaanagtaatgacanatgtnaagtgtantaatanaaaantagagcaaagagccattcagctncagtctttanataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactg

SEQ ID NO: 602124 - DNA, 642 bp, Homo sapiens
  misc_feature (140)..(140): n is a, c, g, or t
  misc_feature (169)..(169): n is a, c, g, or t
  misc_feature (183)..(183): n is a, c, g, or t
  misc_feature (187)..(188): n is a, c, g, or t
  misc_feature (193)..(193): n is a, c, g, or t
  misc_feature (198)..(198): n is a, c, g, or t
  misc_feature (209)..(209): n is a, c, g, or t
  misc_feature (214)..(214): n is a, c, g, or t
  misc_feature (222)..(222): n is a, c, g, or t
  misc_feature (228)..(228): n is a, c, g, or t
  misc_feature (233)..(233): n is a, c, g, or t
  misc_feature (256)..(256): n is a, c, g, or t
  misc_feature (266)..(266): n is a, c, g, or t
actttctgatatagtacttgaaattcttaccagaagattacttggagtattgaagcctttattaatactacttttaaagaagcagttgttttattgtcaatgttttttttcccccaagcatattttcttgtattctgttnccatatatatatatatattcggatatgcnctgccaccatgaanacgnntggcnccaanagtaatgacanatgtnaagtgtantaatanaaaantagagcaaagagccattcagctncagtctttanataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactg

SEQ ID NO: 602125 - DNA, 152 bp, Homo sapiens
  misc_feature (17)..(17): n is a, c, g, or t
  misc_feature (52)..(52): n is a, c, g, or t
  misc_feature (96)..(96): n is a, c, g, or t
ctggagtacctgcagancccaccggtcagccgcgcctacaccactgcctgcntcctcaccaccgccgccgtgcagttggaattgatcacacctttncagttgtacttcaatcctgaattaatctttaaacactttcaaatatggagattaat

SEQ ID NO: 602126 - DNA, 137 bp, Homo sapiens
aaggagggaattttagggacggactggacagcacgtgttcttgctagctctgccttacaaggaatctggcgctcaatctcccagatgtctcagtgtgaagcatctgcgggataggtaaatatatatcagctctatgt

SEQ ID NO: 602127 - DNA, 970 bp, Homo sapiens
gaaattcgaaacggatagcaacggtggctgaggccgtttaaggaagatggacctcacagagaccaaccgtccatgtagtcttgatgcatcttagctcgtcgtggcatatgattcaagtgcacaaggagacggggaccttgcccagtagccgtttctataatcatgatcaaagtactgagatcctcgtgaggtccccttagcgtgtgagtctcatgtagaaaagtacgctacgtgtgcagatgcccattctatgaaggtttaggctgacccaggtgatgatcataaaaaactccatgtaccgagagataggcaagaagactgagagttttaggaagtgagacctgatcctgagttcgtccacttgaccacatggacgcaaacaatgcagcggcgctatcagtgccaacataggatagggcactacagattccggtactatgggactcccctggtagctggtacgctgacatgcgcttgtaatggcaaactcctattcgtctctgcaggatcagtgatcctcggtgttgatgcctgtgagagactatttcccgtcacgtgcaggttcagcaccacagtcccaattagagtaagattgtcaacgaggccaggcgcgagcggagaagctttactctgccgacagcaacctaaacttggggacacaccctggtccaacttctcgtttgggtcctgtgtgacctcaatgtcttcaggggatctaccaggtgctacgagtgtggtaccaaggaaggagacccctaccttgtggtccttccccaggtaatgcctttggagacttgtgggtcaccagactcgcattccagccaggattacacgaatgcagaacttgactccggcatggtccgttgcaggactgggtcctcgtagggtcagcctttgggcccattcttggttagacaccattggcgccgccagatcgggatgaacaaggagagctcgggaaatgttggta

SEQ ID NO: 602128 - DNA, 1239 bp, Homo sapiens
  misc_feature (4)..(4): n is a, c, g, or t
  misc_feature (923)..(923): n is a, c, g, or t
tggnctggcggtcgtacgaggcagtcacgtgttgtgcgacgtgctttctcctgtccgttccagttccgttcttcgattggttcgttagtagattagtgttcgatttgtagttctggcgcgctggtgttgagtgttgtcagctgctgtggtgggtaagtgtctcgtcttgacgtcatggctttttcagtctgtttgtgttctagtcttgttgtttcgtgtgtgatgtttcgtggtgtgagcgtgcttccgttgttgcgacacgttgttgggttggcttagtgtgttctttcttgttgaccctgttttgatggtctgtgtgggcgcggccgcgtagtcgagtgtgggaggccgtcaatttataccagacgccgtgaggggttcccaaaacaagacagaccgaatttttaggggggacacacctatgtggagactcccggaggggatgccccaccaaacggtgtggcgagcagacaaaaggccgggctttgttgtatacccggctggccccccttgtttctttatttcgccgggtctctttaaggttaacggagcccctgggtggccgcgccccaaatggggctggcgacccaccaaaggggtaaagataggaggagcgccccccgaataataagtgttcttctagcgccctttttagaaacaccatggggagttgttcccttgtggcgccacaataataatgcgcgaatctataaagcaaagagtgggtatattgtgagaacatatcaagggaatagggtgtactcgtttccaaaaagaggatagccccccaccagatggttgtacccctgaggccaaaaactgggaaggagagttctcaccacatagttttacacgccagccatagctcgtgtgcgccattgtgggtggtggaacacccacaacccacaagttaagaggcgccnagaattctttgcccagagagattatatgtgccgtattgaggccaccattatacgcaactcttatagagcccgagatagcttctcctgagaacacgtgtgaaggagaaatgatccagagaaaagagaatgaagccccaagagaaagaggtaccctggggtctaacattaagcggcgcccaacgccctgcgtcccccccgagaagacatactttgtgagaacccatgggaaggagcctgagactgctgggacctcttccctatggattcatggcataattaggtgtttaaaaaaaaaattaaggaccttctgggctcc

SEQ ID NO: 602129 - DNA, 422 bp, Homo sapiens
  misc_feature (10)..(10): n is a, c, g, or t
  misc_feature (40)..(40): n is a, c, g, or t
  misc_feature (76)..(76): n is a, c, g, or t
  misc_feature (203)..(203): n is a, c, g, or t
  misc_feature (223)..(223): n is a, c, g, or t
gtggttccangggttttaaagcccccagactttttttttntcctttttaaaagagaccacagtcttgcctctgaanacctccagactggagtgccacaagtttttttccttttccttttttttgaagaacaggttcctcactctgttggcccccaggctggaagtgccagtggcgcgatcacagcctcactgcagcccttgancctccctgagctttagtgancctccccacttcagcccccaagtagctgggactaacaggcacatgccgccatgaccagctattttttgtatttttttgttgaaacagggttttgccatgttgtgtaggctggtctcaaactctgggactcgagatctgcatgcctgtagtcccagctactcggaaattatttcacacaagttcttttttaaaaaaaaaa

SEQ ID NO: 602130 - DNA, 353 bp, Homo sapiens
catcgcatcataatcctctctgcatggacttcaaagctcatatctcccacttaatagtctttatgagtgactgtctagcaagcctcgcataagctcgccttaccccccattattaacctactgggagaacactctgtgctagtaaccaggtactcctgatcaaatatcactctccgtacttagcaggactcaagcctactaggtcatcagctctatagcgtccctctacgtagtggtatccggaacggcaaagggggcgtcacgtcacccagcactttaacagcattaagccctcattcacgtcgagagaacaccctcatgttcatacaccgtagtcccgcattgcgatattg

SEQ ID NO: 602131 - DNA, 127 bp, Homo sapiens
ctttgcactctggttggctggtgttagggttctctgttgtcgttgtttggccggatgtgtttaagtgctgtggccagaagcgggcggagggggggtttggtgtacattttatgtaatgattgtctcg

SEQ ID NO: 602132 - DNA, 130 bp, Homo sapiens
ttaccaaacgcgagaggccgcagtatccttagagagaagtggggtggcttttaggatggcagggacttccttggtcaacgcgagaacctctctgcgtttggagctcctattcaagtcctctctgcgtttg

SEQ ID NO: 602133 - DNA, 746 bp, Homo sapiens
ggagggggcgtcctcctttgcaggtgcggtgttgggaaggagcagtgagccacagggggatgggagcccaaggtgtggccctgcagggagggtccaatggcccatgagtgtgggtgattcaagaatgtcagactggctgggcacggcggctcactcctgtaatctcagcactttgggaggccaaggcgggcagattacctgaggtcgggagttggagaccatcctagccacgatggtgaagccctgtctcgactaaaagtacaaaagttagctaagtgtagtggcaggtgcctgtggtcctagctacttgggaggctgaggcagggaagtgcttgagcccgggaggtggaggttgcagtgagccaggatcatgctactgcactccagcctgggcaacagggtgagactccatctcataaaaaaaaaaaaaaaaaaaaaaaaaaaaaatttttggggggctttgggccctagaaaagttttctatacccattctcgttgtgggcgcgcggcgggcgcccactgttgtgtgtagcgtgtggacccttggggcgcaatagcgctgtgttccccaagggaaggacccggcgccaaggaactatgtggtctggggtttctctcacccaatttaaaaaaacggccgcgggggggaacccggacgttgttttggaccaaattccccagatgggggtccgagggggcctcacgggtttctttcccccggggttccaagcggcgccgtttccatt

SEQ ID NO: 602134 - DNA, 165 bp, Homo sapiens
  misc_feature (3)..(3): n is a, c, g, or t
acntaacactagcaaacagaaccataaatctattaacaggggccaggcgctgtagctcatgcctgtaatcccagagtttgggaggccaaggcgggtggattgcctgagctcaggagtttgtgaccagcctgggcaacatggtgaaacaccgttaggtctacctgg

SEQ ID NO: 602135 - DNA, 310 bp, Homo sapiens
taatttctcagcatttctagttttggaacttcagcagacttcaacttacgatcccttaaaggtaggagtttctacttttggccactgttgcacatttgtgggtctagatggttcttcatattgtggggggctgacctgtgcatcatacaatgttcaacagcatcgctggcctctcccctttcgatgccagtgtttgcctccctccccaccccggcatgaccagagatgtcgccagatagggccaagtgtcctctgctagaaagcccctggcgaaggggtaaaagtagattccaatggcccttgtcacact

SEQ ID NO: 602136 - DNA, 881 bp, Homo sapiens
  misc_feature (1)..(1): n is a, c, g, or t
nctcagcaaaatagtacacaatatctttataatctgaacttcctcaatatctccaccgaattatacatactgttgcgaacaaaattccatccatcactcgcatcctcattactgctccttactagtaggataccttatcatttgctgcacagcatatcaccacgtaaacgccgctttacataaacaaccgtccccctccgtatagttaaccctatctcacacgctatttagctttttcgcaccttctagtggtatcctaaacggcaccttggagtgtgtttaacacaccccgctgcgcccgtttgaggacgcttcccggctcccccgatggatggagattttagggcttgtgtgcgcaggccacctttaatggcgggtgcaattgcgacatgattgaagattccgcggtagttccgctcattctcgagtcccatccagtttctggtgcccggtcccggctcccccttgtgttttcttgcggccctgcatgaacgcggtagccgggcctatccccccgttgtgtcccctcccgcccttctcgcctttttggggcctcctccccactttctgagtgtttgttccaccaatcggccgtccttcgagtatattccccaagaagcaatagcgtccttagaaagcccccacctattcaggttccctcatccacccccccttataccctgatagcttatgcatcacatccgcactgatggtcttacccccatgccaaaaactcgccaaatattgctcaccaacgtttaaatctaagccctcctctgagcaaaaccaaccaccccccaccctttgcccccccaaatttcccccccacacggttttttacttttccccccttttaagaatttaattttaaaaaacataca

SEQ ID NO: 602137 - DNA, 880 bp, Homo sapiens
  misc_feature (854)..(854): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgtcctctggttaatgactctttaaccggtgaaatccaaaaatctccgagtcacntgcggggaaattcctttcatcaagcg

SEQ ID NO: 602138 - DNA, 102 bp, Homo sapiens
  misc_feature (66)..(66): n is a, c, g, or t
  misc_feature (98)..(98): n is a, c, g, or t
atgtgaaaaactttctgggtcctcataacagcccccagggtagggctaccagggggctattttacncatgagaaacatttgatgaggtttgggaccgngcgg

SEQ ID NO: 602139 - DNA, 804 bp, Homo sapiens
  misc_feature (678)..(678): n is a, c, g, or t
  misc_feature (689)..(689): n is a, c, g, or t
  misc_feature (696)..(696): n is a, c, g, or t
  misc_feature (771)..(771): n is a, c, g, or t
  misc_feature (774)..(774): n is a, c, g, or t
  misc_feature (798)..(798): n is a, c, g, or t
  misc_feature (800)..(800): n is a, c, g, or t
  misc_feature (804)..(804): n is a, c, g, or t
gctattctgctgttgggtcaccttctgcctacttgtgacattccttctgctcttccttgctccagggattgttccagggcccccagttattctaaatgaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaaaggcaagttccttaaaaaattcaantccggctttgnagaactnccggttccaaaggtccaagaaattattttgggggaataagttttaaagccccttttgccttttccctgagaaagncanaaatttggggcctcccaaagggtntncccn

SEQ ID NO: 602140 - DNA, 1965 bp, Homo sapiens
  misc_feature (1536)..(1536): n is a, c, g, or t
  misc_feature (1566)..(1566): n is a, c, g, or t
  misc_feature (1592)..(1592): n is a, c, g, or t
  misc_feature (1596)..(1596): n is a, c, g, or t
  misc_feature (1662)..(1662): n is a, c, g, or t
  misc_feature (1673)..(1673): n is a, c, g, or t
  misc_feature (1685)..(1685): n is a, c, g, or t
  misc_feature (1696)..(1696): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602141 - DNA, 774 bp, Homo sapiens
  misc_feature (3)..(3): n is a, c, g, or t
  misc_feature (87)..(87): n is a, c, g, or t
  misc_feature (92)..(92): n is a, c, g, or t
  misc_feature (103)..(103): n is a, c, g, or t
  misc_feature (105)..(105): n is a, c, g, or t
  misc_feature (119)..(119): n is a, c, g, or t
  misc_feature (124)..(125): n is a, c, g, or t
  misc_feature (129)..(129): n is a, c, g, or t
  misc_feature (132)..(132): n is a, c, g, or t
  misc_feature (737)..(737): n is a, c, g, or t
agnagagagagagagagagagagagagagagagagagagagagagagagagagagagagagagagagagagagagagagagagaganagagngagagagagananactcgtgccgctcntgccnnttcngcncgagagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagatctttccctgatttttgtctttcccctttcncacccttcccattccttgatggttttgtttttcttgc

SEQ ID NO: 602142 - DNA, 229 bp, Homo sapiens
catcagcctcccgagtagctgggactatgggcgctcaccaccccacccagctaatttttgtatttttggtagagatggggtttcaccgttttggacaggatggtgtcaatctcgtgacctcatgatccgcctgccttggcctcccaaagtgctgggattacagacatgagccaccgcacccggccttcttttttaatgtttctttttaatgaaccatctttggattcct

SEQ ID NO: 602143 - DNA, 2491 bp, Homo sapiens
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcatggtacgtgtggcttgccattcatcgaggtttgtgacgacattcttctcatggtattagatgttgccagacggtaggccgctttctcttgtcgcttgctctggagaccctgcgattcacgatttctcttttgccttggtgttgagtggttcgtgttgccttcgtactacgtgcttatcttgccctttgacttcttcttgatcaactcgtactttgcatctgtcgctgctggatatctttctcttgatcttgttgcgctccttgccgtcttctcccgtctatgccgccttgttctcctgtgttcttctgggatctgtgtcctcgtcttgccatttctctcttcccaggcacagcgatccgtcgaccatgtttcctcctctctcgcatcgttcgccttctgccacctgccgggccttcctccctcctccactcacgccctccccccacgcgccaccacctgctcgccacccctccctcgcccacgccccaccctcggttctcctctcatccgcgcccacccccgcgcccctcctcccctcctgtctgcccacaatcccctgcgctccaccccgccaccctctgccccacctcccccccccctgcgccacgcccccccctccctgaccccccccccccccccacctctgctcgcctcccctcgccccaccccccctcctccgcgcctctctcgcgcacccccccttgcccccttcgcccccctccctgctgccgccccctccccccccctccctgccgccccctcccctccgccctctcccccctgcaccccctggctcctccccccgccactcccctcctctccctcccgcccgcgcccccccctcccccacccccccccctctcccccctcccgccccccccccccttccccctcccctccccccccctcactcccatacccagtatcctcgtcctctccacctctcccctctccccactacctccccccaccttacccgcctcctccccctcctcacccctccacctcaccctcaccccccacaccacctccctccactcccccccccctcacccccccactctctcccccccctccaccctctctctcctcctcctctccctctccctccatccctcctctccttc

SEQ ID NO: 602144 - DNA, 767 bp, Homo sapiens
  misc_feature (3)..(3): n is a, c, g, or t
  misc_feature (87)..(87): n is a, c, g, or t
  misc_feature (92)..(92): n is a, c, g, or t
  misc_feature (103)..(103): n is a, c, g, or t
  misc_feature (105)..(105): n is a, c, g, or t
  misc_feature (119)..(119): n is a, c, g, or t
  misc_feature (124)..(125): n is a, c, g, or t
  misc_feature (129)..(129): n is a, c, g, or t
  misc_feature (132)..(132): n is a, c, g, or t
agnagagagagagagagagagagagagagagagagagagagagagagagagagagagagagagagagagagagagagagagagaganagagngagagagagananactcgtgccgctcntgccnnttcngcncgagagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagacctttccctatttttggtcttgcccgtttctttcccggcttgcaccagtctttccgtggtt

SEQ ID NO: 602145 - DNA, 2046 bp, Homo sapiens
  misc_feature (1617)..(1617): n is a, c, g, or t
  misc_feature (1647)..(1647): n is a, c, g, or t
  misc_feature (1673)..(1673): n is a, c, g, or t
  misc_feature (1677)..(1677): n is a, c, g, or t
  misc_feature (1743)..(1743): n is a, c, g, or t
  misc_feature (1754)..(1754): n is a, c, g, or t
  misc_feature (1766)..(1766): n is a, c, g, or t
  misc_feature (1777)..(1777): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602146 - DNA, 1254 bp, Homo sapiens
  misc_feature (1107)..(1107): n is a, c, g, or t
  misc_feature (1145)..(1145): n is a, c, g, or t
  misc_feature (1153)..(1153): n is a, c, g, or t
  misc_feature (1159)..(1159): n is a, c, g, or t
tgtcggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttanctggcggtaagtgctagactgtaagcccgacaagggcngggctttnggtttngttctctgatgtgtctcagtatctagcacataatagacactcaataaatacttgttgaattcaaaaaaaaagtcgacgcggccgcgaatttagta

SEQ ID NO: 602147 - DNA, 1292 bp, Homo sapiens
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaaggtaaataccgagaggaagcagtttagggcttcatgttttcacatttcgtaagttatgaagttaaagacttttttatttgaaagtttctatgttaaacaacacatttaatatgttctgtttgacataatagtatgtatcataaatccataataaatagtatcaaaatca

SEQ ID NO: 602148 - DNA, 159 bp, Homo sapiens
cgccccaattcgcttacaaaaagagaggcagatcgtctctccactgtgcagcgcttaaaggtactcagtgaaaactactgtcacatatgcgcactctttaattttgctatccactgttttacttaacctgtaaggccccctctcattgcaacaggaggt

SEQ ID NO: 602149 - DNA, 1998 bp, Homo sapiens
  misc_feature (7)..(7): n is a, c, g, or t
  misc_feature (1569)..(1569): n is a, c, g, or t
  misc_feature (1599)..(1599): n is a, c, g, or t
  misc_feature (1625)..(1625): n is a, c, g, or t
  misc_feature (1629)..(1629): n is a, c, g, or t
  misc_feature (1695)..(1695): n is a, c, g, or t
  misc_feature (1706)..(1706): n is a, c, g, or t
  misc_feature (1718)..(1718): n is a, c, g, or t
  misc_feature (1729)..(1729): n is a, c, g, or t
gggctgnaggattcggcacgagtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602150 - DNA, 1313 bp, Homo sapiens
  misc_feature (1166)..(1166): n is a, c, g, or t
  misc_feature (1204)..(1204): n is a, c, g, or t
  misc_feature (1212)..(1212): n is a, c, g, or t
  misc_feature (1218)..(1218): n is a, c, g, or t
tgtcggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaagggaaattaggttggtctttcaggcatcttctaaaggcagccacctgccgttcgcgacaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttanctggcggtaagtgctagactgtaagcccgacaagggcngggctttnggtttngttctctgatgtgtctcagtatctagcacataatagacactcaataaatacttgttgaattcaaaaaaaaagtcgacgcggccgcgaatttagta

SEQ ID NO: 602151 - DNA, 128 bp, Homo sapiens
tctgtgtatgccagtgagctagtatgtcctcctggggggtttcctgatgggaaacggtgttggtcaagatgcctgccacctgcaccagtgttggactgtgtctgcgcctcctcttcctcccattctcc

SEQ ID NO: 602152 - DNA, 337 bp, Homo sapiens
aatgcatagcgatcaggaaaggactacttaggcaagagaagcagctgaattcccacgttcccatgaagcatcccccatcgattctgagcgcatagtgtaaagtaggactaaattgggaacaaaccacaagaattatatacaagtggctgaggggctatatgataaatactcaggagatcatctattcctgcactagttagatacagctacattctttacagtacacaaaagccattaatcatgtagtatagagaccaaaatgtaaagagagatagaatacattactgatgtgtgacttaattcaagtacacgcatctacttgtgttacagcacagtt

SEQ ID NO: 602153 - DNA, 1911 bp, Homo sapiens
  misc_feature (1482)..(1482): n is a, c, g, or t
  misc_feature (1512)..(1512): n is a, c, g, or t
  misc_feature (1538)..(1538): n is a, c, g, or t
  misc_feature (1542)..(1542): n is a, c, g, or t
  misc_feature (1608)..(1608): n is a, c, g, or t
  misc_feature (1619)..(1619): n is a, c, g, or t
  misc_feature (1631)..(1631): n is a, c, g, or t
  misc_feature (1642)..(1642): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602154 - DNA, 1303 bp, Homo sapiens
  misc_feature (1156)..(1156): n is a, c, g, or t
  misc_feature (1194)..(1194): n is a, c, g, or t
  misc_feature (1202)..(1202): n is a, c, g, or t
  misc_feature (1208)..(1208): n is a, c, g, or t
tgtcggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagtctcttaggggcaagcttctgagggtcaccttcaccctgacacctgcagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttanctggcggtaagtgctagactgtaagcccgacaagggcngggctttnggtttngttctctgatgtgtctcagtatctagcacataatagacactcaataaatacttgttgaattcaaaaaaaaagtcgacgcggccgcgaatttagta

SEQ ID NO: 602155 - DNA, 1992 bp, Homo sapiens
  misc_feature (1563)..(1563): n is a, c, g, or t
  misc_feature (1593)..(1593): n is a, c, g, or t
  misc_feature (1619)..(1619): n is a, c, g, or t
  misc_feature (1623)..(1623): n is a, c, g, or t
  misc_feature (1689)..(1689): n is a, c, g, or t
  misc_feature (1700)..(1700): n is a, c, g, or t
  misc_feature (1712)..(1712): n is a, c, g, or t
  misc_feature (1723)..(1723): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602156 - DNA, 1392 bp, Homo sapiens
  misc_feature (1245)..(1245): n is a, c, g, or t
  misc_feature (1283)..(1283): n is a, c, g, or t
  misc_feature (1291)..(1291): n is a, c, g, or t
  misc_feature (1297)..(1297): n is a, c, g, or t
tgtcggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagtgtggtgagacaagaagaggcggcagtatgggagttgggagggatcttggagttggaaatcctatttctctgcccgtggcgctttcctggggtgcaataaatcatgaggtccattcctgctagaaggcaggaatccagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttanctggcggtaagtgctagactgtaagcccgacaagggcngggctttnggtttngttctctgatgtgtctcagtatctagcacataatagacactcaataaatacttgttgaattcaaaaaaaaagtcgacgcggccgcgaatttagta

SEQ ID NO: 602157 - DNA, 2107 bp, Homo sapiens
  misc_feature (1678)..(1678): n is a, c, g, or t
  misc_feature (1708)..(1708): n is a, c, g, or t
  misc_feature (1734)..(1734): n is a, c, g, or t
  misc_feature (1738)..(1738): n is a, c, g, or t
  misc_feature (1804)..(1804): n is a, c, g, or t
  misc_feature (1815)..(1815): n is a, c, g, or t
  misc_feature (1827)..(1827): n is a, c, g, or t
  misc_feature (1838)..(1838): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaggtacctgtgcgtgcacgcagacgggaagggctggggaagcgggaggactgagaaaagccaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 602158 - DNA, 159 bp, Homo sapiens
taaatcgagctcggtacctaatttttgtattttagtggagagggggttcaccatgttggcagtctggtctggaactcctgacgtcgggtgatccgcccaccttggcctcccaaggtgctggaattagaggcctgaccccctgctccaaagcctgttagg

SEQ ID NO: 602159 - DNA, 739 bp, Homo sapiens
ctggaaactgggtaatttataaagaaaaagaggtttaatgtactcacagcttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgttacgtaaagaagggcagatttattagagaaacttgtgaaccatatgttgcagtgggcagctcagcagagaaggggctacctgcaaagaggcaagggctggaggaaagtttatagggtcctgctgaaagggtgctacggtgtggaatgaggtcattgtgcccgcaggttgttgtgattagtgtctctaaacaattgttcatacaataattgtccattatgttctcaacttgggttctccccaatctgggaacccttcctttattgttgcttacttatcaggttccacattacaggtgtggaacttccttcatcatattttaaccaattgtggtacctgttttaaaacttt

SEQ ID NO: 602160 - DNA, 138 bp, Homo sapiens
gggtgcatttttaaaggaaccaattgtgtaaaagcagacatcattatggaattcatcatgcatgggatttattgggggaattaccagcaagagaaaatacttgaataagtacccagaaaaagcttggagagctgttag

SEQ ID NO: 602161 - DNA, 103 bp, Homo sapiens
ttctcgcagtcgcgaccatatacacagtcgcagtagagtaggcgctctctcagtccgtcaaagtgaatggagccaaccataggggcctggaggaatgacatat

SEQ ID NO: 602162 - DNA, 468 bp, Homo sapiens
tggtgttctagaggatccctgcaagacgtatagaaccataataaaataccatccatacctatgagaacagttaaaataaaaaatactgacaacagcaactgtggtgatagagtaacgggagctctcatacatcagtagggaaatgtcaagtagtacagccaccgggaaagttggttataaaattaagcatatatctaaccaaatgttgatggctattgtgataccctggttcttgtcttcttagtttaaaagaatttaggccggacacggtggctcatgcctgtaatcccagcacctcgggaggcccaggcaggcagatcacgaattctggagattgagaccatcctgggtaacgtggtgaaaccccacctctactaaaaatacaaaaaagtagccgggcgtggtagcaggcgcctgtgtcccagctactcgggaggctgaggcaggagaatggcatgaacccaagag

SEQ ID NO: 602163 - DNA, 250 bp, Homo sapiens
cccttccccctcttgttttcctagaccccccaaagttaaaacttggggttcccctggccccccccaaacccttgtatattgtttgttttagggtcgggccccagtaaccaaccccggtttttattgcccaaaccaatgtttgctggggatattccccgtaaattttattttatctgtttttttgtttgtttggggggtttttggggggggggtggttttgttttttaaaataaaaaaaaaaatctgtcca

SEQ ID NO: 602164 - DNA, 937 bp, Homo sapiens
agactgctcagcctgcattagtatgacagtaggggggctgtaacaatcgctgctatactcggctggcttactggattatcatggcgttggaatcttcatagtaatgcacatccaattacttcgtggtacctgcagtttacaaaataattcgatccttcagtgagcatatggtgtatctggatgttccagatgttagaactataaccatatttattacaaacagatattaatccctctactcccaggtgtcccttttcaatatgttaagatcatcaattggctttgaggggtgccgaaaagaaataaaccgtaggcggagagcgggagcttatcctgatagtgcatgtccactatagaggattgtcagtaaaattaacaattccacagctaatccaataaatcaatggtacattctaagtgttctgacttttcactaatatattctcacactttgatccatcacagtaacaatgtacatatgttaactgtaaataaaaatggtttgatactcagaaataccaagaatttaacttttccaaatgtgtctacagtcctgggaacaagtaagacattattggccaaaataagaggaaagaacaacctctagtactgcattaatgagttcaccatagaattggtgggacagtactgcagacagcgtgcaagttactaaaggtctcggtttaacactattgttagagggcctgccttagcacgaaaactgttccataatgaaccgaggcaactattgcacgtattttacacaagcggctgcactgtacacctgggtttagaacatatattccgtataccccatttgcccagggttgcccaagtgtacaacaatggttcttggtatcatccccaaaaacccaacgtttatcgagcgcaacattacaccgtcttcgagcctagggaatacagccagcagcaaacc

SEQ ID NO: 602165 - DNA, 155 bp, Homo sapiens
gataagcggatgagggcaatgggatagtgggtgggggatacagagaggtgatcccaaaagggaaaacccttatccggtcttccccctcttccccggattggccaaccgtgtgagacctgaagcacatcctctaggtcagagtcgtcgaatcttgc

SEQ ID NO: 602166 - DNA, 152 bp, Homo sapiens
gctgtgtcgtctagaggatcccaggcgcggctgaactggcattttagatgtggttgactatttctgtatgtctccatctatcgatgagggtctcaaaaaaaaaataataaaattaaaatgggggtaaaaaaaaacacaatttaccatatatg

SEQ ID NO: 602167 - DNA, 257 bp, Homo sapiens
gaccaacatggtgaaaccccgtctctactaaaaatacaacaattagctgggcttggtggcacacgcctgtcatcccagctactcaggaggctgaggcaggagaatcgcttgaactcgggaggtggaggttacagtgagccaggatctcaccactgcaatccagcctgggcgacagagtgagactccatctcaaaacaaaacaaaaaacaaaaaactccaagccaaacattgggtgacttaggggcctcagaagaggt

SEQ ID NO: 602168 - DNA, 685 bp, Homo sapiens
  misc_feature (538)..(538): n is a, c, g, or t
  misc_feature (540)..(542): n is a, c, g, or t
gaagataatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaaaaaaaaaaaaacaaaaaaaaaaanannnaaaaaaaaaaaaaaaaaaaaaaaaaaaaagagagagggggggcgcgccaaaaatattccccagggggggccctttgggccccttttggaaaggggggcccctaggggggcgtttcgagggggggggcgggttttaaacacggg

SEQ ID NO: 602169 - DNA, 607 bp, Homo sapiens
gaagataatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagcaccaccaatacagggagcaccaccaatacaggtagcaccaccaatatgtattggtggtgctgacgatctcaggatcctgggcttcgtaggacttgaccaagcgagcaaacttaaggaca

SEQ ID NO: 602170 - DNA, 1655 bp, Homo sapiens
gcccccgcccgccccgggccctgatggactgaatgaaggctgcctacaccgcctatcgatgcctcaccaaagacctagaacgtgcgccatgaacccggagctgacaatggaaagtctgggcactttgcacggcgcgcgcggcggcggcagtggcgggggcggcggcgggggcggcgggggcggcggcgggggcccgggccatgagcaggagctgctggccagccccagcccccaccacgcgcgccgcggcccgcgtggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtg

SEQ ID NO: 602171 - DNA, 127 bp, Homo sapiens
cctggcaggctctctacctgtagttggtgataccacagaatactggactcagtactaatatttcagtcaccacattcaaacagggagggcacctagctaataccgaactggatgctaccgattcagg

SEQ ID NO: 602172 - DNA, 1444 bp, Homo sapiens
ggaggccgcctctgactgccacctggcatgggctccgccaatgaggttcggcgccggcctcaggctccgtgcgcgcgcgcaaatcttgtgtacttccagtacgtgggcaccgactttaacgggtgtcgcgagcgtcgaggggggcactcagcgcgccgctctgtggtccagaactaccgtggagagaggccgccgagcggatgaatttcctgtggagccggtcaggttcaccaatctccagccgcacggacgccgggttccaacgcccctgagcaacgcggcgaaaccttggacgtccacgcggccgctcaggcccgtgccggcccttcccgccccgagatacctggcccggagggccccttcaaaacagcaagcaccgtgcaggacaacccgtgcacatcaggggatccttgcgaggccttccgatgtgccccagcgactttccaacgcatcggtcaatgcaagcacacggttcaccgggaaccacttaaccctttgtaaccgcggcctttggaccaactgggtcttgtcaaccgtgcgttgcacttgaaggcttgcccgagtgctatggaaccggcaaaccttaattgtcttgggacagtcatccccccgggcaagaaccttgggccttgccactatatgggtacgcaccaatagccatgttgaaaagggccggtacacaaaggcgcaacgcaattcccgattttaggagccacaacaaacacgcggaagtttccatggggtgctcattttaccccaatggataccacggcatatggagaccgaaggcccccccggagttggcactagtaaggtacccaccagtagtggaccgagaaaccgggccatggctagcgccggtggtgggtaccttacccgggatattcaccccacaaagtggggccaaaggtggcccaagtgtccccccgttttttgagtacaaaggccccctcgataatgggaatgaagctaagtgggaaaaggcaatttgggagtaatcactttgagcaacaacgttggcggcacgtttatgggcaagaaagacaacaagattacattttcaccgagtgggttacattacgaaacgacgggttatacccgcgtagggaaaattaaacccgggcgcactatgctctagcatattaggcctgcggcccaggagatggctcgcgtcagtagggagagcagacagcaatatatgtggcgccacacaccgtattggcccccaatatggcgtctaaaaactgctcgcagaactctctgtggacgaggaaacaggccccaactgaacttcctcccgacctgtgtgtaagacaaagcgacacgcaacaggacagcgagcagatttgtaacagaaccccccatagtcaagccacgaacgggagacatacataattccacttcaaatcgatattagtgagtgacaagtagtcgacggagtgac

SEQ ID NO: 602173 - DNA, 180 bp, Homo sapiens
gtctgactccctaggctcagtagctggtgcctacccaatcccagggcggtgtctcgagagaagcgaacctggtaagcctccactcaggacaccagtgaacagctgaaccgaaagcagagaacgtctggccctctacccaatgaatggtaagatgggaagactacggagcactgccatagt

SEQ ID NO: 602174 - DNA, 102 bp, Homo sapiens
gcctcggacaccgccatgtattactgtgcgagagacttatctggtcctacacatatagtaatgctagtctctcatcactactttgactactggggccaaggg

SEQ ID NO: 602175 - DNA, 265 bp, Homo sapiens
tgagaaagcttcagcatttttcttgctaacaggctcagaaaagtgtttcaaagccgagcacagggttgtttggttgcttgtgaagacaacctttgttccacaatcaattattaaataagcgaacaatttccgcaatgaactgaacatgcaacatttatcctacattcagtttgtcattcacactccttaagatttggtcagaatacttatttctttgcatgtcttatacacttgtactcctgtatgaataaaatattgtttttta

SEQ ID NO: 602176 - DNA, 529 bp, Homo sapiens
  misc_feature (10)..(10): n is a, c, g, or t
  misc_feature (66)..(66): n is a, c, g, or t
  misc_feature (73)..(73): n is a, c, g, or t
  misc_feature (176)..(176): n is a, c, g, or t
  misc_feature (214)..(214): n is a, c, g, or t
  misc_feature (433)..(433): n is a, c, g, or t
tccatttaanccccacttcccgaatgtctatttcaaatcaaggccccttaaataggggttaaattnaaccaanctttgcaccttaaggcttaacaccataggaactttgctaagccattgtcccctgggaatacaagggccacacccgggaccaagtgggaagacctgtgggcttnaagcctcggggcccggggcatgcctgccaccccctganaaaaacaggttccaaagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccncccagacctaggcttccctcttctcaggatccaccacagggttaggggacaggaagcctgttctattctcaataaatcttacaaaattccaaaaag

SEQ ID NO: 602177 - DNA, 113 bp, Homo sapiens
tgccaccttcgcaggtgggccagaactaccaccaggtattaagaggcccgttcataaatccgtttcccccaaaccttgaggttttttgggctttctaagggttaccctgttca

SEQ ID NO: 602178 - DNA, 151 bp, Homo sapiens
atctcccatccgtggataaaatgtctgattcgcagcacatgccatcagcctacagaccctacacttgtctcttgtgcagtcgtccagaaccccaggtcattgctctggttgcccacactctgcagttataatttctggtgacttcaatatc

SEQ ID NO: 602179 - DNA, 276 bp, Homo sapiens
gccttttccaagggccccccccccccgggtgtgcgccaagctttgggttccccggaaaacaaaactttggcctcggggataaggaagtggggggcaggggccaaaatcaatggcaacaaccaaggggggggtcccatcccccttggggattaaatgggccggcggccaaaccaatccctttgggaggaatttggaggagggccccttcccttttatttaatttcaggggacaaaaatgggtttggaaaaaaaaaaaaccgtttgtttacaccggga

SEQ ID NO: 602180 - DNA, 235 bp, Homo sapiens
  misc_feature (58)..(58): n is a, c, g, or t
tcttgagacagggtctcactccattgccaatgcctggagtgcgagtggcactgatcancggcttcctggagcctcaacttcttgggcttccacctctgcctcctgagtagctgaggctacagttgcatgccaccacacctgctaattttttgtagagacaggtttttgccatgtttcccacgctggtcttgaatgcctgggctcagcaatctgcctgcctcaacctccctactaa

SEQ ID NO: 602181 - DNA, 827 bp, Homo sapiens
ggcccattgtgctgctctgaaaagccatctttgcattgttcctcatccgcctccttgctcgcctgcagcccgcctccgcccgggcgcttccttccgcctgcccgcgaaactccctggaaggcttcatcgccaagatgtcccttgaacctctcgccttatctttataaaataccccttgcattcggattcaccgggcggtgacccaaaaacattgtcaggagcgcaggcctgtaagaaacacaaggctcccggaaacatttcaccccaacccaaaggggaaccttttacacagtggtcccgacatgcaacagggaacagatcgcacggagaccaacagtggtcaggacacatcgttgggcaccatgagaaccgtgccccctcttgcataaaaccggtcgacaatttgccttaaattgcagcgacacacattctggggccgccacccccaggagacgcgcctagcccccaccattgcaacggtctacccacacgaaaacgcaccaagctggcccaacagaaatggggtggccgcccaacgcacaccgacagccgacgcgcaacgggcaagccaactcgaacgtcgtcggaactggcatcgcaagcgcaaaaagaagccgcactggcagactcttgaaccgcaattgcaagcgcaaacgccttggaagcctccacacactaaacacgcgcgcgcaaaacagccgtgacccacaccctcgcacacgaaactcacatgacgcggcatgttgaccgacatgctctgaatcacccaaaagcaaactgcagaaatgaaacgctgactgaacgttattgccaaaacaacacggcac

SEQ ID NO: 602182 - DNA, 206 bp, Homo sapiens
cctaaagttatttgttgttgttgttgttgtgagatgagtctgctctgtctccagggctgagtgagtggtgcatcttggtcactgcaacttcactggtggttgagcattctctggctcaggctccaagtagctgggtacagtcgtgtgcaccatgccggctattttttgtattttagtagagacggggttcaccattgctggcagct

SEQ ID NO: 602183 - DNA, 115 bp, Homo sapiens
gggtgggtaggttgttgatatcctagtgggtgaggggtggcttcatagtagaagagcgatggtgagagtggtgcggtgatgtaagtgaggagagtggcgggtactaggggctctg

SEQ ID NO: 602184 - DNA, 178 bp, Homo sapiens
aaaaattaaatgaattatcaagggttttggacaagacatatgagccatttttagtcattcaaaatagtaagttacaaacaagagaacaaaagaagaaagaatagttaaaatcattaatttttttatttttcaaactgtgtaatgtgatgttttcaaataaaaactatctcaaaatttt

SEQ ID NO: 602185 - DNA, 102 bp, Homo sapiens
ggagccgcgttgctgttccacggcctcggtttttcctaacttgctctgatgctgtcagggctgccccgcggtcatagacttaaaggactgcaataaatgtag

SEQ ID NO: 602186 - DNA, 670 bp, Homo sapiens
gtttttgataaccttaatagttttgaagcgacttattggtcatttggtcaaatgtccttcaattgggttttgcctgtatttttctcatgcattaactgaggttatgggtttttcttgagttaagagaatcagctgcttccccaaaaagccaagggtacgtttaatggaaaatgatattagaaatcaagatttggacatttgggatgttgttgcttctagacactctcagctgacagagcaaggaaatatttgtggatatgctaacctgactaaatacgcatatctgctccatacctacctaacatctatcttctcaagaactctgccagggaaggagtagtttctgtgtttcataaacagactgagactcaaagaggctaagtaaactacctgaagccatatagcaacacacaatgacggatgtgagattcaaacttggatttatctggctccaaaatttctagttgtttttttttttttttcccactacagcaaaactaaggagaagagacagaggtgaatagctgtctctcagtggttattctgttttcccttatctacatgttttcctcctttcactctctcttggtttgttcttatccttcagaggtaaagaggagccttcagagagctataaaggttgatcaaagtaccagattatgagattaaa

SEQ ID NO: 602187 - DNA, 110 bp, Homo sapiens
accgactagccgacggggttgaggggagtaggcaggaggatcatggggctgtgggaccagagagaagctggggtcagaggtaggagctgacgctgtcgggctagtcgggg

SEQ ID NO: 602188 - DNA, 130 bp, Homo sapiens
ggggcgagacctacgacgccggcgagcagtggccgttacgcctaaaaagatggcggtctttgcacctctaattgctctgtgtattcggtgccgcgactttcacgatggctcgccaaaccttactaccttc

SEQ ID NO: 602189 - DNA, 164 bp, Homo sapiens
tttttttttgtaaagatgatgtcttactatgctgcccagactggtctcaaacgcctggcctcaagtgatcctcccaccagggccttccaaagtgttgggattacaggtgtgagccattgctcctagctatttttctttatacctttgctcaagctgcttcctag

SEQ ID NO: 602190 - DNA, 717 bp, Homo sapiens
  misc_feature (482)..(482): n is a, c, g, or t
  misc_feature (504)..(504): n is a, c, g, or t
  misc_feature (510)..(510): n is a, c, g, or t
  misc_feature (592)..(592): n is a, c, g, or t
  misc_feature (596)..(596): n is a, c, g, or t
  misc_feature (628)..(628): n is a, c, g, or t
  misc_feature (667)..(667): n is a, c, g, or t
attcgcggccgcgtcgacgctttcctaataaagaaagcaccaacaccacattcttcgaaattactggaattttatttgcctcaggttatgacttgcaaccaaagacattgtgcaaagaaagcaaagattaagtacactttagggagaaggagacgatacacattggtaacataggagatcagggtgacaaaagaagccatccaatacacattggtaacataggagatcagggtgacaaaagaagccatccaatacactatgtagattgcaatattcaatagcgctttcaacaaaactttttttaaatcaagagcaaaaaaattaagcaatgtttacagtagacataaatcttatacaattcaaaaagcttttgttcagatcatagagcataaaatggaaaaatgtatatgcaggtgaaatctaactactgtacatttatcacctattaaagttgcttatatgtaccacagtgtaaaaaaacnataccgaacaaataaaaacctngaaaantgcctgatgaaaaaattaaaataacccggtggcttttaaagggcttctcctgggtatcagggcttccaaaagaccaaaaatntttnttcatctgaaccaggtggataaaaccagggcncaaattaaaccggttacccaaattaggaccccacccatnggtatcctattcaccccccatatttttcctcggcttttttggttgggttc

SEQ ID NO: 602191 - DNA, 1052 bp, Homo sapiens
  misc_feature (526)..(526): n is a, c, g, or t
caaagggtgactcctgtgagcggcaggcactctggccacttcatgcccccagcctggtgctgcctctgctagggccgcctcctatctcgagagcttcagggcagtgccccaggagcaggagcgcaggtccgtgatcatcaggcaatgcacacacttatgcatgcccaagaaaggacgagcggctcccttgggcaacccatgcgaaagggttacaggtgccaggtcctgcagtctgaaagtgtaactcgtgatggtaggtcgtccgggctcgggaccgaacagcaatttgtaggaccatggacgtgatagtcgcaccggaaaagtggtccacccaggagtgttgaccatgggaggccagcgacagccttgcgtcaagtagagcaactaagatgaaacttgcagtcaagagaagcttgccgaccggaagaagaagctaagttgagtcgccgctagtctcgagactcattctggaagggtctccttgaagtcccattcgcagacctgctgaggcgtaactctctcctgnggctctagcggttgtcaattcgatgggcaagggacgaggtgttcgctctgctgcctgtgttgtgtgactgggtaccgacgtggtgggagcgaagggggacatcaggtccgtatgtttcccctatccccgtgtcttatatgatagcaacccgtgctttgtagatctggtctagttttactccgtagcggtgatcctggataaatgtactggatcgaatggatactctgtggcttgttacacattccttcatgagggtggagtcagttctacctatgcgttgttctggagccatcctacgatgtaaggttccgactgaaagtggtcgcgggtggtcccctatttatattgcagcggaggcacccgttgtgtcctgggactaccaagggtccttatctttaagcggcaccatttgggttctttttcctatttacacgggcttggtttccacagaagggcctctgtattgcttttttgggtttgacttgctgggtgcagaaatggcccggcgggtggccttggccttgga

SEQ ID NO: 602192 - DNA, 128 bp, Homo sapiens
tgtgtagtctggcgctgcgtagtgtgctttctcgatgtttacatccacgccatcgttggttatagtggttagatgtgttggttagtaggcctagatatgaggagcgttatggagtggaagtgatatca

SEQ ID NO: 602193 - DNA, 957 bp, Homo sapiens
  misc_feature (3)..(3): n is a, c, g, or t
  misc_feature (93)..(94): n is a, c, g, or t
  misc_feature (111)..(111): n is a, c, g, or t
  misc_feature (118)..(118): n is a, c, g, or t
  misc_feature (143)..(143): n is a, c, g, or t
  misc_feature (150)..(150): n is a, c, g, or t
  misc_feature (172)..(172): n is a, c, g, or t
  misc_feature (176)..(176): n is a, c, g, or t
  misc_feature (181)..(181): n is a, c, g, or t
  misc_feature (191)..(191): n is a, c, g, or t
  misc_feature (259)..(259): n is a, c, g, or t
  misc_feature (283)..(283): n is a, c, g, or t
  misc_feature (287)..(287): n is a, c, g, or t
  misc_feature (289)..(289): n is a, c, g, or t
  misc_feature (295)..(295): n is a, c, g, or t
  misc_feature (323)..(324): n is a, c, g, or t
  misc_feature (329)..(329): n is a, c, g, or t
  misc_feature (333)..(334): n is a, c, g, or t
  misc_feature (362)..(362): n is a, c, g, or t
  misc_feature (413)..(413): n is a, c, g, or t
  misc_feature (418)..(418): n is a, c, g, or t
  misc_feature (428)..(428): n is a, c, g, or t
  misc_feature (459)..(459): n is a, c, g, or t
  misc_feature (461)..(461): n is a, c, g, or t
  misc_feature (496)..(496): n is a, c, g, or t
  misc_feature (509)..(509): n is a, c, g, or t
  misc_feature (532)..(532): n is a, c, g, or t
  misc_feature (553)..(553): n is a, c, g, or t
  misc_feature (598)..(598): n is a, c, g, or t
  misc_feature (604)..(604): n is a, c, g, or t
  misc_feature (611)..(611): n is a, c, g, or t
  misc_feature (616)..(616): n is a, c, g, or t
  misc_feature (621)..(621): n is a, c, g, or t
  misc_feature (625)..(625): n is a, c, g, or t
  misc_feature (628)..(628): n is a, c, g, or t
tanagatgtgccctccagagggctagatgtggaagatgtgaaatttgtcatcaattatgactaccctaactcctcagaggattatattcatcnnattggaagaactgctcncagtacnaaaacaggcacagcatacactttcnttacacntaataacataaagcaagtgagngacnttatntctgtgcttngtgaagctaatcaagcaattaatcccaagttgcttcagttggtcgaagacagaggttcaggtcgttcnaggggtagaggaggcatgaaggangacngncggganagatactctgcgggcaaaaggggtgganntaatncctnnagagacagggaaaattatgacagaggtnactctagcctgcttaaaagagattctggggcaaaaacccagaatggtgttnacagngctgcaaatnacaccaatgggagctttggaagtaattttgngnctgctggtatacagaccagttttaggactggtaanccaacagggactnaccagaatggttatgatagcacncagcaatacggaagtaatgtnccaaatatgcacaatggtatgaaccaacaggcatatgcatatccngctacngcagctncaccnatgantggntanccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactga

SEQ ID NO: 602194 - DNA, 669 bp, Homo sapiens
  misc_feature (434)..(434): n is a, c, g, or t
  misc_feature (456)..(456): n is a, c, g, or t
  misc_feature (462)..(462): n is a, c, g, or t
  misc_feature (544)..(544): n is a, c, g, or t
  misc_feature (548)..(548): n is a, c, g, or t
  misc_feature (580)..(580): n is a, c, g, or t
  misc_feature (619)..(619): n is a, c, g, or t
attcgcggccgcgtcgacgctttcctaataaagaaagcaccaacaccacattcttcgaaattactggaattttatttgcctcaggttatgacttgcaaccaaagacattgtgcaaagaaagcaaagattaagtacactttagggagaaggagacgatacacattggtaacataggagatcagggtgacaaaagaagccatccaatacactatgtagattgcaatattcaatagcgctttcaacaaaactttttttaaatcaagagcaaaaaaattaagcaatgtttacagtagacataaatcttatacaattcaaaaagcttttgttcagatcatagagcataaaatggaaaaatgtatatgcaggtgaaatctaactactgtacatttatcacctattaaagttgcttatatgtaccacagtgtaaaaaaacnataccgaacaaataaaaacctngaaaantgcctgatgaaaaaattaaaataacccggtggcttttaaagggcttctcctgggtatcagggcttccaaaagaccaaaaatntttnttcatctgaaccaggtggataaaaccagggcncaaattaaaccggttacccaaattaggaccccacccatnggtatcctattcaccccccatatttttcctcggcttttttggttgggttc

SEQ ID NO: 602195 - DNA, 859 bp, Homo sapiens
  misc_feature (4)..(4): n is a, c, g, or t
  misc_feature (66)..(66): n is a, c, g, or t
  misc_feature (124)..(125): n is a, c, g, or t
  misc_feature (150)..(150): n is a, c, g, or t
  misc_feature (247)..(247): n is a, c, g, or t
  misc_feature (263)..(263): n is a, c, g, or t
  misc_feature (315)..(315): n is a, c, g, or t
  misc_feature (318)..(318): n is a, c, g, or t
  misc_feature (331)..(331): n is a, c, g, or t
  misc_feature (358)..(358): n is a, c, g, or t
  misc_feature (398)..(398): n is a, c, g, or t
  misc_feature (571)..(571): n is a, c, g, or t
  misc_feature (588)..(588): n is a, c, g, or t
  misc_feature (648)..(648): n is a, c, g, or t
  misc_feature (675)..(675): n is a, c, g, or t
  misc_feature (686)..(686): n is a, c, g, or t
  misc_feature (733)..(733): n is a, c, g, or t
  misc_feature (765)..(765): n is a, c, g, or t
  misc_feature (796)..(796): n is a, c, g, or t
  misc_feature (846)..(846): n is a, c, g, or t
aggncgcgcgaagtgacagctttgaaaagaaggggattcggcccggcctggctcctcagggatgcnagcccttgagactaaggaatgttccttcagggaaactagggtggggtttgaatgaganntggggggcaggcatggccctgagtncctactcagcgccccccaccctccacctctgcccttcagcaggttggggcagccagatcccttccattccagaactgccagagactgggacgctttngaaggtaagggcgcanagcggcggcgggagattgaactggggccacctgagggcccgaggccccgttntgngggcgggttgggnggagaaggccttggcctgcctgaagcnggaggcctcagcaaaggagaaagggggccaggcccatgcnccaccccggcctgggctgccaaggtccgggctgggcacagtgtccattttctaacagtatggcgggagaggggcaggcaggaggcagggccaggccccagggtgcagagatgtctgttcgggctagggggcctccagcactccgggctggaagcgtgcagtctcctggaagangagctccttcagccgcnccttaggtaggtcatccagctccatggcgaaggtgaagggctcctcggccactggctcanccgttgggtcaaagttctgctccaggnaggggtgagcnagcgcttcctccactgttatccgtttattggggttaaaggttaacanccggtccagcagggcaagggctttggagtttnaattgggggaaaagcttggcccaagccaccntgggtcttggagggcagaaactgttgggagtttcgggccttcatgttgangaaacaatacagg

SEQ ID NO: 602196 - DNA, 241 bp, Homo sapiens
catggccccacttgtatccagaagttcccaggggtgattgtgatggtggttggcgactggaggttgtataaggtgttcttggaaggaaggcgcaggagctggaattagttggtccctactgtcccccatgaggtcgtgaacccctcttcctgacttctcatgcttcttaaaggcattttggcttcttcaaatctgtacagcaacagcaacttttcctgtcaaatacactgcgaaactgcag

SEQ ID NO: 602197 - DNA, 652 bp, Homo sapiens
agcgggagtgcgcccgtggtcccggtcggcgccaggtgcgttcactctgcccggctccagccagcgttcgcgccaggcacgtagctgccccaggctccccgtccccgctgcctgagtatggcgacagcgctcctgtcgggagaaggctcagaagctgaacgagcagcaccagctcatcctatccaagcttactgagggaggaggacaacaagtactgcgccgacgtgcgaggcctaaggtcctcgatgggcttcctggaatattggtgtgttgtattgcgcatcagatgtgctggaattcatagaaatcttggggttcatatatccaggtcaaatcagtcgaacctagagccaatggacatgcagaacacgatacggtgcgtgcgagatatgggaaatgctacaatgcaagactactctatgaagccaatcttccgagagaactttcgaagaccgacagagcagatcaagcagtggaattgttctcatcagagataacatatgcacagagaagaaatactacgataaaatatgccatagctattacaaatatttcctcctctgatgctcctctgcagcctttggtatctctccttctctgcagagctgctgtggaccagaataaatgggagaaagaaaaggaaaacgaagga

SEQ ID NO: 602198 - DNA, 144 bp, Homo sapiens
acttctaacacgccctgaacttgaacttatcagcttaaattaaagtgtgcattgacaaagactctggggacgttgcagctctcagaggatcccggaaatttaacgtacctgggcacaaaacacaaaacgtgatgaacactggaa

SEQ ID NO: 602199 - DNA, 245 bp, Homo sapiens
gccctcatacatggaggatggtgttggtagcgacgagtgagagagtggataggggttatgcaccatggaggatgccttctttaccatttccctgaagccctgagggaggacagtccatgtgagttgttgtgactggagggtgtcaggatcagtccaggtgaaagcaaataggttttgggaatcaggctgtagggaaatggtaaagaaggcatcctccatggtgctgacatcctccatggtgctga

SEQ ID NO: 602200 - DNA, 146 bp, Homo sapiens
cctcgcctttttgataggatagtagaaaagagctcccaaagctcggataggagactggacaaaagaaatacctggtgcgttctgatctcacagtttgggccagtctacttcttgatccgggaagcgaattcatctccgagctgagg

SEQ ID NO: 602201 - DNA, 293 bp, Homo sapiens
tctagagtatccccactatcgctaagaaaccctcggaggtagtggctacactgcactccagcctgggggacagagacagagtccaactcaaaaaaaaaaaaaaaaaaccctaaaactggtggtaccccaaataactgaccaccaaaaattcccgccggaaaaatttagagccttctttcttgaaattaacttttaaacacgttttcaccagaaagcattgaggctaacatgtggcataaatagctgtcagctttatctcgtgctacccacagaaaaaggtaaattatatgaca

SEQ ID NO: 602202 - DNA, 330 bp, Homo sapiens
accacatatggtgactggcacaagctactgagatatcagataactttttgtcaacatatctaaagagtttatatcacgcacagtttaaaatcatgatgagatgctgatggttggacgatattcatgtcatagctgttgcctgatattaagataacacagttgatccatgattaaccatgccaagggaacatctcaatcagtaagagaacatctcagccagtgtcatcttgagaagagcatcaacagcagagggagcagaaggaggactgtctgggcttggagactcggtgcaaccccacactcccttgcatactcctcaggatggtaggc

SEQ ID NO: 602203 - DNA, 157 bp, Homo sapiens
cttcccccccccctcccaaaaaaaaaaaaaaaaaagccagggcaaagggcctggggtggcccttttttcttgccccagcccaccctttgggaacaggcagctcctttttccaaacttttttcccccttttttaaaaataaaggaactggccctttta

SEQ ID NO: 602204 - DNA, 431 bp, Homo sapiens
tgccctagggcattaactgcgtaggagtaggcagcgggaagaacctctggccaccgatttagatgcttgagtctggctaacacctttatggttgctccccatgtgatgtccgaaactcttcccatgggccttgtatctcacccctaagtatatctacagtcctgctgtcaagattgaatacatgaaaacccaccacatctgtgtatggtacgagatcccagatgcctgttaagctgagtgaaagtccatgctgtcttttaaatcactttatatctacttaatcatcccacagtaacccgagttgaacaagttacttgggtttctcataaatgattatgcacgtgctgaacatatcggaaagaaccacaccctctcactgatgaacacgtgggcagttctcagtgagagtctccgtcgaactggggatctct

SEQ ID NO: 602205 - DNA, 379 bp, Homo sapiens
acaactgtaataccagctcctcaggggacatgcatgagcctgaggcgcgggaaagcatgcagtgagccgcgatcacagcactgcactccagcgtggccacagagcacgactctgtctcaaaaagaagaaacaaacaaacaacaaaaaacacagcacagaagggtggtgctgtgggcagaggggtatttccagtggaatgggctgtaacagttatctcaaggttggtcacgatcacaggaccatggaatgctggggcccgaaggcactaaggccacagcatcaacatctacttcccagagcataacaccaaggcccagagcaactgggtactgtgctgggagctacaatgagtttgaggcagagtctgggctaaaaacca

SEQ ID NO: 602206 - DNA, 857 bp, Homo sapiens
acggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggctgccaagggcgcgctgcgaccccggctgcttcgcgccccatgcaaccgcacacgccaccgcgccgccaggcgcctgccgaacgagctcaaggcaggagcccgggcttcggagcaccgctgtgactagcgaagctggcaaggacggaggccgggggcgcctgggcggcagagcgctgggcataggcgggcgggcttccctgtaaccgccgctgcgacgactgtacctcagggatacccagggctggtgaccgaagcgggcgaggcgaagccgaggaagcccgtactacccagcgatccgtccctacgggtcccagccgccggccacgggacagcggcgcggaagcgcccggggggaacggcccaagggagggcgccacgaagacagcccatggcgatcgccagcggaggccagggagccagggtcagaccccgtacgacaggggtccaatgaaggccacaggcgcaagcaaggaccccgggcggcgccacggcaacgaggcagcaccgaggtaacgacggggatcccgggacggcgaagcggcaacaaaggattcggaccggtggcgcgagaaaaagcccggcgagagaaggggccaaacgatgggccgcacgcccaggaggcacgccggaacccaagggttccatgggaaggcgtcacggggccggaacagccaagcggacttggcggaaagaaag

SEQ ID NO: 602207 - DNA, 360 bp, Homo sapiens
gtgttcccaagcttgattgccacaatcaagttggtcttctccctggcgcatgcacggatggttcaacgtaatccattacataaacagaaccaatgacaaaaaccacatgattatctcaatagatgcagaaaaggcctttgataaaattcaacaccccttcatgctaaaaactctcaataaactaggtattgatggaacatatctcaaaataataagagctatttatgacaaaccctcagccaatatcatactgaatgggcaaaagctgggagcattccctttgaaaaccggcacaagacaaggatgccctctctcaccaatcctattcaacacagtattggaagttctggccagggcaat

SEQ ID NO: 602208 - DNA, 118 bp, Homo sapiens
cttgtccttcttggatgaataaggtctgaccttccaaactttcacaacacactgagcatctaagcaagtgtcatgccaggtgtagcccagatgcttccagtgaacatgtcaccacgct

SEQ ID NO: 602209 - DNA, 407 bp, Homo sapiens
cacggggactatcccccgccagctaagcacttgactctcttggacggcgggcgatgactaatattagccgtagggcggcaaaaaaattctctcggccgatttccggtgggcccgaaggtcgtcttgagccccgcatgaacaagctcccgtcgggtccgacacaggatgagccgccgcctacagcggcggcgctcacctgtcgcaccaaggcgggcgagccctactgccggcaccagagcgtcgaggccgaaatttccgtgggccggcgccagccccacaatcggtggcctagccgcgagtggcgtctccaaaccctggcccatctcatacgacttcggtcgcacgacaatgatccggaggtgttgggccgtctgactcacaccttcctcgaacgcgtcaagccgatc

SEQ ID NO: 602210 - DNA, 575 bp, Homo sapiens
  misc_feature (178)..(178): n is a, c, g, or t
  misc_feature (182)..(182): n is a, c, g, or t
  misc_feature (190)..(190): n is a, c, g, or t
  misc_feature (195)..(195): n is a, c, g, or t
  misc_feature (206)..(206): n is a, c, g, or t
  misc_feature (217)..(217): n is a, c, g, or t
  misc_feature (225)..(225): n is a, c, g, or t
  misc_feature (234)..(234): n is a, c, g, or t
  misc_feature (303)..(303): n is a, c, g, or t
aacgttactgattatcgtgggaaatccttggtttcttgcttccacccactcgatttcacatctgtgtgtcgactgaacattctcgcttttggtgtacgcgttgcagaattcagatctcgtgcctatctggagtggtacgcatgctctgttgcttcccagtggacccttgcggcctggnttantacccctnaaganaaggaggactngggccaataangattcccnttctttcanatttgacccatcagatctcaaaggactatggtgtatacctagaggactcaggccacactcttagaggtntcttcattatcgatggcaacgccatcctaagacagattactttgaatgatcttcctgtgggtagatcagcggatgagacactacgtttggttcaagcattccagtacagtgtcaaacacgcaagcgtcccgccctgctggctggaatcctggtagtcaaacaataatcccagatccaggtggaaagctcaagtatctcgataacccgcattgagcaagacttcttccagttatgatgcttgaaagttctcaataaagttctcggtttcatta

SEQ ID NO: 602211 - DNA, 175 bp, Homo sapiens
gatcgatctacaggatctttacctggtatcccacccttgctggcaggtataagtcatgcccacctgcgcaggacgctgtggggagcatttttctctgagttgctaagcagaacccctgatgggcggtgagcagaggaaccacagaaccagccacgggcctcaatggctggcagcg

SEQ ID NO: 602212 - DNA, 160 bp, Homo sapiens
ttgctcatctgcgatggaacgctttctcagaactggagaaatagaactgtgcacggaacagcttccagaagcgaaaaccaggttgaaaggggaaaaataaaaacaaaaacgatgaaactgctttctgggggttggttacttagttaccttgcctttgcat

SEQ ID NO: 602213 - DNA, 284 bp, Homo sapiens
  misc_feature (2)..(2): n is a, c, g, or t
  misc_feature (15)..(15): n is a, c, g, or t
  misc_feature (201)..(201): n is a, c, g, or t
cnagtggcatgatcntcaagtcactgcaacctccgcctcctgggttcaagcagttctcttgcctcagcctcccgagtggctgggattacagatgtacaccaccacacccagctaaatttagtatttttagtggagacagggtttcatcatgttggccaagatagtcttgatctcttgaccttgtgatccgcctacctcggnctcccaaagagctggggttacaggcgttatctaccgcacctggtgcaaaccaggttttctgaaagttaaaaattatccagccg

SEQ ID NO: 602214 - DNA, 908 bp, Homo sapiens
tgaccacagtaacatgggcaacaagatgctgcaggccatgggctgtgcgggaaggctctggcttgggacgaaatgtgtcaaggcattactggctcccgattgaggctcaacgttcggctaaatgggagctggactatggagccaaaggcagcgcatatggtttgtcgggcgccgattcctacaacagatgctgtccggaatagccatgtttgcccggttcactgacgctggcagtgagagagagcagagagagagagatgacaacggagcacaactgaacgtggtccatctcccgaattcgctgtaaccggcctgtctctttaacgggcatgccttgctgcctgtccactagatctaagggtgaaccacttcattctgcagggtatctccctccacaccttacagaagttccccttatgtggagtagcctggtgaatggccttccttcccgccagagggctcgtgaacagaccggagaggacagtggactcgcgaagtactccagtgtacactcgtgtacatgtacgcgtgtgtccatgtgtagcctatgtcgaggtccctcagcccctcacatatcctaggggatacggagactgcttgtacacgtggtactgctgacaccacaagccacctctgatcaatcggacgctgaatgtcccatcttgcgcacaccagccatgggcactaatcggcaatcttacccaattcgggtccccgtccaccttcgggaacacctctcccagccccaaggtcggccccaaaataccataggcaccctttacgccccaggcacaaagccctgtaccacgcaccaccagcaccacgccgcaggcgccaccccacacagaaaacaccccacgggtgcggccccaaacgcaacaccgcgaaccccacgcacccggcggtac

SEQ ID NO: 602215 - DNA, 104 bp, Homo sapiens
tgctggtgacctcgcggctcgggctgtggctccaggtggagccaccaggctgacagataaggcagtgaaggactattccgcttaccgttcttcccttctctttt

SEQ ID NO: 602216 - DNA, 100 bp, Homo sapiens
gtgtacccgttgggcacgcaccgtccagttcgtccctttccagcttttacatgtgaattgctgcgtaattgttcggacccgacacggtgcgttggcccaa

SEQ ID NO: 602217 - DNA, 454 bp, Homo sapiens
  misc_feature (348)..(348): n is a, c, g, or t
aaccttgtggccccctttggcccggttttttttaaattggttcaggttttggcaaggcggtccgatattgtgggcgcttaattgtggcgctattttggcctctaatgtggggcctctatttgtagaattcctattggccacttcttttgccacggttttaaccgggaaaaccctgggaatccccgagttatcccccttgtgaacactttcctttttgcccctttgggaaattcggaaaagccccgaacggtccgccttttaaaacttttgccaactttgatggcccctggaaactgaagggcttttttttgggtaaaatttggggatactttttggtaaattgggcgnatttctaacccattgtgccccaattgggcaaattccgttaaaactcctttgaattccccggattgcgccagaatggggttccagtttgaaccaggggcccctttta

SEQ ID NO: 602218 - DNA, 762 bp, Homo sapiens
gggccaatgggtcttttccttttcctttttagaaaaagagtaaaattctactcgatgaacattcagcagcatggtgtgaagctattatggccacattctggaaatcattgcattcttccaagcaaagaaataagaaaatcttcccaaacaaatgtcagaaactttaccacactgtcatacatgctgcctgtaacatttgtcttttgttaattttttttttctggctttcatctcaagtgtctctcaagttttggcaatttcaagtcttctagtttccatggaaataggaaacaatgatctctgggagattaagagcggggagatatccactctaatggagttctagagttttcttcctttgatagtatttgtgaattgagagaatgttggtgtggaggcagggcttcggtgtcatcaacaaatctttatttttgtgcctataatgcatcaggcattgttctcttccaggaatgcctccacctccaaactgctacattaaaggtaaacatgctctcccagatgtgggctctcaggtttattcttaagtgaaattcaaattgttgagcaggaactattagctctgtagtgagaatctttaccttttccctctaggcaacctcaagcacttcagatattttatagagctctttgtgacactcgggttacaaagaaccatggtgtatatacattgttaattttatttttttattatctatttcacaaggaaataaaaatctcgacttccagagcaagacaaaaaaa

SEQ ID NO: 602219 - DNA, 459 bp, Homo sapiens
  misc_feature (49)..(49): n is a, c, g, or t
  misc_feature (51)..(51): n is a, c, g, or t
  misc_feature (222)..(222): n is a, c, g, or t
  misc_feature (225)..(225): n is a, c, g, or t
aaaaggtgaggggggaaggggccccgtgtatagtgaggaacgccccccncntattttttccgcggaaagaagggtgggccggggggttaaaaaaagagtgaatttttttttaatttctcccccttaagagaaaggggttttgggaggccccctttggtggggcccgggaaaagtggggaaaaaggggttttttaacccctttggggtccaaagattcccctnaantgccctttggccccgggataatatggggttaattgcccccggtttttaaaaaaagccccttaaaaaaaaggttttgggaagaaaccctaagggggggttattggtccccccccccaaattagggggggggggccccccctttttttggtgcaaaaacggtttttccaaggaaaagggggtttggtaaccgggtgggggctaaaaaatagggaaaaaacccctttttttttttga

SEQ ID NO: 602220 - DNA, 765 bp, Homo sapiens
tgtttacctgcgcaggagccgcaggagcgtaggcagtcatggctgcccagccggaatggcatggtcttgaagccccacttccacaaggactggcagcggcgcgtggccacgtggttcaagcagaccggcccgtaagatccgcagacgtaaggcccggaatgccaaggctgcgccggatcggtccgcgcgccgcgtcgggtcccatccgggccatcgtgcgctgccccacggttcggtaccacacgaaggtgcgcgccgactcggcggtttcacctggaggactcagggtggccggattcacaatgaatggtgtgcccggacatcgtgatttctgatggatccgaaggatggcggaacaaggtccacggagtccctgcaggccaactgtgcagcgggcctgaagggaggtacctggtcctaaactcatcctcttccccaggaagccctcggtcgcccaaggacaggcgagactcagttctgcgtgaaggaacgtgaaagctggcctagcacctatcttgaaccggactcaggtcgatagcccggtcctggtaacgttctatgatgagaggaagaagaggctcgagatcatgcacgtgagcgaaggatgaagcaattttccaatagccgttcgtctaagtctaccgttataggccgctgtgccaacggccctggctctttctggcattacgggcaaaggaagatgcgcaaggaaggcccgcagaacgaggatcgttgacaaggaatcgtggataaatgccctacctg

SEQ ID NO: 602221 - DNA, 1002 bp, Homo sapiens
tatatgcattatggaacctttatttttcatgtgattctgtacataaggagtatgagagtaaccctttacaaatgtcattccatcactgaaggacagatcttctgtggaaacaaaatggtctacaaaggtatccgccctgcaataaacgtggctgacagtatctcgtgtcggatccggtgccaaaccaggggctatgaagcaggtaccaggtaccatgaagctggaatgaggctcagtatcgcgaggttgctgctttagcccagtccggatctgacctcgatgctgcccatctcaacaactttcgagatcgatggagtgcgtctaacatgagttgctgaagacaaggaccgtattctcccatggctattgaacaacacaagtgggctgtcatcatatgacgggcggtaagcgggaaatctatgaatcaaaactggcgcccaccaagatcacaacaggtttcgaaaatcgcactcactagactccaatgtacgacagccacacacaccaaagccaccgcagggaccaccaacacagagcccgacgccaaagatccagcaacaccccaaaatgccaccacgccagcaaaacgagactcgtacaaaagatccatcaggcccccggctcagaacctcaaacccaccggggcaatcccacatcaacactaacacaaccacatacgccaccaaggtcccagacaactacggcccatccggacaccgggtcacatcaccagcactcctgtttgatacagaaaccgaccattgaacagaacacaaggtccaccacagtgcctacagcaacacaaccgccaaacccaaccgtacgcgacccacaacccagacacgagcacgcgaacaaccaaaaaaaagcaggacacctcaccccaaatcccacaggacacacgacgcccacccccaaacacaacccacgagaaataaacaccgcagagcacaccacaagcacaggacgccgtgaagacgacacaccgagtcaacacaagca

SEQ ID NO: 602222 - DNA, 221 bp, Homo sapiens
tttttacccccgggtccccccccgggtccccggaggggtggggaagcaatgaccttgcctgccccgttttttaaccgccccatccccccccctttattgaggggggggggaaccccccccgccagtttttgggggggaaacttttaaaaggttgggaaatttttcccaaaagattttttttcaaaaggggttaaaaaacaaaaaaaattttttttttttta

SEQ ID NO: 602223 - DNA, 209 bp, Homo sapiens
taagattgtacagttgaggggatcagatcatccgtgcagtacaatacttggtacaagttcaataagcccggtacgcttccatcacacccgccagaccattacggaaagctgggacaatggaagagttggggagatttcttaggcgtggtcaatacgtatcccgtcaatgaaaagattgactggcgtccatataacgaatgtttagctta

SEQ ID NO: 602224 - DNA, 111 bp, Homo sapiens
gaggatcccggaagcacgactgcacatgattaagggtacagatgcagcctcatttccaccttttgtgagaaaagccaggtatgcagttcttttcttctgatatttgcaggt

SEQ ID NO: 602225 - DNA, 490 bp, Homo sapiens
accaggatacagggacaagcctctccacccggctccctagagccattagaaagctcagcacagcagggcagtggtggcacacgcctttaatcctagcacttgggaggcagaggcaggcggatttctgagttcgaggccagcctggtctacagagtgagttcccggacagtcagggctatagaaaccctgtctcaaaaaacaaaaacaaaacaaaacaaaacaaaaacaaaaaactcagcacactaggatccaggttcctcataactagcttgatacccagcgttgcttggattggccctgggcctctttgatctgggtcccagatgctatggataccaccacttccaccccaacagtctcactatttccctgcattataagctgtgagaggctctgggctatacctctgctttccctgccccaacccactgtttccttggtgtccaagggagccaaggagttgaaaccagacggggctttgtgcttactg

SEQ ID NO: 602226 - DNA, 730 bp, Homo sapiens
catatgtacaaatcaccatattcttcaggaactatgatgactggcgtctggaaagaataaagagctctgcagcagggcgatggatggaggtctcagtgttctggtgatcttacagattggttgaccagctttcagcaggaagaagactagaaagaggagatcgtgaagaattcataggactaagaagatagaagaatttcagatagctgtggagacaatatggtttagataattctggaggatacatagactatacaactaatttacggacagagtagtggtagagtagaagtatataggggaggaatgcctgcatctgaatttggcataggagagatcatgctgatattgagtggaagtcattagctgcttggattttgagcgatggataatcagcaaagactttcggaagtaattgaagcagttcatgaggtattatcagagatgatgccagcagatgtgagacgggtgtggctttcttcagtggtggatcactttcattgatctttagcgcgaacaaaggctggggttgtggttacgagaaatttccatagtgatactttcatcattattacgagaatgatggttacagcgatgcttgaaaggtatgtgattccttgcattccaagataattcatctatgatgaacgatgcatggaggaaggttggatcctcagggggcgtctcagtaataacaggttacagggaggaaggctggattggagcgtgt

SEQ ID NO: 602227 - DNA, 161 bp, Homo sapiens
gactctacaggatccccagttgactcgtaatgataaatacagcttatttgatggctatagggctatcagattgtctacttttaaatttatgtatatctttatttgagatggagtcttgctctgtctcccaggctgagcaacagagtgagactcgctgtttc

SEQ ID NO: 602228 - DNA, 134 bp, Homo sapiens
  misc_feature (27)..(27): n is a, c, g, or t
  misc_feature (114)..(114): n is a, c, g, or t
cgcaaggaaagttgaaattttacccangcatattatagcacggctaaccctataccttcctagaaaaatgaataaccaggaaatacctttgataagggggtacctaaagcttangcccccccaaaccagggggg

SEQ ID NO: 602229 - DNA, 672 bp, Homo sapiens
ccccatgtgatctggatcccctgagcggtcacacctgctccccgaattcctgctctgggagcccgagccctctgccccaggctctaccgagccccctccggccgcctcccagaagaccagaagttgcccctgggcccgcggggcatctcttggtgtagccccccgcccgccggaggaggcccccgcctgcgcccggtctccagcgcacgaccaccctgggcgggcccttcgctccggtgggcggggcccaggtcacgggagacgccccccggctgcctgggcggggcgtggcaatccgaggggagccccgcggacattccgctctccgcttccgtcccgcggggcccactcggcgttttggggccgcacgccgggagccctctcggcaagatgaccttgctacagaagctctccctcaccttcccccccacgccccggcccaggcaggccccccccccccgcgtgtcttccgtgtcaagccgtgcttgagtcctgggagcccccgagccccacccagggaccctcgaggccccatcccgttatccgagacccttcctacccccccttcctcggcgctgggatctatttttgcccacagggggggggatgggggggctggcgccaccgaacctgcacatttcaacttgttactcccataaaccgaagtgacca

SEQ ID NO: 602230 - DNA, 314 bp, Homo sapiens
taaattcgcggccgcgtcgacggctctttttagtgtcaacccaaatacacaatcaatagaggttcacgcggccgaaccggactattaaatcaaaaccttcgcacgtggtttttttagcgtccattcgtcaatcatatccgcccaatcctgcaacatcgcccgacgctgatcgcggtattcagccttgttgtaaacggcccgtacccccttctgctcgtgcgcaaggcacttctcaatccagtctgagttgtaacccgcctcatgcagcagcgtgctcgctgtgcgcctcaaatcatgcgggccgaacttgctta

SEQ ID NO: 602231 - DNA, 107 bp, Homo sapiens
tatgcagaccttgatagtaatgacaccatcctggaagtctggctccgaggagaacactttctctctagaggaggttgacacgctcggcctgcagggacaccagaact

SEQ ID NO: 602232 - DNA, 310 bp, Homo sapiens
aatcaggctacacaacagtatagtgatggcgtataagtcactttgccagggggtcaataggcggcttctactcatcagtaacaatgcataaggagagtaaattagcgaagcgacatctcaggagagaccaaaatacatcgacacgactaaaaagctactttgtgaatcaggatgagggagacactgaaaacaggaaatcctttacggtggggcaagatcctggaactttggtaacggtacagaacagtgtagtgaaaccaaggtcagacagacccacccaatcaccacataactaggaaaaactgtggaa

SEQ ID NO: 602233 - DNA, 369 bp, Homo sapiens
acctcctaccccacgctcctaccccacgaaggaatctgccaaagaaagaaaatcagtgacattccaattcctgaaagagctccaaaacgtaagttagatagacttggaatgtgtgctactacaaagaatagtttacactagaaagtatattttatgtcaatattttaaatatacatattttgagattaagtatatgctcagctttcactaggttttggacaacccccaaatctcactggcttatgacaaacatttatttctaattaatattacatgttgtggctgcagtttggctgtcgtagttttatgtgtagcgaaggaatagtccgtatttgggaaagatttttcttgtgacgtggggtaggaggt

SEQ ID NO: 602234 - DNA, 252 bp, Homo sapiens
ccctaagggaggctatgtacatatggagccttctagaaaatgacctttcttaatatcattgtctcaggtgctaatgacagttgaagagaaatgattatttttctaacaccatttctttggttcctaaatagaatctatttcaaccaatttcaaagcatgagaagagagcaaaatcttaagggacagaagaagcttgtaatatgttgtgttagaaatgcatattttattcagcttttttctgagctggcttca

SEQ ID NO: 602235 - DNA, 485 bp, Homo sapiens
ggtgacctagaggttaccggatggcgacatttcaagtatactgttcaatggcttttagtatattcaaggttgtgcaaccatgccacaatcaattttagaacattttcatcatcctgtaaagaaacctggtactcattagcagccagtcctcatctctctaccttttccctaactccccaaccttaggcaaccactaatctactttttatctctagggatctaccttctggaaattccatataagttgaatcatgcaatatgtggccttttgtatctggcttctttcacttaggatcgttttcgagattcatccatgttgtagcatgtctaacaacttcattccccttttttttttggacagggggtctctggtctaggtggaagtgcgggggtgccatcatcgctcattacagcctcaattcccgggatacaagcagcctcttgcttgggctcccaggtagtgggactacggggttgtccaccac

SEQ ID NO: 602236 - DNA, 858 bp, Homo sapiens
gagctgtgatcgtgccattgcactccagactgagtgacagagtgagactgtgtctaaaaaaaaagtttgaattaaaaaaaaaaaaaaaaaagtcggtgtgcccgggggtcatgcctgtgatcccagatttcggaggccaaagggggtgggattacctgaggtcaggagtttggagaccagcctgaccaacagggtgaaactccgtctctactaaaaatacaaaaattagccgggaataggggcgcatgcctgtaatcccagctactgtgtgaggctgaggcaggagaatcccttgaacccagaaggcagaggttgcagtgagctgagatggtgccattgaactccagcctgggcaaatgagcgaaattccatctcagaaaaaacaaaacaaaaaacaaattcaaatttagcatgataggatcaggctacttagatcacgttctgagaggtatggtaccatagggtaatttttgatagtgaaatgtaactttgaggtttgttatatataaacatcttttccctgtggctaagggtcttagtatcagcaaatggtaagtcagttagacacatcaaatggcttttaaacttagtgaatatgaaagtgacttgggttcattaagaagaacggttattatttcagacaaaacaagtggttgagggtcggcgaatttgtcactggcctaatagcatttagatggaggtaaatccagttaaaattcggagggtcaaatatccagggttgatgaagatttggaaagcggtgtcgaggaaagggaaaggaagacggatagggaggaaaaaaagaaggttgagtagggtgatagagagttaagtgtgtttaacacgtgtttgcgtgtg

SEQ ID NO: 602237 - DNA, 220 bp, Homo sapiens
ggtcgacatcatgcagtggaatgcagttatatttggaccagaagggacaccttttgaagatggtacttttaaactagtaatagaattaactgaagaatatccaaatataccaccaactgttaggttttaatccaaaatgtttcatccaaatgtgtatgctgatggtagcatatgtatagatatccttcagaatcgatggagtccaacatatgatgtatct

SEQ ID NO: 602238 - DNA, 201 bp, Homo sapiens
  misc_feature (62)..(62): n is a, c, g, or t
tgtagatgtgtgtgtggtgtgtgtaggggtgtgtgtaggtgcatgagtgtgtaggtgtctcncccactataagaaacaggtatcgcaccgtggccagaatggggtaggtattcacagagagtggttatcaaggtgtctcactttgtcttctgatcgttttccagagattcctgttcataatgcagccactgtatctctact

SEQ ID NO: 602239 - DNA, 81 bp, Homo sapiens
aatccttgggacaagatctttctaaaatggcaattatgtactggaaagcaactaatgctggaccctttgataaagaatctt

SEQ ID NO: 602240 - DNA, 348 bp, Homo sapiens
gctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaatgaaaa

SEQ ID NO: 602241 - DNA, 316 bp, Homo sapiens
tactgaacttagcaagcgtaattaggtcacggttcatgagggactgaacgcacagagccgagaacgtcccggagatggggtaccacgaagggtgtattctcatgcacaaccgcagctcggaatcacagccacacacacatcccacctctaatgctttaaaatggctgagtaccgcagcccgactcggcatactagctccctgctcatacctgggccatgtcagtacagtagaattcgcgcgcggctagctgaacgcttgggacaactcactcgtcatgccctgtaacctgtagcccatctccatacagtgtgggac

SEQ ID NO: 602242 - DNA, 196 bp, Homo sapiens
gtatatggtgtaactgtcccctgagtttgggggctgcactcccttggagatggaatcgttactgtgagaacatccctgcagtgggagggattccctgggcgaagggattctgtgtgtcgtgttataaatgtggccccttacatccaggcttgctgctgtttgtgctttcttccccaaatttttattttaaggggta

SEQ ID NO: 602243 - DNA, 784 bp, Homo sapiens
  misc_feature (632)..(632): n is a, c, g, or t
agcggggcgctgcctcgtctctgctacccctggttgggcgcgtcctgcgacagcggctccttcgggcaggccccgcggtcgcttgagccggccgaaggaaggcgttcacgttcttttgctcgcactggccaaggccgtgacgaccaagcaagggtcgagaactcccatcagacgtgggtcggaacgacgtgtgaagccactctgcatgctactagcctacgacgtgagtcacaaggaccgagtcatagagcactggcatctgtaaccttagaacttgctagtgtcgagcctgaattgcatgagtcatggtacccggcatcgtgcgaccccctgtggtacagacggttgaccgtaccctcggagcatggagctttctcactggaggtgaactggttagcgagaggctggaagtgaaataaagacgcgctcttgtttcaggagttcgtcccctgctgagataggaatggcagagccaccttcctcatcgtctcgccatcactgcagacttaagcgtataatctaaataagcctaggcatctgtcgtaatagtttcagataccgctagtcgtcagatcaagtcagtggcgtatggcagtcagttgcacgtgtcgggtcacatggcgtgcggctgnaatgcaccacttggtcctgcctttgggcccattccatgctgagtgtccctggggcagaagatctcggatcctataatgggccagtgatggccagacagaaacatgaagtcgtgctcggggcagggtggtgccatgcccaaggggaagaaaac

SEQ ID NO: 602244 - DNA, 294 bp, Homo sapiens
tcctgactgggcgataccatgtctcgcgctgttagtagaataggatgggagtgtacatgtctctttgatgttctggtttcctttcctgggaatacaatacccaggagtgggattgctgcatcatatggtagttctgtttttaatttttcgagatacctccatattgttgtccatagtggctgtactagtttacattgtcaccaacagtgtgcaagagttcccttttctccacattcttgtcaacatttgctgtcgttcatctttttgatagtagccattctatctggggtgagg

SEQ ID NO: 602245 - DNA, 823 bp, Homo sapiens
  misc_feature (350)..(350): n is a, c, g, or t
  misc_feature (730)..(730): n is a, c, g, or t
  misc_feature (744)..(745): n is a, c, g, or t
  misc_feature (751)..(751): n is a, c, g, or t
  misc_feature (760)..(761): n is a, c, g, or t
  misc_feature (764)..(766): n is a, c, g, or t
  misc_feature (769)..(769): n is a, c, g, or t
  misc_feature (787)..(787): n is a, c, g, or t
  misc_feature (792)..(792): n is a, c, g, or t
ctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggcctgggcctcctgcggcctcgcggaccctgcgcctgtggctgtggctgcggttcgctgcacaccgacggagacaaagcttttgttgatttcctgagtgatgaaattacggaggacangaacaatttcagaagcataaaaaccttccctaagatgtctggaggttgggagctggaactgaatgggacagaagcgaaattaggtgcggaaagttgccggggaaaaaaatcacggtcacttttcaacattaacaacagcatcccaccaacatttgatggtgaggaggaaccctcgcaagggcaagaaggttgacagaacaggagcctgaacttgacatcaactcccaatttccgtggttgaagttctacacgaatgatgatggcaagaaggccttgtgtgggactgtcattatccagaggatgaggttggccagaagacgagggtgagagtgacatcttctctatagggaagttaggtttcagtccactggcgagtctgnatggaggtctattnncactcnacaagattnntgnnnggnttattgacactagggttnctgcngcgggggggacaacttgggagagcgggggcc

SEQ ID NO: 602246 - DNA, 160 bp, Homo sapiens
ccggtcacgttgggggcagtagtgtgcgcctgtaatcccagtactcaggaggctgaggcgggaagaattttttttttttagagtctcactatgttgctcagactcagacggttttttggttttgttttgttttgttttgcccaacggtgaccggcgactt

SEQ ID NO: 602247 - DNA, 614 bp, Homo sapiens
cactttaatggtccaagtacaggcgtgacaagagatctgaaatttgtgcaagggctgttaagtttcttgatatatgtacaatcttttgagagtctagtcccagcagtatagacactaaagctcgagcttggccaaagatacttatttatacaagtgatttctaacacgctaaaagagtacatttacatcagttccgaagcacggcatgtcctggtcattcacaaggctcctgtgtgagcaagattctgctccagctacgacatatatgcttaacaggccagcaggctgctctggatttggtttcagacaccagtgaccagaagaagccagttttgcgtgtgaggtgtgtgggcccccgctgccttgggcctgctcaccggggtggattgacccccgtcgggtcacagcctgctttcacttctgtcttgtgggcctattctgcatctgggctgttgggctctcctgctctctgtccctcagtcacgtcattgtctggctgtccggtgctggctgcactctcatttgtgaggaataccccttccttcttcttttctcccaatacctccagccccatcatcctgagataatgaagcggtcattcttaggcacaaaag

SEQ ID NO: 602248 - DNA, 814 bp, Homo sapiens
gtaaaagtaccatttgcttgctgtatccctatgtcaaagatattaaggtagcagcagtcttgaactgtgaaatttgtcacagaggaatcgtgtgctgtcaactgacttaattagctgaattatctgaaaacagctcaatctataaagccataccaagaatattctgattgctagactgccacttatctcatagtgcaaagttaggaataactatactatctaatctgcagagagaggactgaaatgtacatgtcaaggaacgataatctgcttacatgaaatatccaagaaggagctcagaaaaatatggactagagaaggttcaatactgtcagtccgacaggaagccaatgcaccagtccagctgtccagagaagccagcaaaagtagcagagagcaaacaaattcacagaactcaggaacaggaaacaagtcctacctggcagcgaagcgcttaacggaacgctgaggacaacatccgggcagatgctgactggcagcgaaagggacccactaagggagcactctctgcggacagcgctcttacctccttgcccctccacattcctgtgtggcggtgcatgagagacgatgtctgcagtggaacacagcttacctcagtcatgacacgcaaggactgcttaaatatcagtcactggccatggacacacaatcacaataaatctggcatcagacgctgaggcaccaaatttgcttcgcaagaccatggatcattataaaaaccgagctcttgacctgacaacatatagaccaaggaataagcatatacacattactcgggagaatgtgtgat

SEQ ID NO: 602249 - DNA, 107 bp, Homo sapiens
tgctcggtaccttacctcccaaagtgctgggattacagccaccatgcctggctaagatgtattttggagttcatgtgatacttatgtaatacgctggaatggaattg

SEQ ID NO: 602250 - DNA, 837 bp, Homo sapiens
  misc_feature (16)..(16): n is a, c, g, or t
  misc_feature (23)..(23): n is a, c, g, or t
  misc_feature (26)..(26): n is a, c, g, or t
  misc_feature (43)..(43): n is a, c, g, or t
  misc_feature (46)..(46): n is a, c, g, or t
  misc_feature (55)..(55): n is a, c, g, or t
  misc_feature (67)..(67): n is a, c, g, or t
  misc_feature (69)..(69): n is a, c, g, or t
  misc_feature (81)..(81): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (132)..(132): n is a, c, g, or t
  misc_feature (160)..(160): n is a, c, g, or t
  misc_feature (199)..(199): n is a, c, g, or t
  misc_feature (209)..(209): n is a, c, g, or t
  misc_feature (228)..(228): n is a, c, g, or t
  misc_feature (253)..(253): n is a, c, g, or t
  misc_feature (272)..(272): n is a, c, g, or t
  misc_feature (274)..(274): n is a, c, g, or t
  misc_feature (299)..(299): n is a, c, g, or t
  misc_feature (304)..(304): n is a, c, g, or t
  misc_feature (309)..(310): n is a, c, g, or t
  misc_feature (330)..(330): n is a, c, g, or t
  misc_feature (332)..(332): n is a, c, g, or t
  misc_feature (339)..(339): n is a, c, g, or t
  misc_feature (487)..(487): n is a, c, g, or t
  misc_feature (560)..(560): n is a, c, g, or t
  misc_feature (562)..(562): n is a, c, g, or t
  misc_feature (586)..(586): n is a, c, g, or t
  misc_feature (658)..(658): n is a, c, g, or t
  misc_feature (679)..(679): n is a, c, g, or t
  misc_feature (682)..(682): n is a, c, g, or t
  misc_feature (704)..(704): n is a, c, g, or t
  misc_feature (706)..(706): n is a, c, g, or t
  misc_feature (716)..(716): n is a, c, g, or t
  misc_feature (730)..(730): n is a, c, g, or t
  misc_feature (743)..(743): n is a, c, g, or t
  misc_feature (766)..(766): n is a, c, g, or t
  misc_feature (834)..(834): n is a, c, g, or t
tccaaacccaattaanaaaaccnctnccgacgtggtatccacnaancaccacacngcagccaacccngnccagccttggcngtgaggcagtccccggggcctgnccngcngaggccacaagagtcagacgcncagacagccggggtctgacgggcccccngggctggcccaggagggctgggtgtgtggtctgtgagcnaggggcaacnggcgcccccccccaggacnctggggagcccaggccacagcagancagaggccccaggcccccncnggcccatgggaatggcacgtggcgnccccngcccnnccccagccggggccccaccncnccccccnctggaggagacggaagccagcccagggcggagcccaagcctccgggctccggtggttccgccagggggacagcctctttcagcagccgtcgctccaggtatctctggcgtcggggtgcagagtctgtgggtcagtggtttgggctccnccccgtgaataagggtattgtctcccccacggccaccgtggtgacgtccggaggggcctgcagggcctcaatnantgtggcctcaccttctgcctcctntcttttccgctggacggagacgatcaccttgactacatcaccccttggctttcttcttttcacacaaatgantaggccaactgtggagcaaanaanaaaaaaaaaaaggctccctgananaaaccaccanacccagtgggagcngctggtcccagcnccggccttcgtcaccagccagcngcacttggtctggtgctgacattcctccagggtcccattgggagaaaaggtcccggggggcagttctnaca

SEQ ID NO: 602251 - DNA, 376 bp, Homo sapiens
actccttccctctctcacgtacggatcctcgtatcagagaaagctgagttacagatctgccctggctccactctgcatgctgtctaggcgagaagaaggagagtctgaagatctggcctgccgcctgcagttattcccggcgcgcgtgtgggagagttggagcgggctctctctgctgctctccacgcagcaccaagaaggccagcacaggttcaacaaggagttaaccaaagagagagacgccctcaggctggagcttatactatgaacaccctaagcactgaggacctgaagccagagaaatccgaattggaagagacgcttcgggtcctagtgactgagaaggctggccatgcagctcaacttggaagaattg

SEQ ID NO: 602252 - DNA, 172 bp, Homo sapiens
ggtaatatgattcaaagctgctaatgttctcattgccataaagactccgtgtcaattgtgtcgacctatgggattaatctacctactgatcccgagatcgtcgtctagctttctttgttgggtttctattctagaagattgagaagtgcatataacaggctgagagcagctc

SEQ ID NO: 602253 - DNA, 977 bp, Homo sapiens
  misc_feature (977)..(977): n is a, c, g, or t
ggcacaagctgttggatgagatagagtcgctgacgctgcggttcagtgaagagcaggagaacaagaggagaatgggggacaggctgagtcacgagaggcaccagttccagagggacaaggaggacacccaggagctgatcgaggacctccgaaagcagctggagcacctgcagctcctcaagctggaggttcggtagcagcggcggggccgcagcagcagcatgggcctgcaggagtaccactagcctgcagcgcgggagagctgaggctgtggagcatgtggatggtccgcagaggctgacatgcagggataagcgcaagctgaaggagcagaacagagggagactgaacgggcgagatcgattaaccctcagcatccagggccgccaagtagcctcttctccagagccttctctgagtccctggctgcagagatcagctcctgtctccgagatgagctcatggaggcgattcaggaagccaggaggagatcaactttccgcctgcaggactacaatcgacaggatcatcgtggccatcatggagaccaaccgtccatcctggaggtcaaagtagaggcaggaaggtccagcctgagctggattcggggactcaagcaccctggagtggttccgggcacgaccatgaggagccaggatccagcaggtcccacagtcgacagtgcccagagcatgagggaacctcggtgagcatgagcgggccgcaaagacgggctgccaagggccgaggtgcgagaggcaaggcaaagcaagaccagtcggcgtgcaagggatgaggcaaggacgaagcaccgaaccagcccggacagcgcacagcacagacagcgagacaggaatccacacacgcgggacgcacacgatacacggcgcgagcacccagacaggaaagaaaccggtgacaagcacgacaaggcacaagaaaaatggagaacacgacaccaccgatggggagtcccn

SEQ ID NO: 602254 - DNA, 415 bp, Homo sapiens
gtactctaagatccaatgaggtcggtgagcaataccttgtatggcggtagtcactgcttctctgtagcacgcatcacttgggtaaagaagttgatgtgggactgacgaaacatagcagatcttctaaggcatctgggaaggccgtcttccccgatggaaacgccgcagtgggagccgcagaggttgatgttagctctcggagatggcggccatgcgaatctggtccaaggcccgcgtgaagaaggctgcaaaagtgctgcagaagggcaccgtcctgttgcgggtggcacagcccaccgcgatgctcaccatgttctgctcagcaatgtagcactcgatgaagcggtccgggtgctcctttttgaagatctccgagaaggtggaatttttggtgtccccacccggacctcaattt

SEQ ID NO: 602255 - DNA, 240 bp, Homo sapiens
gatattgggaccgggcgacacacgaactacaatgcgccaggcacaggatgaacgaggtgagcctgaggaacctgcgcggtactagaaccagagcgaggacgggtctcacaccctccagaggatgtatggctgcgacctggggcacgacgggcgcctcctccgcgggtatgcacagtccgactaagaacggcgaggattacatcggcctgaacgaggacctgcgctcctggaccgccgcgg

SEQ ID NO: 602256 - DNA, 154 bp, Homo sapiens
ttactataaaacttagtactacatatacataaccctaatacgaacttaaaattcatcatacatttacttcattttttagctatgaccttctagtacatctttagcttcatagatattggctgctatatacggagatcctcctttgtcaggatga

SEQ ID NO: 602257 - DNA, 100 bp, Homo sapiens
tttttgggtttttttttcccccccaaaggggccccttttttttttggggggggccccccccccccaattaaagtttttttttgcccccttgggggggcca

SEQ ID NO: 602258 - DNA, 735 bp, Homo sapiens
ggttcctttccaagtgtcaaataggacacccatcttaccggccaatgtccaaaattacggtttgaacataattggagaacctttccttcaagcagcaaacaagcaactgcagggcgacaacagcaaacaccaacaatagtttcaagcaacattttttttttaacatcaaaaacacaacagggacacacagcgggaagcactggcacaaatctacaccctacaaggccagaacaggcaaagcaaactggaacgccacagcgcagatatataatgaaccccgacgctcagcgcgccgctacttactactctacttaattcccccttaacggttgaaactctgtgaactgaacatacacacacgggttgactgactatttcacctgactggtagaatcgaaagccccatgcaccgtacgccttctgttacatgaccgtccgctgggaaatagcatgtatctggtctctactgaccaatatattttaactgacctttctagatgccttaactattggcatgatcacgctagttctcataggctttagtattctctgctgtttaccgcatggacatcactattcctggttatactcaccaacgaaaggctagcgaggcggcgtcagaggtgctgggtgaacagagccatgagcccgcaattttatcacgcactctgactttctcaacagttcaccacaccctctctgaactcctctgttagccttactttaatccagtac

SEQ ID NO: 602259 - DNA, 277 bp, Homo sapiens
aaacgagctgggaaatcttaccccgcctgtttaccaaacctaccgagcctggtgatagctggttgtccaagatagaatcggtaggcaactttaaatttgcccgcagaaccctctaaatccccctgtaaatttaactgttagtccaaagaggaacagctctttggacactagaaaaaaaaccttgtagagagagtaaaaaatttaacacccatagtaggcctaaaagcagccaccaattaagaaagcgttcaagctcaacacccactacctaaaaaat

SEQ ID NO: 602260 - DNA, 347 bp, Homo sapiens
  misc_feature (302)..(302): n is a, c, g, or t
  misc_feature (316)..(316): n is a, c, g, or t
tgagaccaagtcttgctctgttgccaggctgaagtgcagtggtgcgatctcggctcactgcaacctctgcctcctcggttcaagtgattcttctgcctcggcctcccgagtagctgggactacaggcgcgtgccaccacgcccagctaatttttgtgtttttagcagagatagggtttcactatgttggccaggatggtctccatctcttaaccttgtgatccatcgcttcccaaagtggctgggattataggcatgagctaccgtgctgggccttatttttctttacctccagcctcctantggtccttccttantctggtctgtggggtatgcatactggtcccg

SEQ ID NO: 602261 - DNA, 210 bp, Homo sapiens
tccaggaatatattctttattgagaattgcatacctgtgtcagatgaaacatctcaggtaccccccaaatatatacacctattatgtagccacaacaaattttttaaataggctgggcgcagtggctcacgcctgtaatctcaacactctgggaggctaaggcgggtggatcacctgcggtcaggagtttaagaccaaccggcatttcga

SEQ ID NO: 602262 - DNA, 817 bp, Homo sapiens
tctgggttgagcccaggtacttaattggatgggtacttgacaaggggcggctccctaggcccctcccctcttaaaggggtctacttggaaacggtaaggaggggaaattcagtggggggggggaggactgattgtggcaggaactccccagcagggagggtctctctctctccttctggttgcctcttggcgggggctgggtgtggctccagggggctctatacctccttggagaggccagtgtgtgggccattgaggctccaccaacccgtgttttgctgttagccaaaatttcgctgtgctcatttaccaggaaagtagagtttgagcaaatgtggctcgtgtggagggcaatgtgccaagccccagcgctcaaaggtggagagagtgtgggtgttcgcgtgtttgaagtctcagaaggaaaaccacctggggtgctcagtgtgtagcccaggattgcccttgaaggggggccctccgagcgccgtggtttcaccacctttctgggagtgtcatcatattgggccaggttttccataaagcggcaggctcaggtccacacaggtgacacgtgggcatgggggcgaccacggaaggcacagtgccagtagagctacccggtcaggctcggggaatgacctgtgcccacaagcctgtgggcaaggcgccagataaaaggcaggggatagatgtcctgggaagagccccgggggccaatcaacggccaaacagttcccccggggggggggcgaatccacaaggctctgggggggcaagagattggcatggacctggggggccatgagtccttccagga

SEQ ID NO: 602263 - DNA, 414 bp, Homo sapiens
  misc_feature (213)..(213): n is a, c, g, or t
  misc_feature (393)..(393): n is a, c, g, or t
  misc_feature (398)..(398): n is a, c, g, or t
taaggtgctggaccaatgttaagtcacatgaccatttaaagcaaatagtgaaatgagtgattcaccaactttgagaccttggaataacatcagaaggaatcatttaccaggtgatcaacttctaatcagtaaagtctttagggaaaattgataagtattttgaacagcttacattgtaaagtctcaaaaggaaaattgctagtttccttggangacatatagtgctcttttttcaggaaatttttccaaatatcaggacatttggtctaattaaaactaacactccgcgtattctcataaaaaattatccaacggcctcatgttcatttatttctttattatttgtgggtaataatgtctccttattcctagaaatgatgttggatgtgttcngggcncagcctaggttaattg

SEQ ID NO: 602264 - DNA, 116 bp, Homo sapiens
atctatgatatacagtcactttacaacatatagtaacttgcaacagaaactaaacaccactagtcattatagtaacctatagaagacaaaactaactaaacacaagtatatatagg

SEQ ID NO: 602265 - DNA, 212 bp, Homo sapiens
cccccccccccttttttttccccccttaaaaacccccgggccggttcccccccccggtttttttcttgggcggggggggggtttccttttttccccggggacccccttttccccttggccctttttgggggcccctttaaacccgttttttccaaaaaaccggggggggccgggcccggatttcccggggttttttgcccccccgggcccca

SEQ ID NO: 602266 - DNA, 960 bp, Homo sapiens
gacgtcaccctgagactgggcggcgagctgggatgtgcaacagcctccgtgggcctcgtgacttgtcttggctccgtgagcgcccccgcccggtgtgggagctcagtgcggcggctggccgctgaggaggaggagcgagaggtggtgcagggtccgagtcaagcatggtgatggggccccatggtggcctaccccatgtcttctctccccagaaatgtgagagcttacttgcctgcagagtatccgctactattagctagtagatcccacagatcacctacgatcgacgtgttgcagcacatcctcataccgagcacttatgatataagagtgggaagaagaacttaggcatacagctaacctgggccgggaccaggctaggacaggaagtttaactactcaatatctatcttgactgggacctacagagacagccttatgcacactagcctaccaaaagccttaacactagacaaattgcagtagtacgataattacgggccctacggcaggacacggccacatatgataaagaagacatagggaccaataagtcagggcgccaaaagactgtcatatgaacaatccgaaggtgttagcatggctagagaaagacggtcagtcaacctgaacgaacttgacgacacagcaccattaaacacaggaccaatacatacaatcatgatgggccccggtaacccattgtgcctacacgggatccaaacgacagttgccatgaaggccttgggatcggaacatggggcggcaaagcaatggctcaccaagagcgcgataccagggacccgacccccccttgaacggcgcaatgacatcgaaggaagatcagcgatacgggtacacacccagaaagcgccacggcatggaggccacaaggccagtccgcggaagcccccgagagacgaacggaatggcagcccatggcgaggactacctaaagtg

SEQ ID NO: 602267 - DNA, 215 bp, Homo sapiens
gggaaaggtacaggcgtgggaggcagtgaagacgctgcaaattcctaaggtggaaaaaatccaagcaatttattattttactttgggttgatgattcagaattcattgctaagcaataactgttacttttcttcaggcacatgatggtacagcactagattagatgattcctactctcttgaaacccagcacctggaaacaacctcaaatcatac

SEQ ID NO: 602268 - DNA, 185 bp, Homo sapiens
ccccccccccccctttgttgtggatttttttaaagggcggttttaaaacggggccttttccccgctttttttgttttggtttgagggcatccttttttaaaaaaactttttttttcctgggggggccataattttttaaatggggggggggggttggtttttataaaggttgcccccccccggta

SEQ ID NO: 602269 - DNA, 740 bp, Homo sapiens
gtgcagtggcacaatctcgggtcactgcaaactccgcctcccaggatcaagcaattctcctgcctcagcctcccaaatagctgggattacaggcatgtgccaccacgcccagctaattttgtattttttttttttttagtagagatggggtttcaccatgtttggccaggctggtttctaactccgtgacctcagataatccacccgcattgggcctcccaaagtgctgggattacaggtgtgagccaccacacccagccctcacctccttttggaattgtgggactgtatctttacttaaaagttgggatagattaaaccgggcatttccacacacgtgttcaaatacaactcatttaaactacaagtgtactttaccaaatatacaaacaagcaaacaaaaccagcttatcatttaaagtcgtgtgtcagccaccactcatctgtaagtccagattagaagccttggagtcatcgtgtggtccttctctctacttggtctctcaccgtgcaattccttccttaagcaccaaatgccaggtattaagctaaacactgaggatacaaagcttagccagtggtggtagtagggtgcttgtactcccagcttacttgggaggccaaggcaggaggatggcttgagcccaaaaggtcaagtctagcagtgacccatgatcagtgccactgcactccagcctggacaccacagtgaaaccctgtctctaaaaagtaaaatatac

SEQ ID NO: 602270 - DNA, 199 bp, Homo sapiens
atcctcctgctgctcgcaggatgttaggtcaaaacgtgagcaggaggtgaacatcctgaatgaatgaccctggtatggagtgagtgccaatgacccactgaggcccagatccaggagatgatggcagaatgcactcacagtgccgtggagtgagctggctggagcatgctgtgagcagactgaagctggtgtgaaatgc

SEQ ID NO: 602271 - DNA, 326 bp, Homo sapiens
ataatagaaatggagaaatgcccacagtagcagagaaaaatcagcattcaaggttcagttagggaatgatctcaaattcaagtgtatgtgtctggaatcaaacagaataaggtcagcagcaataggccttagggttagtgcagaatttattttcccaccatgtgaaaacaaatgtgactgtttctcgtcaccttgagaagaggtttagcgaccacttatacaacagcttcttagtatgggttcagaattgaacatgtatttagactgctcctgctgtctgcgcactgtgtggggctcagaacatggtgtttagggaaggccagctt

SEQ ID NO: 602272 - DNA, 253 bp, Homo sapiens
tttgttttttttggccagaacacacacgggtatgggttcattcttggtctctggggacggtgacggggtctctcacaaaagaagaactccctctggcgggggatgtgactagggactcattgggccggcaacacccacaaaagaatctaggctttagaatgaactactggaccctgagtcaaagacctgttagggatatttggcccattttctggcctctagttgctggaataggggaaagacggggaaatat

SEQ ID NO: 602273 - DNA, 299 bp, Homo sapiens
tattcagggtgtgtggggaaggcatccctggagaggtgatgactgagaagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcac

SEQ ID NO: 602274 - DNA, 146 bp, Homo sapiens
aggacgtcgcttagcgaagtccagctggagagacgctcaatatgctgaacaaataacaggagagagggcccacgtggcagccgtaggactgaggcaccatgtcgcacggacggtttgcacacttgcacggcggagaagacagcatg

SEQ ID NO: 602275 - DNA, 105 bp, Homo sapiens
tacacttccgggcgctacatgaggtgggacttcaccaaggtcgggggccccgggacaggcacagcgtcacgggggtctcaagatgttgtcccggctggtctcaaa

SEQ ID NO: 602276 - DNA, 218 bp, Homo sapiens
gactagaggatccccatcatggggtcctggaggcaggagttcgaaatcgagcctggccgaacatggtgaaatcccatctctactaaacaatacatgaacattagcctggtcatggcggttcctgtgagcccaggagtttgaagctgtagtatgctatgatcatgccacagtgcacttcaacctaggtgacagagcaagaccttgtctcaaaaaagaaa

SEQ ID NO: 602277 - DNA, 494 bp, Homo sapiens
gcctacagagtgattaaatggtgtccccatgtcacattgatcagcagcattcgtgatcatcactaatatcaatatatgacggggaggctgttgggtttataagatggactccttgaaggcccaggggaggagacgctcagggggttctgaaatatagatgataggaagttagtctcctggttgaatggaatcaggaggaacttatctgactctgcacaggagaatgaagcctgcacagatagctcctccatcttttcctcctccgcaggacctctctcaagccagttgtctctcacattcagcctggcacgtgggaccatctcccacagttggtccgccttttttctctgtcttcccggctgccacctctcctctcctaacttttccccccgaatgtgtttcttccttcttctttgtacagttggcagtttttcagagcacttggatcagataaatgggcgaagcgagtgtgtggacagtacagataattcctc

SEQ ID NO: 602278 - DNA, 423 bp, Homo sapiens
taaaacgacgttcagggaaaacgaaatttttttcctcgcttattaggggaggggggacctcccaaaagctttcccccctaatttttccaagatggggcggctaagggggggaaaaaaaaaagggtctttgtttttcttcctaagggggggcgggggctataaaaaaaccgggttaaatggtcccctcccgttcaaccccctttttttaaaggccccttttttttttaaaaccacacccgggggggggaaaaaccaaggggcccggggttttaatttgcaaattttccccttttggttaaaacgcaaagggtagccttttttttttcccattttttttgggccaaccggaaatggcgggggttttttcccccttttggcaaaagggggtttgccccactcccccgggggaccttttttttgttg

SEQ ID NO: 602279 - DNA, 1370 bp, Homo sapiens
gaacttgataacgccacatactactgataataaactccgggatgccagagaagcgtctgatgtttggctggcaatggtgatgatgaggcgtacctctgtgctaaaaagcccaagataggggataggaccccatttgcgaaggccgcaacccttgtccttgatcaagtagagaattcgtgcaaggtatacccaggatcctagccatgctattcccagacataggcccaggtcacgaatgacggcaacgtcactcaaacacgattagagtcctagagggtccgatgagagaacacagaaggaagacaaggtttcatctgcgaagactgtgtgcacaagatacacctacgcttggcgtagcgttggcacgaacggagacacgcggtgggtaacgccctggtgcttgagtgaaagacacgtatctgcccacaagatagcgcgtcagatagtcatctcatacgcttcacattcgagacgatcggtgcgctcggtcacaaagccgttgtgtgtgtagactcgcaccgaggtcccaaacaaatacacccacttgctagttcccaagaactcactggtagttaggcaaagaacaccttgagagaagtcgcggagccggcatttagacccaccgctgagcggtgaacccgaatgtcgttgccaatcagatccaccttctcacattggggaacggaccccaagactaggtggagtggacccaaaagggaagcggtgggtggcgggatattctttgcccccatgggaatgagcccccagaacattgagtggctgacgactggggcgcctcttaaatcatagaccttattagatcggcctaagcgtggaggtacactcgccttccttgttgtcctatcccctttcaaacacatgcgaaatagtgtattctcctccttgcgttataacgcgacacacgtgaataagcaagccatacaccacacggaatgaagagaatttgagttggggtctctaaatttgggcacctaatcggtgttccaacatcgccaaaattccacgtcccagaattacttcccaacggaccatatgctggtttagaacacagaggaagttcctcccggagagagaagaaggcaaattctctttttgatccagtggcatgttggaccgtttatacgccgttttccagcatggacaacaacgggcaacaatggaacatgggcgtgttgtgcagggtggacataagggctccgccaagttataacagaggccaccaaaaggggcgcaaccaacgtgggggggttggaaacgggaaacgttcgaattatccgggaaagcccacccgcacagggaaagcagagcacgcacgcctatgcgaaccacaacgacggtacatgttgcag

SEQ ID NO: 602280 - DNA, 241 bp, Homo sapiens
cgaggatcttcacatcacgcaccacgatataattacaaaagtgtagtgcataccgtgggataaaacagtcaatgttgatgccttgaggacttggatcttttatttatttacagtagggaggaggaggaaagttgttaagagagaaaaggttacattacaaaatcctgtcagacctgcgagttcacagactacgccgggtagaacatggtgacaaccccgtactctacataaaaatacaaca

SEQ ID NO: 602281 - DNA, 294 bp, Homo sapiens
cacgatctttgcaaacagcgtaactggcaaagaactgacatctagaatttgcaaagaactttcaaaactcaactgtaaaaaaccaaataatacaagtagaaaacaggcaaatgacaggaaaagatagttcaccaaagaggatatagagatggcaaattagcatgtgaaaagatgttaaacatcactagccattagggaaatagaaattaaaaccacaatgagctattactatgtccctgtcagaatggttaaaataaaataaacagtgacaacaccaaatgttggcaaagaatc

SEQ ID NO: 602282 - DNA, 824 bp, Homo sapiens
  misc_feature (806)..(806): n is a, c, g, or t
cgcagtacaggggccagatcctcagccctcagtggcccatgctccatcctcttgtataaatggtggaatttcagaagggacccccgtggaacaagggtctgtagaccctcaatatggtcactagtttctaggatggatctgtgtagtgtaatgtggatgtaatcgattacaccagggtaagcgatatttgcttgtgattacggcgttctaattgtgttgctacgccttgtttacggactgctgtctgtgcatacagggttccttggttcctctgttaaagtggcttgctgtgtatctctgtgtctgccacgagttgtgtcgactccgtagtagaatcacaacgcgaggcactctttggttattgatgctcttacgtgctcttttctggtgagtaaaagacaacttctctgcctaagtcattagtaatcaatcgtatactctgcaggacaacttgacgtactcgattgctggatacacgatatatgtcaacgaaggtaatcacacttaagtaatgcttggcctcttggtgcacaagcaccaatggataaagagcgtattactgcacgagtgctctctaagctactcccagttctgctaaggatacacaatactaaagttgtttataaaattatgacaaagagaataattcgcctatatcctctatctatgttaaccgtattcttattgtttcgtatagattcgtactatatataagtcacttattcatggttccaagccaatgagtgtaatgtattttctcccaatagtaattgttaatattcataattattcagctctgctgctantacatcgtggacttcgtt

SEQ ID NO: 602283 - DNA, 380 bp, Homo sapiens
tttggtgatcatctcctctattcagtcctacacttctctccccatgccaatgtataggccatgcagacaaggacatatactaaatagcaccacctatccatccagcttccatcacactgctagagataacacttcagaaaatccaagtacaatcctattaaaatcttattataatcaatcgtctatataataatttttattattgcccattactaggatagagaattccaagtttgtcaagtaatgaactgcatgatattcctggtctctttattcaaagtcatctcctacttatacccctaatgtgtgcgcgcgcacacacacacacacacacacacacgtacacaccatcttgccttccagtcaccctcagccacctt

SEQ ID NO: 602284 - DNA, 207 bp, Homo sapiens
ctttggtatgccaggcgggtggactgctgagctcaggagtcaagaccacccttggcacatggtgcaatcctgtctctactaagatacaaaaaattagccaggtagtcccagctcctcaggaagctgaggcacaagaattgcttgaacctgggaggcaagaggatgcagtgagcccaggatagtgctacagcaaccccagactggggc

SEQ ID NO: 602285 - DNA, 747 bp, Homo sapiens
  misc_feature (512)..(512): n is a, c, g, or t
aaagattgtttcccacccccacttttgacgatgaccataggtttgcgcccacccctccccctcttctctttccgtgtctatctctctaacagtcgacatctaagggattacgcgccccgcactctctcaagggttgccacaactcataaatcaagtggtcatatgacaagtgcgcgcgccactcactttccttgtgatacgactcgacatattacagacaacacgtcgcacacccctctgtgttgttctataataaaccacccgcgcacacgtggtagtatatgtctgtggcggcccacctccatcaccacttcttttccctctatatttacttctctcatatacacgtatgacacacccttgttcccccacacagcgctctttataaaaaatttcttctgttccaccctctttattatatataactcagagagagtgctgtctcctcaacccacagttggagagacccttttatgcaaccgctcgtacgatactcctctccatcggagatntttctaagaaagtgccaccccaagatgatggtgtacgagaagtttcacccatcgccgcgctgtgtttcgaaaatggcgagcgagccgctcccagatcaggacgtcctttccctagagtgatcactgcgccgagcgctccgttcgagtcaaattctcccacatcgtcttctacgcgccacctcaaggagttccaaccgtaaatgcgcccaccacgccccaacaattagcacgacaa

SEQ ID NO: 602286 - DNA, 312 bp, Homo sapiens
ttcggcactgaggtagtgtttgagtccgtcgtgcttcaccggtctacctcgctagcatgtcgggccgcggcaagatctggcggcaatggccgcgcctaaggccaagtcgcgctcgtcgcgccggcctccagtcccagtggccgtgtacacggctgctgcggaatggccactacgccgagcgcgttggcggctgccatgtgtacctggcggcagtgctggagtacctcacgctgagattctgtatctggctggcatatgcggcctgtacaataataatacgctattcattccccgccatctgcagctggccat

SEQ ID NO: 602287 - DNA, 123 bp, Homo sapiens
ctttccttacttgcccaggactcaagctgctggccctgtgtcccacggctaggcagcaggccaggtgacccctccaacccctcctcagactgctcatgccatccccgttccatgggtccccgc

SEQ ID NO: 602288 - DNA, 558 bp, Homo sapiens
  misc_feature (12)..(12): n is a, c, g, or t
  misc_feature (24)..(24): n is a, c, g, or t
  misc_feature (51)..(51): n is a, c, g, or t
  misc_feature (58)..(58): n is a, c, g, or t
  misc_feature (154)..(154): n is a, c, g, or t
  misc_feature (194)..(194): n is a, c, g, or t
acgatttttccnatggaatggaanggggatgattttcagggttgaaacctntcccacnttaacattcggagcattagttggaattttcccttagggagcatgcaacctaagatcccttcgcatgtgcaaattcacaaatggagtttcgcgctcntatgggcatctaatgccgcccactgatcggaccaggagcnagagctcaggcttgtaaatgcttcgctcgccccactgaagcccggttcctgacaaggccacaaaacccagttctggtccgaggcccagggactggggactcccgctctagaggaggatctctccttgccacttctaccttctggtagtcccaggtgtgtctggacccaacctctgcctccttcatcacgtgccattctcccttctgtgtctctgtcttcacatagcctttcttgttatgaagacaccaggtgaaggtacagtgctcatgcctgtaatcctagtgctttgggaggctgaagcaggaggattgcttgaggctagagttcaaggccagcctgggcaacacagggagaccccatctct

SEQ ID NO: 602289 - DNA, 344 bp, Homo sapiens
ctttactactctgcttatttctctcgtatacttcagactgctgagtctgtaactgcattatcttatttacatgctttctctctacaatgatgcaatggtttgaatgtctcctcccgaactcatgtttaaatttaattgccattgtaacagtgttaagaggcagaacctttaaaaagtgattaggtcatgagggcatagccatcctcaaatggatgaatgtctttattgcaaaagttggttagctggagtgggctcctgataaaaagataagttcagcccccattttctctctgtctcatacactctcttgccttttcactttctgccatgggataatgtaacaa

SEQ ID NO: 602290 - DNA, 255 bp, Homo sapiens
taatgagtacagggagaggttatgctgcagagtgacacgtgattgagagctgacaagacagccctcagtgcgaccgcgtgaacagcatcaaacatcaaccaggtcagcatcacgtttgcaggtggccccggcagagatggcaccattgacttcacacccggctcggagctgctcatcaccaaggccaagaacgggcacctggctgtggtcgccccacggctgaattctcggtgataaaggcgcccactggaccct

SEQ ID NO: 602291 - DNA, 213 bp, Homo sapiens
tgtggctactgctgaggagtgacaggcaaggcaggatggaattggtagcaaggcagagaggactctgggtgactttgcagcagagtatgccaagtccaccagaagtacgtgcaatgcggtgtatggagaagatagaaacggggcaggtgcgcctgttcaagaagatggtgggaccggggaaagcacagctaggcatgattgaccgggtggtac

SEQ ID NO: 602292 - DNA, 296 bp, Homo sapiens
gccgagctgcgggtgtccatggagacgatctaccagtggttcaaacaagcgcatcaagatcacaaggcgtcgcctacaaccctgatgggcgaactgtgcgcaccgacggacaagcatcctgcacatagtcatcaagcgtggctggaaggaaggcaccaagatcaccttccccaatgaaggcgacgccaaagctgacaacatccctgctgacatcgacatatgtgctcaaagacaagccccatgcaacagttaccgccgagaatggccaccaatgtgatctacagatgcctgatcag

SEQ ID NO: 602293 - DNA, 245 bp, Homo sapiens
cccccaaaatttgggggccttgggggccggggggttttttccttttaaacccatttggggccgggcccccttttttttttttaatttttgggggcctcccggggggggcggggcccccccccccaaaagggggggggggggaaaaacccccccccccccccttttttttttcccccctttgggggcccccccggggggggttttttggggccccctttttggttttttcccccccgggggggcca

SEQ ID NO: 602294 - DNA, 392 bp, Homo sapiens
agtatagtgagaaacctgtgcacatttactatctctatcaacgggagagtggtcagcagtatttttccgtctatttgatccaaaggaatcgtggggacaagttgtccagttgacttccttggtgcctacaaactacagcatgacttgtcctggactccgtatgaggacattgataagcacgatgctaaaatcagctagtgatggacacgtggctaagccagtcagtggccctgtcgtccgtgcactgaacccagattccagggactgactcactgagagtgggctttgacaaacagctctcacaggagctggctgtcaacctccttgttgcccccactgttgccttgagacttgaagacatgtaggtgactcacaaacttcttggaaagaga

SEQ ID NO: 602295 - DNA, 292 bp, Homo sapiens
  misc_feature (42)..(42): n is a, c, g, or t
ttcatgttattcagaattgttttggtgatacctccaaccccngaatcccagcactttgggtgggtgaggcaggcggatcacttgaagccaggacttcaaagccagcttggccaacatggtgaaaccttcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaa

SEQ ID NO: 602296 - DNA, 343 bp, Homo sapiens
  misc_feature (142)..(142): n is a, c, g, or t
gcacacagctaactgccaaaaatacatggacgcgtagtagctgttcaactccatagtacttgagaaatacagcgttatggttacatgtccagctcacaacaaaacccacacacaggtaaattgtttattaataagtcagtgngttcgataatttaacggtgactggaaaatgtgcacacaggtgactcatacatgacggtgtgtgttaacaatgactagctattattcaacaagtgtctattaggttaacttggggaccctttgggaggttacaagacagtcattataacacgtcctggtttcgtgtttaacatgttactcatagaattttttttaagtgaaa

SEQ ID NO: 602297 - DNA, 455 bp, Homo sapiens
  misc_feature (102)..(102): n is a, c, g, or t
  misc_feature (268)..(268): n is a, c, g, or t
  misc_feature (308)..(308): n is a, c, g, or t
  misc_feature (388)..(388): n is a, c, g, or t
  misc_feature (441)..(441): n is a, c, g, or t
agccgttgggcctgcctcggaggaggcgtcgccgccgccgctgccgctgccggcgccgttgccgctgccgggaaacacaaggaaagggaacagcgcaggggngatgggcgggggtagagccccgcggagaggctgggcggctggcggtgagcagactgtgcctgtccacggtgcctcctgcgatgtctgctgccctgagctgtgccgaggtaggtgacagcgtaccacggtgggagcatgaatgaggtgtgtgtgatcaagaggtggntcagagggtgtgaataatcaagactggagccaggtattgntgctgagagcgacgctcttcattgggtacaggagaggccgaggcgctgatcagatctaccccttaaacactgctccgtanagatgcagctgatgaagacgagaggcgcgagccaacactttgtgatacgctgnctgccagcggacac

SEQ ID NO: 602298 - DNA, 385 bp, Homo sapiens
ccattccattccattccattccattccattccattccattctattccattccattcccttccattccattctagtagggttaattccattccattccattccattccattccattgcattccattccattcaatttcattgaactctggttgattccattccattccatgccattccattccattccattccattccattccattccattcctttccgttctattcaattacattcggattgattctattcaattcccttacactccaatacattctattccattcgtgttgtttccattctattccattccattccactccattccattgcactctggttgattccattccattcccttccattccgtatgactccattccatt

SEQ ID NO: 602299 - DNA, 169 bp, Homo sapiens
acgcacttggtcacacgcacttggtacatacacacgtagtttaggaggtgatataggtagccttttccataaaatttgaaggatcatttattcagtaagtgttgggatgatttatttcaaataaatgaaagattttaacacaaaattgatttgcccccaagttgcgtgt

SEQ ID NO: 602300 - DNA, 250 bp, Homo sapiens
aactactatcacccaggttggagtacagtggcatgatcatgtctcacatgcagtctcgacctcatgggctcaagcaatcctcccacctcagcctcctgaccagctgacaccacaggcatgcaccaccacacccagctaatttattgtagagatggggttttccatgttacccagagctggtcttgacactcctgtagcccagaggaatccacctagcctcagcctacccaacaatgctagggacctacag

SEQ ID NO: 602301 - DNA, 102 bp, Homo sapiens
taaaatgggacatcatgagtacacatagttaatagattcccatattgtgcctctagttgcagaactttatagaccctttagtcggataatatgcaatgtgaa

SEQ ID NO: 602302 - DNA, 616 bp, Homo sapiens
gggctagggacctcaacaatgtgggtacagaagtcccctcagtgcctgccagggcctggagtggaggttcaggaccaaggggcttctggtcgctccacgcccctgtactcggaccatgcctctgcggtcactgtcggttgccgcccctaattgtgtctcaaaggctgaccctggtcccgggctgcgtacacgcattgccatgctttgccttaaagtcctcggggtctgcccggcccttcgccccgtgcctggcactgctcaccgcccaaggcgacgccggactggagccacggcaggtgcctggcctttctcctgcccggcatcggaaccagcttttctctcttacgatgaaggctgatgccgagagcgggctgtgggcggagctgcggtcagtcccagtatctaattttgctttgagaagaggctcctctggaccgctgctctcctgcagggaggtggctgtcccgcgggaagccatcagcttgggccagctggcaggtggcaggaatggagaagctgagcctgctggccaggaaggggccagaccccccccaacccccagctgccatcgctctccacccagcttggccccgcatatcgcctcctgagccgaggc

SEQ ID NO: 602303 - DNA, 198 bp, Homo sapiens
ctagaggatcctcatcacattacatacagtacttgatattctatttaatgatggtggtgtgtaatttcttactggtgcctaatttataaattaaaattcatcgtaggtatgtatgtacagggtggaacatctctaatccaaaaatccaaaattggaaccgttccaaaatccaaaattaatcgaagccgctgtgcccgg

SEQ ID NO: 602304 - DNA, 291 bp, Homo sapiens
  misc_feature (23)..(23): n is a, c, g, or t
  misc_feature (75)..(75): n is a, c, g, or t
  misc_feature (247)..(247): n is a, c, g, or t
  misc_feature (279)..(279): n is a, c, g, or t
tgaacaaatgataacctgcaatncccttttcaaaatagtacaaggagatataaatagaaacccataaaaaccttnaaaaacaggaggaatgaagttaaagtgtacagtttttattagttctcttcgccctgtttgtttttgcaatcagtgtcaagttgtcactttaaaataacatgttatgttatttgcaagcctcatggtaacctcaaatcataaaatctacaacacatacacacacaacaaaatnaaaaacaagaaactaaaacatactgccagagnaaataaacttca

SEQ ID NO: 602305 - DNA, 338 bp, Homo sapiens
gtttagtatcttctgcttacctgctcctgcatcctcacatattaggacttgtgggactttaggattgttggatggccatggagtctctcatcacagggacgccaggaggacaaacacccagatgacaagcaaccagagccacatgggaactattccctttgagggggacgagtgtgaattacaagctcaggagtagcctggactctctccttgtgacctgaggctactcctggatcccagggctgttctctaccactggactactgactatgtgttaccctgaagttgagtcccatgtggtatcggtgctttaggtcttgggtacaagctctaagtga

SEQ ID NO: 602306 - DNA, 195 bp, Homo sapiens
aaaccttttcccccccccggggggggggcgcaaaaagggggggggggggtttttttttcccccccccttgggggggggggggggccggggggggggcccccccccccccccccccccccccccccccccccccccgttttttgggtttttttttttggtttttcccggtttttttttggggggggggggggggga

SEQ ID NO: 602307 - DNA, 95 bp, Homo sapiens
aaatttaggtttatggggtagatttagcccccagttgccagtttttagcgctcccaaatgaatgaataaacatgagcttgcgctcctagcctaga

SEQ ID NO: 602308 - DNA, 797 bp, Homo sapiens
acgctcctcgtccatccaccggtaccccacaacggttgagagagtgtctccccctcatcatttccctgactaacagacttaagtatgccctgacaggagtatgaactaatagcaagatttagcatgctgctgtgttcattaaaatctgatggcaaggtccgaactgatataaccttaccctgctggtattcagtagtgagtgatcagtcacgcattgactagagactgggagcagagattctccgctctagatctatgacaccaagggctcgcattgtgctgtacatcgtgattacagcctgtaggaggccagagtacaagttgtgcaaagtgagaaggatctttgttgggcactataaggaatccctctatctgtgtgacatcatgatgacccgctatcgctagtccgctaccccgagtcccctcatcagagggtgaactgagtaccattcagatctgagtttagagactggcaagattactggatcttcatcaagttcgacactggttaacctgtgtattcgtgactggcggtgctaaacctaggaagaattggtgtgatcaccacacatgagagagggcaccctggagtcttgtgacgtggttcacgctgaaaggatgccaatggccaacaagcttggccactcgacttttccaacattggtgtatcggcaatgggcaaaaaccatggatttctcttccccgaggcaagggttccgcctcaccattgctgagacgagagcaaaagatggggccaaagaagcagggtcaatggcctggggactgtcacttgcaga

SEQ ID NO: 602309 - DNA, 104 bp, Homo sapiens
gggagacgataatgggttgctgctgttgggcgatcaagcggacagcaagacacccactctgcagtggctctcatcctggtacggtgcgttggcccgaacacggt

SEQ ID NO: 602310 - DNA, 125 bp, Homo sapiens
  misc_feature (121)..(121): n is a, c, g, or t
cccttatcacaacacaagaacacctcgtgattactcgctgccatctatgacccttgtgccattaatatgatttatctaccacacgtagcagtagaccaacctgaacccccttacgaccttngccg

SEQ ID NO: 602311 - DNA, 1138 bp, Homo sapiens
cagagtgaggcctcatctcaaaaaataaaaaaaaagggccccaagaactcagctaattaaaaatcaaagagtccatttagaaattgggcaaaagacgttgagttagatgttccactgaaggaggatctatagatggcacagtaagcatatgaaaagctgttaaactccataagtcatcagggaaatgcaatttggaaaccacagcgaggctatgactttacttaatctcaagggctaacagaaaaaatagtgaaaataccaaatactgatgaggatacaaacgggatattttatacattggctgacaggaatgtacaaggggtacagccactcgtgggaaagagtttatgaacttgtcttactcaccgtttaaaccataatttttaactcaagtttaaaccttaagacccagcagtggtgctccgtggacatttcatttccagagaactgaaaaccctatattggtcctggtactcaatttattcataggagcttaattggtaatagccccaaactgggaaacaacccagatgtcctacaacaggtacttggttaaacaaaccatccatacctgtggaactcactgctcgggactgaacgggaactacctgtggatacaagacctcgggttgtacctcaggggctatcagggtgaccacaacaaaacccagtctcaaatgggtccccatatggttttgatcgcttctatataccattccttgaggtgccaaacttttcgacactgacaaccacgctcacgggttcgcccaggaatacgaccctggacagggcgcgtgtgacgcaccactcgtacgacacttactcacgggggcactacaccccaggcgcgtttcccgttgtgagtggccgtgtattggcaacagaggtagctacatgggacctttctgaaagagatatcaagaaaatggttggacagcaaaaaacgaatttgaggacatatattgaagcggagctcagcacacagtgaggaacttcttttcacgcataacactgaaaagtatagatgtggaacctcagataacaacacccacaaatgaacagtggagtgtacaaaaccgggggtgatgactgtaaaacagatgtgagtctacaaaagtagacgataaaatacatggta

SEQ ID NO: 602312 - DNA, 299 bp, Homo sapiens
tagaggatcgtgagtatctgacaggtacagcatctagctgggcagagtgagagaaaagtgaggaggtgagctgaggtgcgggtcagatggaaggcaggattgggtctaaaagggattactctgctgggtgaggaagatgggggatcagggcaggaggagaggggctggcaggagatgacgggcctacgttgcagagtagaggggacaaggccaagtaagaagacagaccattcaggaccacgggaggggcctggtaaccgaggttggagaggttttggtggaaggggtaacagagtggg

SEQ ID NO: 602313 - DNA, 402 bp, Homo sapiens
tgcctgttgtctcgtcacctgcggtgcctgtgcgcagccctatctgctcaggctccgagaccatctgtgtagcccgtgtgtgctgctttgctggcgttcgctcgctgcgcggctctctggtatccttgtggagagagtcgagaagctggagtcctcttatagctcgtccggtctgcctgcgactatgcgaggtggccgtcagtcccacaactgttgtagtgcaccccccgtggggtaccacaatacctgcctcatccctctacaccagccgccacatccaccacacacacctccacacaccacacctccacccatagacctacacacacaccacacacacatctacacccaccacacacacctccacacacagctacactcatacacctacacagacacccc

SEQ ID NO: 602314 - DNA, 117 bp, Homo sapiens
gagtctggtgtatccttggaggtcttgactggaataacactggcgatttttaaaaggaagtagtagagtgttgaccctattaaaaaggaggagggcagtattttgggatttttaata

SEQ ID NO: 602315 - DNA, 158 bp, Homo sapiens
aactcacatcctgtcggaattgggataggagagtggtattcataaatccatgactttgggattcagcacaattatcagttagttttgcagaactggttgaatgaactatgtatcaaaactgtgtgtgtaccatggtatttcacagacctagagaaagg

SEQ ID NO: 602316 - DNA, 1157 bp, Homo sapiens
cacagaaactaatcatattgttatatcttctccgaaaccacagattatccccaagcattggcatatcatcacccgatgaggcaaccagccagaacgcctgaacgctggcacatacttcactagttctacatcgcgcgtagtaggctcccttcccctacgtcatcgcgactaatttgcactcacaacatcctagggctcactaaacattctactagtcactctcactggccaatgagctatcacaacttccgtgagccaacaactttaactatgagctagcgttacagcacatagcttttatagctaagagagtacctcgtattacggagctcgcaaattatgactccctaaagcccagtgtcagaagtcgccccatcgacttggtcacatagtagcttgagagcaagtacgtcttgcaaactaggcggctatggatataactacgcgctcacatcatcattctcaacccacctgagcaaaacagatagcactaccccgttccttgtgacctgatccctgatgaggcataattattaacaaagctccatctagcttacagaaaaactagacctaaaatacgctcatgtgcaatactcttcaagtcaggcaaatacgcctcggtagtaacagccatcctcatccaatacaccctgaaagctttcaccgggcgcacgatcattctcataatcgctccacggcacttaaatcctcattactattcctgcactagcaatactcacaatagaacgcatcagcagtcgcatcaatgatcctctctccaggacttcaaattctattccaataaaagcgttacggaagacactgttacaaatcatgattaacattcgcctttacctccattattaaccatctgggagaaccctcagtgtctaaaaccagatatcctagtcaatatgacgagcaaaaaagaaaccaaaacaaaacaacgtttaaccctcaatttccacacaacgggcacccccacattatgaataaactctcagagaaccctttagaattacaatataatacccactcggttctcaaaaaaaacgggcgagaattcgaggaggcatagcgctttcatcaccttcatatcatcgacgagcacagaccgagcatactctctatgcactgctgcccaaaagcaagcacga

SEQ ID NO: 602317 - DNA, 1048 bp, Homo sapiens
gccaaaacttgattcagaacactaacatcgacgaatggacaagaagagcgagtgatggacccagtacagcgctttgagaagctgccatggaagagttctatgcagctcatgtagaccagtctggagcatgtggccatgcggccttggcgcattgagtgcctgtcacaatgagttgtgactagggccaagcaactctcgcgaacgttggtgcgccacgagccacctaagacgccgacagctagttgcagccgtgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaagggaatgaagagcgtcctgggcctaaacacagcagcctcctctcttcctgcctgagcaccgaagcgggagccagcagggggcagcagaggccaacagggagctcgcaggccgggcccctgcgtaccgtgcccttcttcctgatcaccctcctagcctaagggtagactttgaactgtgtgtgtcgatgactgctctgttgcacaggccgtcccccattcttgcctgggtgtggagcctggctgtcccctctccctcagtccttctgactgtctccagctggaggtggctctgagctgcactcctctgggttctattacaggtggggtcccataatcctgtttctttaccgtggattcactggtcgaaaagggatacccaaggccaatgcttaatgacctcactttttaaccctagaggattaaccaagcctaagggaacatggcaagcaagaggaaaccagagaactggaaaagaagggagtaaggggaagaaaccaaagcgaaggaaacccaacaagctgagcaggagaggacaaaaacggcagaacaaacacgaacagaaagagagcagacataaagaacagcaggatcgcgcggagt

SEQ ID NO: 602318 - DNA, 135 bp, Homo sapiens
attcgcactggaggctagtggcggatcacctgagatctcaggagtcatacagcagggcacatgcgaactcgttccaccaaaatacaagaacagcctcgcgtgtggtgacactgtaatcccagctacttgggaggc

SEQ ID NO: 602319 - DNA, 128 bp, Homo sapiens
cacgagggcggccatgatgcacattttgtaagctgtctgactatgatactctttaaactagtctggtcatggcgtgaaactgaactacgtctttcctggcagaggccggcaatagcgagcaggaacag

SEQ ID NO: 602320 - DNA, 625 bp, Homo sapiens
  misc_feature (625)..(625): n is a, c, g, or t
agaaggatttgaaaaccccggatcgaggtactgcttacccgaggccgctgatgcgcggagaccacggggagaagccaccgtcatcatgtgtgaccagtaggcaaaaccttcaactgaagacttgagggataagaaggaacgtgaatatattaaactcaaagtcattggacaggataccagagcgattcacttcaaagtgaacatgacatcacatgttacgaaactcaaagaatcatactgtgaaagacaaggtgttgcaatgaattgactcaagtttctctttgagggtcagagaatcgctgatgatcatacttcaaaagaactgggaatggatgaagacgatgtgattgaagtttatcaggaacaaactgtggtgcattcaacagattagatattctgaagatagcttatctattccctcaatccttttttatgtgtcaaaatagatctatttgaatgtggagttccggaatatgaaactgtcaccccatctctatgcatctggtagtttgaattctagtgctcatgattcatgattgactgtattcatcgtgctgactattgatgagcgcgtcagatccctgcgtagtagcccttgcttttgagtggtgatagatagtcgccn

SEQ ID NO: 602321 - DNA, 156 bp, Homo sapiens
atgacacaagcaggtgtaggtgctgactgaacccagccttggccggcgctaactaaggcggacctggtttccaactcatagtagtacaccccgtataccctctcggcaagatgcacgcacagtagttgtcctccatagccctatgctagctacagt

SEQ ID NO: 602322 - DNA, 201 bp, Homo sapiens
aggcttatcgctctaaagattaaaaatgccctagccccacttcttaccacaaaggcacaaactacaccccttatccccatactagttataatcgaaaccatcagctactcattcacacatagcctggcgtacgcctaacgtacataactgaggcactactcatgcctattggaggcacctagcattcacataacttcctct

SEQ ID NO: 602323 - DNA, 485 bp, Homo sapiens
tagattcatcctttatctgtagctgaggaatacagtgccgtatatcctatagtgtactatcgtagtggtgttggtacaatgaaccataggcgtcgctcattatctcagctatggaaattccttcgcacaatcatccttgcattctctcttctagaagtggaacagaataatataaaaagggcaggacattgcaaaactaatagcttcatcgtcatgatctgtgcatttaaaatcatatttagagaaggaactactattctgtatacttcttgggcgaagttgaaacaggaaatcctttgagttaggatagaagctggagaattccaaagctggtgaaaccttgctcctggagaaatactagtgtttcctttatagctgtgggagaatttaacaaaataaatgggttttggcttaacaattttagtagccaaactttcatgttggcctcagagccacctacatctagataactctcttgaagaaca

SEQ ID NO: 602324 - DNA, 119 bp, Homo sapiens
tgtcaatgagacccgacattataaacagtgacctagcggccactgccatgcgagggttaagtcttgtaccctactctttaagaatagactagattctaactaccacatagtttttattt

SEQ ID NO: 602325 - DNA, 479 bp, Homo sapiens
tcacacgcacttgggcatggagatggatgcctgtaatcccacctacttgggaggctgaggcatgagaattacctgagcctgggaggcagacgttgcagcgagccgagattgcgccactgcactccagcctggatgacagagcaagactctgtctcaaaaataaaacaaaacaaaaacaaagaaaggaaagaaaacaaaaataggacgggtatagtggctcacaattgtaaacccagcattttggtaggtctaggtgggaggatggcttgaggccaggagttcaggactagcctaggcctaaaaactaaaaaagaaggccaggtgcaggggttcatgcctataatcccaacattttgggaggctgaagcaggaagagtacttgaggccaggagtttgaaaccagcctgggcaacacagtgaaaccctgtctccactcaaaatacaaaaaaattagccaagtgcgtgtgagggtaccgagc

SEQ ID NO: 602326 - DNA, 197 bp, Homo sapiens
actgagttccctgataggaacaccagaatagtcaccaccaagcatagagaggacccttctctgcgagctttaacgtgtcccaccatcatcccctgatgaaaaaaaatttttaacacagaaaagcaggacttcatgattgtggatcagtgattagcgaacccaactagacatccaggagcaatgagggtttgatcccc

SEQ ID NO: 602327 - DNA, 685 bp, Homo sapiens
tggttgcaatcgcctgggacgccgccgaatggtctgtgcaggttcgcgggtcgctggcgggggtcgtgagtggagtgcgccgggagcggagatttggagggagatggttcagtacccagagcctccagatgccggggaggacagcaagtcgcgataatggggagaattgtctcccatctactgcatctgccgcaaaccgagacatctaagctgtcttcatgatcggcgtgtgacaatctgcaatgagatggttccatggggactgcatccggatcactgagaagatggccaaatggccatccgggagtggtactgtcgggagtgcagagagaacgtaccccaagctagagattcgctatctggtgcaagaagttcacgggagcgtgcgtatggcgaatgaggcgagtgactaggcagtgagcccccgggactcgatgggtcggacgcggcgcgcagaggccttgtccctgatccagacctgcgagcagccggggcagcgggtcagggcagcacgggcgttggcggccatgcttttgcctcgtgggctctgttttcgcccccaggcatatccctctcgccgcaattgccctttggtgtgccttctcccaaggctggtgattctcctagcagcaaggcagccgccgaatcactctgggtcacgcccgcgatgttttggtgagtgtgc

SEQ ID NO: 602328 - DNA, 191 bp, Homo sapiens
actgtaccgcacggccgcagaaaaaagtctctcgcctgcgcgccggcagccgggtgcgctgataaatttggtcatggaggttgaagcggcgacaaactgcgcgaaagcctcgcccccggcaacctggcggtaggcatcgcggccggtgacgaacttcaccgtcacctgcgcccaatcggcatccatttccg

SEQ ID NO: 602329 - DNA, 108 bp, Homo sapiens
atcttctgctgaccacactgacctcgtatcaccggctcgacctcccaaaatgcttggattgcaggctgagccaccgtgcccagcctcattagttcttaaagtcactaa

SEQ ID NO: 602330 - DNA, 532 bp, Homo sapiens
  misc_feature (8)..(8): n is a, c, g, or t
  misc_feature (69)..(69): n is a, c, g, or t
  misc_feature (78)..(78): n is a, c, g, or t
  misc_feature (133)..(138): n is a, c, g, or t
  misc_feature (252)..(252): n is a, c, g, or t
  misc_feature (283)..(284): n is a, c, g, or t
  misc_feature (291)..(292): n is a, c, g, or t
  misc_feature (294)..(295): n is a, c, g, or t
  misc_feature (331)..(331): n is a, c, g, or t
  misc_feature (354)..(354): n is a, c, g, or t
  misc_feature (392)..(392): n is a, c, g, or t
  misc_feature (441)..(441): n is a, c, g, or t
  misc_feature (461)..(461): n is a, c, g, or t
  misc_feature (463)..(464): n is a, c, g, or t
  misc_feature (531)..(531): n is a, c, g, or t
ccccagcntccaatccacaacaccagcagacccttcagagacatgccgccctctaccaagaagccagangcctaggancatacaacatccatatttttttagaaaaaagagtcaaaaggagcatctatgagannnnnnaggggtgcaggctgaagcagcgcctcaacagccagggacatgtaggcaacacgagcaggcacagcgcggccaccactgtccacacgctcacacaagccaggcccgcaggtttcnggagagctagcaggttacattcaggcagatnnccctttnntnncccaaacccacagaaccccaaacaaggcatcaccangaaagacacgggaaagccaaatnacagttgaaccagggacagagaacccttggccccactnatgtcccaagccaccagcagctgcttccaaaatccctatgctattacantgggaattatatcatttaananncctgattattccaggcttctaatctttcatataaaactgcctttgttttgctgctttgttcaactgng

SEQ ID NO: 602331 - DNA, 475 bp, Homo sapiens
accagtgtcctgcgatgcactgtgtctgtgcagcctttaccgcagctatcataagtggaaagcgagaagcatgtgaaagaacagacgaaaaaaaccagcataacgtccctaacctcagaaattaagatacacttagtgaacacagtgctgacgactttgggtagcaaaatctgcacggttcttaaaatgggagtcttcaaaagtacttcttcaaattcaaaagctaagaaaaccaaagagggaccagttacacaggcttactggagatgccgcctgtcatgaagatgaccatcagtcctacttcccagacacagtgagaaccggtgagcctgacgaacctgaaggaaaaggccggctgacgggtgctagatgcaatagactatacaagaacacaccgggtcaactcatcattgacagcgagagacacactactgctcctcctggctgatgcacggctgcctttctgcacctcaag

SEQ ID NO: 602332 - DNA, 272 bp, Homo sapiens
gatcaggaaaaggtccctcctttgcagaggcaaaagaaaatccacttcctcaaggatctgtagattataataatcaaaaacgtggaaaaagagaaagccaaacatctattcctgattattttatgacaggaatcacaaacattaataatgagcttcagtggtataaaattgaaaacatttgatgtaatctgatttcagatccagtcgagtatagttcattggtgtccactgggagtgaatccatgaggcggcggttggccttagccgcgcct

SEQ ID NO: 602333 - DNA, 310 bp, Homo sapiens
ggaagatgaggatgacaccgaggaggctgaagaggacgatgaagaagaagaagaagagatgatggtgccagggatggaaggcaaagaggagcctgctcttacagttgtacaacagcgtgttgcccttatacgagggaagcagtttattttggccaacgcaggagacttttgctttttgatctttaggcttgcaaagctttagacattttcctttcttcaaaccagaggtgtaggtgatctcacgcgtctaaggatgttctggtggcaggctaccatgtgtggcgtcgtcagcggggctcttatcttctcc

SEQ ID NO: 602334 - DNA, 177 bp, Homo sapiens
tgtcggtaccatcagaagaggcattaaacaagaatgcagcaaacagctggctgtccggtctccctgcaccaggccctgctctgctgccagcctgctggaacaggaccaactccgctgcccacttctgcgcccagcacccactcgcagctgccaagatcactggcctcttctgatcag

SEQ ID NO: 602335 - DNA, 205 bp, Homo sapiens
ctcttctttattctcttattttatttatttctttatttttgagacagagtctcactttttgcccttgatgaaatggactggcccaatcatggctcactgcagcctcaaaatcctggcctcaagaaatcctccagactcagcctcctaaagtgctgggattacaggcatgagccacagcacctgacctagactgttttaaactaga

SEQ ID NO: 602336 - DNA, 405 bp, Homo sapiens
cttttaagggaactatgtaaacagggcaccagtccagtcatcccaaggggctttttattggctctataaagcgaatctcgattcctcaaagcagtctcgtcatatccaaaaatacgtcatcccagtccaagccttggtagaataaccagggtctccaattgtgtcctgttacaaggacaacagattcttactgaactcatgcaaagaactacattgccataaaataagaatacctcatgaatcgcttccagatttttgagaaatcaggtagagaaaaagacaaatatttcagttttgctcacaaaagtatatgtcactcaattgctatagctataaatagctcaaaaagaaaaaggttttctgactctggaaaacaaaatataaaaagagtcagcaaggtttcga

SEQ ID NO: 602337 - DNA, 335 bp, Homo sapiens
aaagttttcttgtagtaattgcatagattgaggtcttagatttaatacatttaatacatttttgtttgatttttgtatatggcaagagatggaggcctagtttcattcttctgcatatagatttccagttttctaagcactatctatcgaagagacgtgtcttttccccagtgtatgttcttggcaactttgtcgaaaatgggttcactgcaggtgtgtggatagacttatacggtcagttggttttatggggtcgtgtttgttgaatgactgagtgaaagaaatcaaagatctaaattaagtagagacataccatgcccacaggttggaagctt

SEQ ID NO: 602338 - DNA, 652 bp, Homo sapiens
ggggcgataatggcggcgtcgaggctggagctaaacctggtgcggctgctatcccgctgcgaggcgatggcagcggagaaactgggacccggacgagtggctgcctggagaagtacgtggtgagccctagaggacatgttgcatggccctgaaggtccgacgcgagctaaaccgggcctctgaggtgatcaatgaatattcctggcaggggtggcattttctgaagggggatgctgcaagccgagaagcatgaccttcctcctcaagagaaaagcactggccaaccatgttcctggcccctggccgtgttgccaaccaacaggccagagagcgaggtgcccgccacaaagacggtgcattctgcaggtcacggggcgcggtacacccagccgagatgcggagtgagctactaggcaacggaactctgcagagcctgagatggacgtagggaaggagaactggagtggcagggtcccagccagtgagtgagaaagcagtcggcagctgagcttagacctcgtcctgcagcgacatcaagaacctccaggaaaagctggggaagagatgctagggactggccggagcctcagacacattaccttggccgcccagagttgtctcaagagggacacaagaccctgtcacactcatg

SEQ ID NO: 602339 - DNA, 733 bp, Homo sapiens
gtaaggtgccacaggattaagctgaaagcttttctttgttggcggtaagaactttaaatgtgaaataaccttttgcagtttaagtcctgtaaaccacattgaagcatggagatgaggcacaggaatagtactcactgaagttgaaatgactgccccacttccaagatcttccttgtgtttacacccccgtgtatgttataccaatccgaggccttttgtagatgctttgctgacttgttcagctctgtaaaacacccgaaatcacgaccccttttgtaaagcggaaaatcactgttacactggaacactgtcctgtatatagtcaccacctaacctggtaatggagtcttaatgataagtgccagataataatttaatgatgggattagtctgatcgcttaatatgcacccatcctggagagtgaattacttgcactcacgatatagtgatatttattatttctgtaccacgagagaaaagatacactataaaacactatgcttacccttacactgccaccgccggatttcactgctccactaatcttttctattttttaatttaccccttctgtaaatgatgtgcatggaatatgccttatagaaaaatgctgttcataatttgactacgtggaaaagtgcctatatggtggtaatgctagtaaggccaataagaccaattatcatgttggtttactacatcccccgttaacctttcatattgtgatgttta

SEQ ID NO: 602340 - DNA, 131 bp, Homo sapiens
acctatatgccgctaggctgtatacctatgagacggaaggactgtgtgaagaactatccaacattccatagtgtaattgtgatcgctactgtggcctgggcgatggctaggagaggttcaaagattgcagg

SEQ ID NO: 602341 - DNA, 109 bp, Homo sapiens
ccttcgcctgttatccagcgcttgttgaggtcgaggcaggtggatacttagcccaggggtttgagaccagcctggattacatggacaaaaccccatctctacaaaaaaa

SEQ ID NO: 602342 - DNA, 729 bp, Homo sapiens
  misc_feature (431)..(431): n is a, c, g, or t
tccagccatacacttgcttttttttaaatcagtttttttcaaaatgcagccaaatcttaatgattgggacagcccaaagtacccagcccttatttccactgtggagtttagttttacccccacagcgagttagacacccaggtgcgtggtttgtggttctccgtggcccatgtggtgtgggacgagccgtgtgagagggtgtgagtgggaagggtctcttagccaacagaggtgagggtgcgtgagtgtgccacgcggcgaggggtgcttctctgtggcgagaacgagcccttagagagcaagaggtatacagcgagaggagcaccactctcgcgctttcgagaaccacgcgagaggcggggttttgcggacacccgagagagggcgaggcaacttttttctccctctcccacttgtgtggcaaagagcgngcacacagcggcgtgtttgtggtctcttctctctatatcctctctatgttgtggcgtcttttttcctatataaagggggcggctcaagcgacgctactagcgcgccgctgtagcacgcggggtctccagaggagatgtgggggtcctgagggggcgcgttcaacagtgtgggcgagcggagggcaccccctgtggcactgtgggattgagaggtgtcgccctgtggaaaaacccctgtgtgtggggggggcgttttcagcccctgagagggggcccccttttgtggaggggctaaatg

SEQ ID NO: 602343 - DNA, 1039 bp, Homo sapiens
gcaatgagtgctgctgctaactgcggtccccgtgcacgcaccatctgttgccatccctggccggcctgaggccattgccagattcttggacagatggcaaatgttcattgacaccctgtgatccatgtgacaacccctctaggcttggggtccctgttgcaggttccctgagcagtttctgggatattgcccatacccagacctgtatcaggctaacaggcacgaatcgagcctaccgcacacacgcgctctgcagtgacctggcaaccagttgacgccacccaattacccaaatgactaacacgcaaggataccagcaacgactacacgctacctctcttcctcaccctctctggcgttagtgattgtgcacacgtttccacacttcatttgccttctcactattccccccattgcaaggtgcacgtggaactgcaccacaggctaatgcctttttcccctacgcctagggccttgactaacttcacccacaccggccgtgcctgtgccaaagatcagctatcggcaccatcgctaaaccggttggccgccttttacacccaataggcccggtgctcaccacttaccggggatatctttggcactgcacgtgtgagagtccgacgccaattgcacggaggtaagaagcgcctctttacagcctggcccacaactcgagaggtgaacgcgagagaggcggtgaaacttcccggtacttcctggggctacaacaccagcagctggtgttacatggcccacagcgcgttccatccaaggatcgcctatggggccatggcgtacatctcccccattggaccccctcttaaccactgcaaacgtcgttggaccccacagaagtatccataagtgaaacccacgcgtcaccgggctactggaacttgcacctaaccctgcgccactcatatatcccatgtagactcgcattgtcgccacggcgcgaaacacgcaacagtaaagaggcgtattatgcccagtgtgtacatcatcgacgcccaaaagccttcctacttggagccag

SEQ ID NO: 602344 - DNA, 371 bp, Homo sapiens
gtgatgttatcccaacacaaaatacaaaaaaaaaaaattagccgtgcgtgtggcatgcgcgtgtatcccagctactctggaggccaaggagggaggatcacttgagcccgggaggcagaggttggcttgtaggccacatcttatcactgcactccagtctgcgtgacaaagcaggactccatctcaaataaataaatacaaattggccgggtgcggggactcatgcctgtaatcccagcacttttggagaccaaggcaggtggatcttttgaggtcagtagatcaaaaccatgctggccaacattgtgaaaccccgtctttactaaaaatacaaaaagtagccgggcgtggtggtgtagggcgataaatca

SEQ ID NO: 602345 - DNA, 463 bp, Homo sapiens
  misc_feature (17)..(17): n is a, c, g, or t
agcctttgtaaaagganaataaatcctggggcctcaaaatcactaagctaaagtgaaaagtcaagctgggaactgctcagggcaaacctgcctcccattctattcgaagtcacccctctgctcactgagataaatgcatatctgattgactccttgggaaaggctaatcagaaactcaaaagggctgggcgcaatagctcacacctgtaatcccagcactttgggaggccaagggaggtggatcacttaaagtcaggagttcaagaccagcctggccaacatggcgaaaccccatctctactaaaaatacaaaaattagacaggcatgatgtcatgcacctgtaatcccagctactcgggaggctgaggcaggaaaatcacttgaaccctggaggcagaggttgcagtgagccaagataacgccactgcactccagactgggtaacagagtgacaccctgtcc

SEQ ID NO: 602346 - DNA, 999 bp, Homo sapiens
cccaagctggacacctttctggagcacatcagaagccaccaggaggagctggtgtactccgcgtgccttctctgtagctgggacctatcctcttcacctcgatatgtagcctggcgctttactagcagctacttccacgaacagccctccatgaacgagctgcagctcactcgagtagagcgatcatgctgcagtcataggacgttgtgtctcagttggtgttagaccatggtactctaaactcacggagtccctatgagagcaaccatggtgcaagaagaggcactcaataacgtaacacgctgcgcgtacatggctgtagtcggtcgttctcgctcatgtagaaatacctacacttccgcggaggtcactttggggacaaccagtgtgaaggtaaggggggcacgtcattaagcgttgcccacgtagtctcgtaacgagcttcataaggtggaaccgccgtcatgtaaccgtctaagcctgacgagggctcactatcccaccatcccgtggagaaggcgtcgtgaccagaattgctcgatggttggtatactgtgagctatctaactcgccgagaaaacgaaggctgtaagcatcaaagctggactggatcccacgtagcccttcgagtgaagatagcaacattgaccccatgtctcgagatgtgtgaaggtgtggcttcaagggagttacagaacaggctggacgaaactagatggtcgcatttatccgtactccctatcgctggtatagaagggtgtcccgtggatttgattgcacgatggtgttctgcagcagatggagatgacatcccgagcggacaaggctgaaaacccgtagttgacatactactcaggggcggtggtgacaggatcgcttccaggtggccttgggtgatagaagagtcccacacagttgtgggcaaccttgagggcaaaagaggattgcactcttgtttgcacacccctttgcctagaggagaaacattccagaaaggga

SEQ ID NO: 602347 - DNA, 420 bp, Homo sapiens
gagctacggagaaggagcatgatgttcaactaaggtgtggactttgtgctggacacaggggttcagcatgttgactacgctgggctcagtgcaggactcttgtatggctgcctctcctagctttccactgcgcatggatatataagctgcagccacactgcatagcccgtcttaacctctactaccttatttggcgccagccactgcgcccgactttcctccacatgatctcatcttacgctgcactcaatcgagtggatctatagtatgaactaatctgaatgcgatatataagacgcccgagctgttcactgtatgagccatatttgatgaggctgagctgcgtgctcatagctagactacagagatcataatgctgctctgtgcataccattgggagtctgggctatgagcatggcg

SEQ ID NO: 602348 - DNA, 1197 bp, Homo sapiens
gagagagagagaactagtctcgagttttatttatattatattattttttttttcccggggggagtgggaataatggggaacatatacacacacacaggggcgctaaaaagagaggattaacttcacaaagtggcaagaagacagagggaaccaacaagagagcgccgaagggcgcgcaaagggtacgcacgcgaatcacaccccaacagggggcgaaatgtggagtgggagagaagggcatctcccactctcacacagagagagagaagggggagaacccggacatgagcgagcgccagggcccaaggcaggcgggcacacacacacccggacaccacggggccccctctggtgcgacactcggcaaatcagagaccacgcgcgcacacacagagtataatataccacacgcgcctgtggggcccccccaagactaggggcgcctcccatgtgaggacaaagaagagcggcgttaaaaaaaagaagagaaataaagaaggcgctatatcgtgtggacaacaccccccttcttacccccctcctcttaagacccgcgagagatataggagaacacacatgcgcgcgacaaatacagacacctacagagggcaaccccccgcgcggagaaaacagcggaggagagggcgcgtgcggagggagagcaagagaacgtgggcgctccgaacaaaagaagatcatacacaacgagagacaaaatatataaacgcgcgggggttccgcgacaacagacagcaaattccggcgcgcaagaaaaaaacacctcactaatattaccctaccataacactcccgccaacaactggtgggaaccacacccgtgatgcgaacgaatatacccgagagccccataacaccacaagcatacccaaaggggggctcacacccccccccaagggggggcaacctccacgacaaccaaggggtaccagcgacaccaaccacgtggtgagacacaaagttcatcgtgcacccacgccggcgaacaaaacaacacagccgatgccaacagcaaccgacgacacaaaacgcgccccaacatccgaaagaggagcgcgactcccgcccggcacaccagaaacagaccggacccaaaacacaccgccacgaagccggacgccagactaacaacaccgcgaagcccacgaaaaactaacaaggcaccaacccccccctgcg

SEQ ID NO: 602349 - DNA, 469 bp, Homo sapiens
  misc_feature (30)..(30): n is a, c, g, or t
gccatcttcttgtcctgaagcatttgaaanctgggtcccagaaccttctgctcctttgtctgagattctcacatgtaccatgcagggacttgatcaaacagcagatctccatagcttctgcaggtctgtgcagtcaatagctctacctacagtccaccatattgtttgagaagtcttatacatattgctgctatacactgaagttaggggccacagccttgctttttttgcatgggggaaaaatcctcaatccttcaatctttccttagatatcaccttctaaatgagccctactcttatgtatattgttcctacttatgtccacctcccaaccagcatctcactctctcctgtcctcggctcctcctccttcacctgttttcccttgtctgtataatcttgtagaatactggagctttctttcccagcatgcttttgtttcttaccaccagcatagaaactgccttac

SEQ ID NO: 602350 - DNA, 866 bp, Homo sapiens
cactagctagtcaggtctggtgttatcggccgagggcgggagctgcgcgcgcgcccgtcccagctgccgccccgcgcggcccgccgcggccaggatgctggaggaagcgggcgaggtgctggagaacatgctgaagtgcgtcttgttctgcctctcggcttcatcgtcttcctgcccgctgtgctgctgctggtgtgcggccgcctgctgtcctgcctgcgcgacgtcctgctgcacgatgttcacctgtgtacctgcgagtgcagcacgtacggacctgctagggccatgccctatctggcaacacggaactgcagttgctgacacagcggaggctgctgcacagatggcgtgctgggagtgtgcttgagcctgccgcctgcgtgctcatgcgtgctactggacttctcgctacgagcagtaccagaatggccctgcggcagtcgtgcagggctgccgtggtcatcatcctgcccagggccatgtgccgcctgtgccccagtgacgtctgtcctgtgcaattcatggagatcgagcctggagatgctaggccatggagacctgcccgtccccgtgtacttttgccgtggaggacgaggccctgctgtctatctacaagcagacccagggctgcctccgcctcccagtggctccgccgtctgctgctgaagtactgctgctgcactggcactgccacggcttccagatggtcaccagcggggtacagagcgaggccgtgagtgactggctgattgcagcgtggagggcggtgacgggctggctggtaggcctccccatcgtttgtggccctagatgtttgagggcccctggtgtgtgggcggcccggccggcttcctgctcgctca

SEQ ID NO: 602351 - DNA, 470 bp, Homo sapiens
  misc_feature (10)..(10): n is a, c, g, or t
aggcgcacantgagatcctgggggagcaaggcttccagtccctcatggaaacggtggacacagagattgtcacccagctgcaggagtttttgcaaggattctaagagcacgtgtcatgtggccaccatcccttctgaaagaagctgagtaacccagcctgccatccatttatgagcctgcctgagataagatcatttgtgtatgaatataaagaaaccaagaccataaattttttactataaaatataaagaataagtataaatcccaaatattaaagtcagaaaactattcctcaaaagaatttaattttatatttatgaggggccctgtgctgactagaggtgcatttattgagagtagctgcattgtctcttgttaagaaactcgctgattatctttgaatcatgagctcttaacacttggagaagatgaaggttgatgttccagatgtttttctgcaacccaaatt

SEQ ID NO: 602352 - DNA, 707 bp, Homo sapiens
  misc_feature (52)..(52): n is a, c, g, or t
  misc_feature (55)..(55): n is a, c, g, or t
gaggtcgatctagacgatccctaggtagatttagtgctgggggacgccgacnatnacatcagcctcaccgattcggagtccgacggttatcagcaccaaagcgccggcagcggcaagggcatcgccgcgaacttcggctaccgctttagcccggacctggaaacgcgcttctacttgcgttaccgcgaaaccaccaacgattcacccggcaggctcacgcgtgaccagatcagccatgatccgcgtgccgccaacagcctcaatgccgcccacgattcaaagcgcctgcaaccgggctccacctggattgccaacaagaccaccttgcggttggacgataatgcgcgggtcgaggtcgggctggcctatcacgattaccccatggacctgcgcgaaggcaccaaccgcctcaaagttgcctacaccgatatcagcggcaccctgaattacatccggcaggacagcctgttcggccatgccagcaccaccactctcggcctgcgtactacccaggcgatgccgaacaatggcgcgtcggaatacgtgcgcatccctgcgggcaatactgccatttatgcccccggcaccaagacccgcgactacagctacctgggctccgataccgtgctgcatgtaggcaacgagctggaactggtggaggatctgtggctgaccaccggccttgccgccatcaaatctacgtgggc

SEQ ID NO: 602353 - DNA, 409 bp, Homo sapiens
tcgaccctgcctcagcctccccagtagccgagactacaggcatgtgccaccatgcctggctaattttttaaagtttattttttttgtaaagagggagtcttgctgtgttgcctaggttggtctcaaaatcctggcctcaagagatcctcctgcctctgcctcccaaaactctgggattacaggtgtgagccactgcacgtggccatatcatttttttttaatgtgaccaaattgaggccgggcattgttgctgacgcctgtaatcccagcactttgggaggccgaagttggaatatcacttgaggccaggaatttgagaccaccctggccaacatggtgaagccccgtctctactgaaaatacaaaaattagctgggcgtggtggtgtaagtctgtagtcccggttact

SEQ ID NO: 602354 - DNA, 257 bp, Homo sapiens
acgtattcgacgcgccattgttcggcatcgcctgggcagtacgcaggccgagagtggtggtgctggcatggccgaacaggcgcgtcggaatacgtgcgcatccctgcgggcaatactgccatttatgcccccggcaccaagacccgcgactacagctacctgggctccgataccgtgctgcatgtaggcaacgagctggaactggtggaggatctgtggctgaccaccggccttgccgccatcaaatctacgtgggc

SEQ ID NO: 602355 - DNA, 1017 bp, Homo sapiens
gggaggaggagcctgtggcccccagcagtgtggcacccaggtggctggaggagtgaggccgctctgcagctggccctccacctggtcactggagcctcaatggtcaggtggctgagcagtgaggacggctgctgccctgctggcaagccctaaccctctccctgctggagcagaccccgttggagtgcagaagagcccccagatgtgggtggacttgatggcaaggcccagctggtggtgcactcggacctttgagcaggatgtggaggagctggacctgggcgctcatgggctgccttggaggtccacagtcacaggaggagacggttggggccctgagctgccgacacactgcctgcagagctgcagtgctcgactggagcggtgcatggatgtgagtgtagccctgagtggatgacatgcaacatcctccgattggattcggaggccacaacctgaccagtgcatgaccgacacattggatgagccacttctggctggaccctgagatcagagctatggcactattacccatatggagcatatcaggacccataccattgagagggggcagacgcccgaaggggaccattcgaaacaaacactgcgagcgtctggccagagcaacaaccgggggagttccaggaggatggttgatgggccttactaacgagaagcctggaaagactgcaccgcgagacaacaatacagcgtcgaacagagtgagaagcgcgtgtcgcaaaacagagatgctggcagaccgacacatcactcgacgcatccgttaccaagtggacagaccgcaccttgctttgccaggcgaaatagagaagaggggggcggcccgcgggagtggaggacaaggagagcggaggtaccacagcaggggaacaggacggcgaccaagggagaatgcagtagacaataatggaaccaacggggattacgaaccgagcagaagtcacggggcgactgaaaaaagagcacagggacaacgtaggaaagggcggtgagata

SEQ ID NO: 602356 - DNA, 851 bp, Homo sapiens
  misc_feature (416)..(416): n is a, c, g, or t
  misc_feature (427)..(427): n is a, c, g, or t
  misc_feature (637)..(637): n is a, c, g, or t
  misc_feature (688)..(688): n is a, c, g, or t
cttggtccccccttccttctctaacgcaccccttgtccctttccctacacgcttttccactgtgagactggaacatcatcgggacagcccaaaatgtcctcttcccctgcaggagctcagcaaacatccacagagtgaacattccaagcaacatagtccaggagccacgttccagccatggggcctctgcactgctgttctcttcacatggcctgcccttcccccagaaagagagaagaggccctctctggttgtcccatcaaaactccacccttctctcaccctcctcccagctgtatcccttctctgcagccctaacatgcattccactttatttcccttgtctactgtctgcctctctaactactaagtcagttccagccgctccaggatttttgtcttttcagtttagcccnggttcctcagngccttagtgactagtgtgtagtgcctagcagccagtagatgctcaataactgcttgctgattgactggggtgagctccccatccatggagctatttcaagccaagcctagacgatctttcagggctagttctaacctaagacttggtagttccatgactctcttcctggcccagaccgaaaaggaactttcagcaggaacccgggactgngatctgagatggggctccttggaggactctgactaggaagagagacggganggcgcaccaaaaacacaagcccttcatgtgtctcccaggcgtaggtctggggaatcccccaggcccctcaggatcgaccctgctggccctggatctccaggacgcgtccctctgacctgcctgccgggtctgtgagtccccgggcagacaaggtagagccgag

SEQ ID NO: 602357 - DNA, 1021 bp, Homo sapiens
gcagtgagccaggattgtgccactggactccagcctgggcaacagagggagatgccgtctcaaaaaaaaaaaaaaaaaaaaaaaaaacccgcgggtttcttaagggatggggggggggttataaaaaaagagggcaggtagagaggatgaacctccaggggtttgggggaccggacagggggagttaatttatgggagaatagggcaacttgtaggagggcacagaatttgaagaggcaaagaaacttcaagaaagacgaacgcgttttggggtatggtcagcattgggagaaggcccttttgggacggtcacaccggggaagaatggtctgaaggctaggccagatgcgaattcgatgaaacctgggaaattccagaaggaagagagggttcagggctacgataaattacctttcgggaaacattaccatccaggggtaatcaacattaccttttttaaaagcgccattggggcgccttatgagaaggacacccttttagaaagatgtcgccttggtaacactacggagaacactgtggcgcccaggggcattgatctccccacattaccaggggtcacggggaaaacggattcaggagcggacaccaggcaaacgggaggttccaaccaaaaaagaccgtctgtgacggggacagactccgaggagagaacccaggcaggggtgttgtcgttggcaggggtgccagtcttaagaaagtgttggtcacacacaggaggcgtgtcacgacaagggcttaaaaacttaacccttggcttcagggctcaccaagcggtgtggcacgctaaggcgtgtctaaaacactaaaccggtccgggattgccaagaaatgggcatgtgtcttaaagttccgtggggttcacaccacaccccaatgttccaacccaaaggtgcttttgtcaggagccttggagtcccgtgcacgcgaggggtctctaacccgctgtatttatacatcctttactgcctatgtacagccaccatttttcactatttgcaaa

SEQ ID NO: 602358 - DNA, 110 bp, Homo sapiens
acgcaacacattcattcaatcaacatcacatgcacatgcacaggcaagggcaggcaaggcatcataccatcaccacctagtatgtaaatgcaacatgtgggcgtgctgca

SEQ ID NO: 602359 - DNA, 134 bp, Homo sapiens
gcggtccgtggggatacgatttgcccatcatgcaaaacccgtgaagcattagttaaactttacttcctccattgctaaccccactaaaacactcaccaagatcctcaatccccttgaccccctatgcctcatgc

SEQ ID NO: 602360 - DNA, 1238 bp, Homo sapiens
  misc_feature (330)..(330): n is a, c, g, or t
gttctcctcacctttagaagcaccagcagtgacttgtcacaatgactctgctgagccgtctgctggctcgttggggcatcctacctggagacaatgtcgtgtgctgctctggatccactgatacgtaatccatggactgaggatctcccaccggaagagtgcgagacccaggaagacggattgacattgctggaacatgggattcagggatgaaccacacagaacgtatcacactttatgatgcacacccaccaaagtctagtattgaagattcgcccatttacaagaccatattatctcgcttctagtcatgggccaccaggcaaattnccatatatgctatctcgactaattactgtggctattctatcaccctaaggtgtagcaactccggactttagctggcccttaatggccttagattggtaaccatacgcttgggccagccccatgggcgggccacaaactcctccggattgaaaacattccgtggcaatgagcccgtggaaatggtttaacggcttctggcgggaaacatttgacgaggatcggcggctggtagctccaagtcgtcccgaggattatcctatgggagacatacatcaccgttatccacatacagaaccctggggccaggaacacgtccagcctcacaacgctggaagcatttcggggcaaaaggcgtcgatgtttccgtccgaaacgttaggcgcccatgaaaagctgaggcaggattctagatccaaagggtaagcgaattagtggaaatagacgtggcgctaatgcaactaatccagactccgtaactagtgctcggatcgtaccaggggcacacgaccccgtaatgaacagagctaataaattctggtcgatcaatcgcaagaattgcttggatacctaaccggctaactacctaggagggggaacatggctgcttggaaataaggcgcctcctggagagcgctaggacattgcaccaacttgcaagtgtggtcggcacatcttgggtagacatctgaactgatccattgcccttgagaatggagcccatagcccgttgtcaaaatcaaacactgtgtcttggaacatgtgttcgacgtggacccacgctcgcacgggaatacgagttgtccatcaccacaccgtttttggacactgcaagggcgtacaaccagacacatgtggtaaagcacagggcagccaattggtatatcaacgggcgttgtacacagtcggca

SEQ ID NO: 602361 - DNA, 118 bp, Homo sapiens
ggccggtcggtctaagtagtgaaaacatttgacgtacatgaagactcgtataaataagtcaacttttctgtgggactcgcgtttatactcgaattcctcgggtgcccctcgttgtctc

SEQ ID NO: 602362 - DNA, 367 bp, Homo sapiens
cctacgggttcgacgggcaccggccggtagggcactccgtcgactacgtgtgggggaacactggctacttttacaactacgagaccacgtcacgggacagacacgtcttaggactaaacacttccgttgactcacgacgactcttacgcggggactgacacgaccgacacgactcgacgacccgacgacacgaccggacgctttttggcacgacacggacgcacggactctcgaccacgctgacccttgacgacacgcttggtgacgaccggagcagacagacgacggtgtgggaccacgggaacctggactagacctcaaagacactcaggactgagcgaccactaaactacggactaccagatac

SEQ ID NO: 602363 - DNA, 1117 bp, Homo sapiens
ggagagaactagtctcgagtttacgatgttattttcgaaaagcacttgtctcctttattgaacatctgcagggggcccctctgccctgaccaggcagccaaaaaacaagcaggcaggtggtggggggcagggtgagcatggggcaggaagacgcccaccctcattatccagtccttgaaaaatggcttgacaaatgggactctcatggccctgaggcaaacatctccacctgagtgtccggggcgaatctgcatgcgccaagaatgaagccctcggccactgtgcagggttgcctgccgcataccttatctacatactcgacttatggccccttcaagaatatagaatctgtgccacagaagcccgtgtgtccagacaccaagagcgagtacatcagatatcagcacgtccagggggcaaagtgggcttgaagttcacgccaccttgtggcaccagggtaacactctgtgctacccagggtgggcattcaatagagaaccttataatacacaaaacagcgtgacgggccctgtgtggccattttgtgcgcctgtggctacacgacaggcattgaagggattcttacgctaacagggggatagtagacgcctacgcttaacaagaagccgaaggtgtcattagagggagagccccgaggaaaccgtgggatacactctccagcagagtgttcactctacccctcaaataccagtggaaccaattcttccaaccttgggggccctttgccccacattagtacggcactaccacgatgtgttcccctgttatttgtcgcccaaggaggcccaaagtgtcccccactccgccgcatatagtaagcatgtcccccccagggaaaaatgcgtaggggagcaccctttatcacacagcccacaaaaaccaacggtggtcgcaaacaaaagttgctccttcctgggggccccgaggggtttccccgagacgagaagtactctcaccagtcgtccccccatagtgtgattgtggaacaagcaccatggtcccccccaggatatacataagggtgccccccgggtgtccgcgtgcgtgagaccacagcagcattgataaccattctccatcacccccccttttcaag

SEQ ID NO: 602364 - DNA, 350 bp, Homo sapiens
  misc_feature (115)..(115): n is a, c, g, or t
  misc_feature (195)..(195): n is a, c, g, or t
  misc_feature (252)..(252): n is a, c, g, or t
  misc_feature (283)..(283): n is a, c, g, or t
  misc_feature (336)..(336): n is a, c, g, or t
tactagttctcattgcatcagcgggcccagttgatagagcagcagaagcaacagttcctgcgggagcaaggggagcagcaggaggagtaggaggagattgtgggggcacaggagntggagcactcacatctcccccgggagcacctccagacacaggggtctccatccccagtggaggaggtcactcagttacanggctctccccagtatatagcaggcgtgagaagacaaggcagccctccagagtcatgngaacgacacgtctgatgacacagagcgcagntcatgatgggtaatagcaccctcccagacccctgggacgatcgacaccgcagntgcgcaggcggaga

SEQ ID NO: 602365 - DNA, 222 bp, Homo sapiens
gggaaaacaaaataaattttttcggccccccccacataacattttccctgaaggggagggtccctggcacctggcccaatttccacaaggggaggggtgggccccttccctccttttactccctaattggcccaaagcttttgaacagacccttaaaccaagcaaaggaagccttggggggccttccccccctgggggggtacatttgaaattcctcgggcc

SEQ ID NO: 602366 - DNA, 229 bp, Homo sapiens
tagtgactcaccaaggaattaatttttacctagaaatccatgcctgagcaacatagtgaaagtccatctctacaaaaattacaaaaattagccaggtatggtgcctgtagtctcagctatttgggaggcagaagtgggaggattgctggagcctgggaggttgaggcagcagtgagctatgattgtaccactgcactccaacttgggcgacagcgcgaaaaacagtctt

SEQ ID NO: 602367 - DNA, 188 bp, Homo sapiens
gagatcatgccactgaattccagcctgggtgacagagcgaagaccccgtctcaaaacaaacaaacaaacaaaaaatgaagatcaattttcatcctactcattcccagataatactggtcccaaaccattacttctgcctgccactggcacaaatacagtaggaatgccatccccttctgtcgtcttct

SEQ ID NO: 602368 - DNA, 154 bp, Homo sapiens
gcgccattcgaggcttcttccggggggctgagatctagagaggaggggtgtgtgctgctgggagtcgagtgccccgggcgctgtcgtgcctgtcatctggtgtggtgtggtggcccggcctggggtgtccttctgtggtggtagtctgcggcag

SEQ ID NO: 602369 - DNA, 113 bp, Homo sapiens
atgtagtaaacaatgaaaataaagctattttctaggttaaggctatttctaggcttatttagtaataaagctatgctttagaagttgcattgctgcctgcaatcccagcactt

SEQ ID NO: 602370 - DNA, 430 bp, Homo sapiens
  misc_feature (422)..(422): n is a, c, g, or t
ctgtggaagacggggcccacatttctgagggcaggactcgaaacaggcggttccaccgggccccggcccattgctcctgggggttaatttggtcttggaagatgacctgtgcttcccactgtcccgtcccccagcgccctagatcggtgggcaacgtgagtcttcctaggggagggcccgggccagggcgctgcagtaggagtggacacgtttcagtcttgggaaggcgggttcatgcagggactgtgccaggcatggggctgtctggtaccagggagagcccgctgggcccactgaggcagacacacagccctcgggggcatctcacccctccccagcctccaggcagggcaactcctagagacaaccggtgtcacggctacttacgtctgaccccaatccctcccgctgctgtggaaggngagggagg

SEQ ID NO: 602371 - DNA, 163 bp, Homo sapiens
gctagcacgggaaaggagagagagtggaatggactgggagtctggggttagtagatgcaaactattacctttaaatagatgggcaatggggtcttgctgtatagtccagtgaactctgtccaatctcttggagatagaacatgcttggccttgccatatgcaa

SEQ ID NO: 602372 - DNA, 574 bp, Homo sapiens
  misc_feature (574)..(574): n is a, c, g, or t
acgcctgacctcaaaagatccgcccacctcggtctcccaaattgcgtgggattacaggcatgagccatcgtgcccggcctaaaaggccttaatctcgataggctttttgcacatgcactatataaattgagtgcagtactcaatacttacgcccttgcccccttctccctggatcttatttgctaaagaagacattgatttctcttgaaaatgtaacaaaatttttgttgaacattttagtgttgagtgaaaagatgagaattctcagacatgaattttttatttgataataggaaactgtagttataggggaaagtcagtattttgaaaaggcataccaaataggcaaatatttatggaggttctaacacaagcaaggctccctctgtcagaatggacatcaggaaaagtccacttggtgaacattcaataaaatttataagttgctgggggggataaaaaatatataaatttgccttaaaagttggtttgatggtctggaaacggtaaaagtaaggattgttttttttgccaagttcagaccaattggggcagccgtggtttttggcagcan

SEQ ID NO: 602373 - DNA, 1385 bp, Homo sapiens
aacatagcctgttctctaacacaatgcaaaaaaagacgtagaacaacatgtttacgatgtctctttcgctgactgctcactactaaaatctgtacgactgacatgctggctacacactgtgctaacttactgatccaccttatgtccttcaacacgctctgacgctctctctcactcctctctgaccctccacacacactgtctcacgacgcgcgcacgcgcccgcctcctaacacctacaaccaactcaagcgacacagcgatctgccccacagcctacttctcacactaccctaaggctctaccccattcccacctacattcttacggctacgcctcattctccggtcaactgcgtcctgcctcacaaccccttcaaccatcgccattcgggttgcttggcatctgccccttctcacgcacactacttccacgcacactctctcccctctcacccccattacccaccacgaccacacctacccttccaacacactacatctacactttcaccgaaaacaaaacacccacccccatcaccccaccccaaacgccccacctcactcctgcaaccctccttcttcctcctcgcaacgccggaagcccacccgcaacgcagccggcaacgcacccacggcaggcgcacacataccacaccctcaccccatataccactccaccaccacaccccttaccaattcgccatctgccaaaccagcacctaaccccttaccaatccactggctcccattcaccccacccccccataacctctcgcacaacaacctggcaccagcggcccacacacaccacacacaaactgcgcagaaaaccacaagggaccactcacacaaactccgcaacacccctcacacaccaccccactccccccaaccaccacacccccaccaccgaccaacatcatacctcaccccaacacaaggccacacacacgcccccagaccaaccccacaaacagccacacatacaccccgcacacacaaccggccacccccccaactaccccgcacaccccacccaaacccaccacccacaccgcggtcacccacagcccacctacccccaacccaccccgacaaccacccacaaacacacaccgcacccacaccacaccgcacccaaacaacaccgcaacaagcgcccccacgcacacacacacaccgccatccgcacccaaccacaccccgcgctcacaacgacagcagacacgcagcgaccacaccacaccagcagcgccgccaccaccacccccccatcaccccaccgccatcgcgccacacagcccctccaccacaccacacacgacagtaccgcccagctagcacccacaacaaccaaacaccaccgccaacaaccaacaacac

SEQ ID NO: 602374 - DNA, 180 bp, Homo sapiens
ggtgcatgcacgtgcgatatgaactcgttttgcactgtgtgtgcatgtggacatgtatactgtgcatgtgtggtatgtgcatacaaatgtgtgtgcatgtgtagctctgcatgtgtgttagcaagctctctgaccagcacagactgggccactaactacgcagcccccactagtgctcca

SEQ ID NO: 602375 - DNA, 156 bp, Homo sapiens
  misc_feature (102)..(102): n is a, c, g, or t
  misc_feature (109)..(109): n is a, c, g, or t
atgcttaaaattacatgagaaaagctcaattctgtattgtgcaggatattctaagcattgcaggacattcatattggtaaaactctgtttgaaatatcttanagttagnacaccaaactctattttacgtataaacacaagaataaccatttccca

SEQ ID NO: 602376 - DNA, 196 bp, Homo sapiens
aagcatttgtgaaagaacatcatgtccaagctaaaacctccgtgcccaagaaagcccaagggaaaggctgtgaagggacgtctcaatctcccaatgtgtgatgctgaaacaagcggcctggagtcgtgggaaggagggaagccttaccaagactcctgcaaaacccttggacctctcacgtggttgccgtatctgg

SEQ ID NO: 602377 - DNA, 216 bp, Homo sapiens
gctcgataaggccaagctgaaccactggtgaaaccctatctactaccgaaaatacaagaactagctgggcgtcgtggcgggcgcctgtatcgccaggtacacagtgaggctgaacgcatgtgaatcggttgagcctggcgagcgggggtggccgcgagctgagatctcctccgatttgcactccagcctgtgtgaaaattagtgttccgcagtctc

SEQ ID NO: 602378 - DNA, 440 bp, Homo sapiens
  misc_feature (13)..(13): n is a, c, g, or t
  misc_feature (94)..(94): n is a, c, g, or t
  misc_feature (120)..(120): n is a, c, g, or t
  misc_feature (152)..(152): n is a, c, g, or t
  misc_feature (158)..(158): n is a, c, g, or t
  misc_feature (172)..(172): n is a, c, g, or t
  misc_feature (174)..(174): n is a, c, g, or t
  misc_feature (261)..(261): n is a, c, g, or t
  misc_feature (263)..(263): n is a, c, g, or t
  misc_feature (318)..(318): n is a, c, g, or t
cggcctgaggagncgactgactgagcagcgcacccggggagcaaggaggcgcggtgaactgagcggcccctgagctgacagatacactgcgcantgggaacggcgagcgagccgacaggngagttgagggggccgcacattgaatcacctcngggccngcctggaattattncncttcctggatgaagatgaaccacagcttaaggaatttgcacctacacaaattgaatgcagttgttaatgacttctgggcagaaattncngagtccgtagacaaaatagaggttttataccgaagatgaaggtttcccggagtcnggcagtttgcagccttagtggcatctaaagtattttatcaccctgggggcttttgaggagtctctgaattatgctcttggacaggggacctcttcaatgtcaatgataactctgaatatgtg

SEQ ID NO: 602379 - DNA, 522 bp, Homo sapiens
ggctgagctacggcccaattctccctcagcttccgctcctccaccctatatatccttctatcacttcccgtcctcacaggcggtccagcttacagcttagttccgtgactagctcttccccacctgcccaacaatttcctcttagagaggtggctagagctgaaggcatagtcagggtacatgtacctttttctctatcagacctctctcagatcagtcagcgtttaggccctttctcatcagaccccactaaatatatacaggaattccaatatctaactctgtcctacaatttaacctggagtgacttaaatgttatcctgatttctaccctctccccagatgaacaggaaagagttttttctctagcccaatctcatgctgataaccgctggcttcaagaaccagacctccaggaaggcattagagcagttccctgagaggatccccaatggaactatcaggcagattccacaggtatagctaggcaagattacatgatttcctgcctagctgaagggc

SEQ ID NO: 602380 - DNA, 335 bp, Homo sapiens
atcttggacggagactctcactaactcactgttgaactgagacattgaggatacgtgagagagagaacctagtggatatctgggaggaaagctttgccagaacagagggagcacacatgttcttaagaagctcaagatcagtatgcttggctagaacatcaggcaggtccgtgctgactggagcaaagatagtaggagctgtcaagtcagagagctggctggggtacatttcacattaggcctcctagaccttctgcttttctctgagtgacatgtgaaaccattgaacagtttgaactagcgaatgatctggttttatatctcataccatgttg

SEQ ID NO: 602381 - DNA, 1252 bp, Homo sapiens
tgagtaagtctggctccgggggctccgatcgcctgcccggacgccgaccggcagccacgggaacgcgcaggcggacactccgtgcgctagccaaaccctttcgcgaactgggtcctcgtcgtgacgcatacgtcgcagggcactgctcgtctccacctcgctcctgccgccgcgtcgcaggcagaatgcttaaggatttgaaagagtgggtggaactaggggtatagcagtggtagcatgaaaggatgagagggatcacagccgtgagaggactgaggaaagcacgggacgcaccggagtcgagcgtgttctgaggaacgttgatcattgtgagcaagttgctagaagtacaaatgactggaagagaattgaggggcattaagcacgtcgtgaactcttggtgcaactatagatgttccgtcatggtttatagtaagactggtaggccttgcactctcagcctctgtcaaaatcgtcacccaaaggctggccataaattcggaagaagagccttgacatgctcaggtgacaaactagaatctttgcgcagcgtctggcacactgttcagcgtgcaaaaaccttccaagcatctcacagcatctaacacttaagctggacacataaactggaaagactatcagcaccgttgagaaccattgtgaacaaacgttagaatgtctgacaacagcctggaacctctttaagctgtgaggttaccaaccgtgaactgactaccgaagagagtgtcttcaaggctcctgcccccagacttacctcacttgcgatggcgtatgaccgaggagcgaccaggaagcaccctgaacctcaccactgcgcgaacgatggcatgaggaggactcggagcaacgaaggagagaccgcaacaagggagaaggatgaggcacgcaaccaacaccgacgcaggggcctggtgaccgcaacacggacgcctggcggaccgcagacacggcagcacagaggcaacaagcaacaaaagcggcaaagcaggacgaaccacacgcaccacagacacaacacagacgaagacaaacaggacaccctccacacagaagacagcacagagagcgaacacaccaacagcggacacaagacgagaacaagaaacgagagcacaagaaccagaaggggacacacaagcaacgaaggcacaacacgaaactggccaccaaccacgacccgcacgacgcgcagaagagagaagagacaacagagcagcaacaagccagcaca

SEQ ID NO: 602382 - DNA, 937 bp, Homo sapiens
tcttgaaaggccacctgtagaacatgcgagcaggaggaccaactctcaggcctcggtattcaggtcataaatatcggtgccaggacgtcgacgtgttgctggaacgttgtcagcacaagagggggtagcccaaatttcgtgtaaccgccgcgatcaatcttgttgggcggtgtttccccccgccaagtgtctggtttctttggaccccagagcggtaaatataattttctggacttcttacaagcaatcgggtaatattgccgtgctgtctaaagaaaatatcctccccggcgccatctgttgtaccaatgctcccggacgccccggccttttcggttccaacgggcagtcccgatactaaccccaagacaatgtttctcgagaacccatagacgaaaaaagcgggtttcacaagcccgtcccgtcttccccaatgggagactatttttttccggcccaaccctgtgagtatattctactagccggggattcccccaaaaacacccatctcgggtagcatgtttacaagtggcaaaccacattatgcgagggcaataagacaacaaaactgtcttcctcgcaaagaggaattatgaaggccattctgtctgacacaaagatacagtaagacaaactctctcaatcaaacaccccccgcttcccatgtgtggaaccacgcaaaagaaacacctcgcgtgtaataatattcagtaatagaaagcactcttctgagaagaatgcaaaaacaacaggaaagagcacaactattcaacaacctttttcttctgcagacgcccccctcatgttagatttccgcaactcgaaacaatattttacaaatcgtggcctccacagaccccaagtttcccaacttgcttccattttccgttgggggcccaaaaaaaacaaggaaaattctttttcgccccacaaaaca

SEQ ID NO: 602383 - DNA, 1013 bp, Homo sapiens
  misc_feature (6)..(6): n is a, c, g, or t
  misc_feature (68)..(68): n is a, c, g, or t
gattcnacgcaggtgatctgcaaggactggagcaatctggctgggaaaactacatcattctgaacatnacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtgtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagtgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcc

SEQ ID NO: 602384 - DNA, 1079 bp, Homo sapiens
  misc_feature (6)..(6): n is a, c, g, or t
  misc_feature (68)..(68): n is a, c, g, or t
  misc_feature (1014)..(1015): n is a, c, g, or t
  misc_feature (1018)..(1018): n is a, c, g, or t
gattcnacgcaggtgatctgcaaggactggagcaatctggctgggaaaactacatcattctgaacatnacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtgtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagtgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggccnngcnaaaaaacaatacagcacagctcacacgcaatcagaaccaacaacgaacatacaaaaacggg

SEQ ID NO: 602385 - DNA, 1096 bp, Homo sapiens
  misc_feature (6)..(6): n is a, c, g, or t
  misc_feature (68)..(68): n is a, c, g, or t
gattcnacgcaggtgatctgcaaggactggagcaatctggctgggaaaactacatcattctgaacatnacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtgtgcccactcaagatgtcctttccatgctgggtgacatccgcaggagcctggaggagccctaatgcaacctaccccaggaggaaccatggcaccccaggacctcagtctgaggaaacctggcccctcccaccgcttagagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagtgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcc

SEQ ID NO: 602386 - DNA, 153 bp, Homo sapiens
tagtcgtgggcaccgattattaggggaactagtcagattgccaaagcctccgattatgatcgggtattactagtgaagaagattattacaaatgcatgggctgcgacgataacgcttgtagatgtggtccttaccctgaagattgtcggctgg

SEQ ID NO: 602387 - DNA, 107 bp, Homo sapiens
tagaggatccccaaccatgtcgaacggactgatccaatatttgtgacgaacattagaggtgcgaagttgtccgtgaagagtgtgttggatcagtccgttcgcacttt

SEQ ID NO: 602388 - DNA, 191 bp, Homo sapiens
gacagcatcctaaccagcagaggtgcagtacagtgtcttgtcccagcagaaaagtgtcttcaggacagccctctaaagcacagtgagccaatgggtgttgacagaggggcagcctttgcacccccatggactcctataggcttaatacgtggtcctgactggacagaggctggagccatggacgttgaatc

SEQ ID NO: 602389 - DNA, 595 bp, Homo sapiens
gccgaaaccggccacccccgagggcctaacttcgcctctctcgtccttatcgcctcataccttccgtaaacccgcgcgcgcgcgcgcgctaagtccggtgcaactacggctacagtcgcccttcgcgcgaaaccgccacttgtctataaccttatataatacatgagttggaagtacaaagcgcaaagttcggggcgttcaacgagcgagtcaatctataccaaccgtgccgtgtctatcgtttgtcccttagctgggaaattcgctgcgttagtcgtaccaacgaactggttaatgtgtggggagaggtggcccgtgcaccgggtgtctccttgtccatctgtctatcgatctgtcgtgtctggctgcctggtcgtggtgagtggcactagtctatctaaaggtggcaacatcgccacttatagaactatgggacaatgtaggaaagaatacgcgagtaaaaggttagtcaaaggttatgaattgcaaaaaggttgtgccgtcggtgcccccctacaggtcttgttttttcgatgagtactataaaaactgatgtctaaactagaggcggtgaaattttgtaggatcaccaaga

SEQ ID NO: 602390 - DNA, 1854 bp, Homo sapiens
  misc_feature (555)..(555): n is a, c, g, or t
  misc_feature (1470)..(1470): n is a, c, g, or t
gcgtaggacatgaaagctccccgaggtgaatgatgccgtgcattactggcactccagcgtgcgtgtaacccacccgaagttaggaggaggacggatcaatgcccaagaggttcgcaaggtgcgtctagcgtccacacatctctgacttgctgtctaccacttcattcctgtcggagccaaaggacatacatgcaacccgtcacgtgacggtagcgagtggattgaagatcttgtcgctctatcaagcattcatcctgctcgcattcacctacgtgttgctctctctgttcgcttgtctcagatgatagacttagtactcgtgcagcctgtcccagaagtgaggttaactgatttgtgcacaccatgtgggccttgggttcccgttcatacacacgtagaacacgtattacgcactcgggggtgctgtatcacagttctttgggggtcttgccacccgatgtgtgccggcgatggtacattgcctgcatggcgttatcctcttcatcttttcttaccaagactgatgggggaaacgatgccaagagctgagagttnccgcggggagagggtggttagagacacaggtacccctgaatgtcatcaagaacgtgaagcgctgccttttatgagcgtaagggacaacacacgtccgcttcgagcagagattccctacaaataaacttttccctaggggaagaaagggcttattgaatacccgacacaaagattcggtaaaggcccccatggccctggatactcaatcttagtgaaattggagatgttatctgatgacatttgttgaagttagtaatatgagaggggagaggccaaagacggtaaagcgactcacatgcaaacgaaagcttaggattttcaaagtggaggcagtttgtgtaaggggaaagacaggtctgttatggccccattgtgaaacaaaggatgaaattctggtccatggacaccaccccccgtttccaaggaacttgggtttgccccttgacaaaggacatggcattgcacacacacttacacattcccgttagacaatggagatagcttacatacccagccggagaaaagcaatcctaaagaaaaggtgggggccacaggttaatgtacagaccgacgggcttcgaccccaacagggggtccatggtacccagggttcaaaatgccaaatgggggcgcattacagtggaacatactttttgcaacacacaagagagggtggcaccctaaagagttttaaaacatacaccccttggggtcaccagagggtaagcaaagacaaaggagacacgggcgaacccatttcttggtgtccccaatatatgattgctctcttcaaaaggcgcgggggacactgtgtggaaagagtccccatatgacctgggaaggaaggagataacccgcctaaagagagaggccaataatgacgtcgcacgtatagcagaacacacttggtagaanattgtactgaaaacagaaaacctgacaatttaatcccatggaataaaaagtaggtggagaggcaacacgagaaaacactagcacgggagaggcctcaccacacaggagtgtaagcaccagaccaccaagcgagaaaacgaagaggcgacacagaacacacgacagaaaaaccacaaggagcagacgacacacaagcgagcctgcctaccaaacagacggactgcacacagaggttctaaaacagacaagaagagcagaggcacaacccagagactgagccagaaagacagaacacaaaccagagagcacgacgaagacagacaaccacgaaccagtcaccagcttcagcagtcacaacgacagcacgacatgaagagcacatag

SEQ ID NO: 602391 - DNA, 156 bp, Homo sapiens
aggatagtatcacagacccgggaggtgtagttacctttggtgcatagagactgttgaaattcttctgggtggtctccttggtgaagcggcaggagacgagggctggtatgatgtccggaccccacctttgggatgtcaggtacatggaagtatctc

SEQ ID NO: 602392 - DNA, 875 bp, Homo sapiens
  misc_feature (1)..(1): n is a, c, g, or t
  misc_feature (3)..(4): n is a, c, g, or t
  misc_feature (11)..(12): n is a, c, g, or t
  misc_feature (18)..(18): n is a, c, g, or t
  misc_feature (32)..(32): n is a, c, g, or t
  misc_feature (38)..(39): n is a, c, g, or t
  misc_feature (69)..(69): n is a, c, g, or t
  misc_feature (80)..(80): n is a, c, g, or t
  misc_feature (82)..(82): n is a, c, g, or t
  misc_feature (89)..(89): n is a, c, g, or t
  misc_feature (91)..(91): n is a, c, g, or t
  misc_feature (103)..(103): n is a, c, g, or t
  misc_feature (122)..(122): n is a, c, g, or t
  misc_feature (161)..(161): n is a, c, g, or t
  misc_feature (165)..(165): n is a, c, g, or t
  misc_feature (175)..(175): n is a, c, g, or t
  misc_feature (177)..(177): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (198)..(199): n is a, c, g, or t
  misc_feature (204)..(204): n is a, c, g, or t
  misc_feature (213)..(213): n is a, c, g, or t
  misc_feature (220)..(220): n is a, c, g, or t
  misc_feature (234)..(235): n is a, c, g, or t
  misc_feature (255)..(255): n is a, c, g, or t
  misc_feature (259)..(260): n is a, c, g, or t
  misc_feature (270)..(270): n is a, c, g, or t
  misc_feature (277)..(277): n is a, c, g, or t
  misc_feature (280)..(280): n is a, c, g, or t
  misc_feature (286)..(287): n is a, c, g, or t
  misc_feature (289)..(289): n is a, c, g, or t
  misc_feature (297)..(297): n is a, c, g, or t
  misc_feature (306)..(306): n is a, c, g, or t
  misc_feature (308)..(308): n is a, c, g, or t
  misc_feature (355)..(355): n is a, c, g, or t
  misc_feature (369)..(369): n is a, c, g, or t
  misc_feature (380)..(380): n is a, c, g, or t
  misc_feature (384)..(384): n is a, c, g, or t
  misc_feature (391)..(391): n is a, c, g, or t
  misc_feature (393)..(394): n is a, c, g, or t
  misc_feature (403)..(403): n is a, c, g, or t
  misc_feature (419)..(419): n is a, c, g, or t
  misc_feature (421)..(421): n is a, c, g, or t
  misc_feature (437)..(437): n is a, c, g, or t
  misc_feature (451)..(451): n is a, c, g, or t
  misc_feature (458)..(459): n is a, c, g, or t
  misc_feature (461)..(461): n is a, c, g, or t
  misc_feature (482)..(482): n is a, c, g, or t
  misc_feature (501)..(501): n is a, c, g, or t
  misc_feature (549)..(549): n is a, c, g, or t
  misc_feature (678)..(678): n is a, c, g, or t
  misc_feature (701)..(701): n is a, c, g, or t
  misc_feature (765)..(765): n is a, c, g, or t
  misc_feature (857)..(857): n is a, c, g, or t
nannaaaaacnnaaaaangaacggccaaactnaaaacnnaaaggcaaaaaaaaaaaagggccaaaaaangggggggaaangnactgtcnantgttcgagggantaaaccaaaaaaaaaaccnaaaaacaaacatgtgtgtagcccgaaaaaaaaaaaaaangacnatttcatgtnangactncntnttggcttccccnncaaangcattcccngtgccantctgtacaaaggannaaccaaaaccaaggccaaanaaannaccacaaaanttggcancancaaaannancctcaaanaacatttcncncattttgaaaaaggccattcccgtaagcaatgaatcaaaacccgccngaagttgtggtccnatccgttccancccnaactgtncnnccacccccngtaatccacctttgananttttgcagcccttcangaggtacttcacancaaaaannanaggaaaaaacaatcgaagganctcaaaaaagtaaagtccntcttcaggcaagtaaaagttggttaggattttgattaagtagccaaantcgtaaccggtatgaaatgacaaccatttgaccccttcacagaggaccactccagaagttataagaagttctgcaaagtactgggtttcaattccttcctcctcatgttttttaaactggataccagangttgttagtagctctatagagtnctgggcatacatgtcctccgtcaaattaaatttaaaattaaactgccaagttgaagttcctggngggtattctccttgctcattcataaatgtcagttctagctgaattatctttaacaagtctacattacaccgcaatagttggtattgatagtnagcattgctcctgaattc

SEQ ID NO: 602393 - DNA, 347 bp, Homo sapiens
tttaagtgttaattgggaggtgagggtaggagatcaagaaaagaagtgtcaggatgtaattcagtgggtttatggtagatgtctcaccttggaagttatagctgctacctttgtctatcttgtattcgggtgagaaagccattgaatggaggagtgaaagagaattttagattgctcagatccgggagcaaggccaagggggaccaagggccttgcagggtaacttgaggacagagactcacctgatcggctctgcctgcacgtttctgcagtgatgacgcgtccgcaccctcaataattgctttccagttgaggaaaggagtgttctgtttgaaatcctcccagag

SEQ ID NO: 602394 - DNA, 121 bp, Homo sapiens
gccggcaccttatgactacagcgagacctgatgtcttgttgcagtgatgatgccaagggcagcttttctctgatgttctcagaagatcccatctttgggttctagattgataatgtgatag

SEQ ID NO: 602395 - DNA, 335 bp, Homo sapiens
gccgcgtcgaccttgaataaattttaagaattagaaatcctgtaggctgggcacagtggctcacgcctgtatttccagcgcttagggaagctggggcaggtggttcacatgaggtcggtcgggagttcgagaccagcctgaccaacatggaggaaccctatctctactaaaaatacaaaattacccgggtgtggtggtgcatgcctgtttcccagctactggggaggctgaggcaggagaatcccctgaacccgggaggcagaggtcgccagccatgaaccgagattgcaccattgcactccagcctgggcatcaagagcgaaactccgtctcca

SEQ ID NO: 602396 - DNA, 136 bp, Homo sapiens
ctttaggcaggacactgcctctcctcctagtttacgcctctagtcacctgactttaatagctccactccacccagggcatcctgttcaccatatcgagtcccttgtcagtccctgggggcctctcacgtcctggcc

SEQ ID NO: 602397 - DNA, 549 bp, Homo sapiens
  misc_feature (120)..(120): n is a, c, g, or t
  misc_feature (255)..(255): n is a, c, g, or t
  misc_feature (279)..(279): n is a, c, g, or t
  misc_feature (291)..(291): n is a, c, g, or t
  misc_feature (293)..(293): n is a, c, g, or t
  misc_feature (336)..(336): n is a, c, g, or t
  misc_feature (341)..(341): n is a, c, g, or t
  misc_feature (349)..(349): n is a, c, g, or t
  misc_feature (361)..(361): n is a, c, g, or t
  misc_feature (369)..(369): n is a, c, g, or t
  misc_feature (407)..(407): n is a, c, g, or t
  misc_feature (453)..(453): n is a, c, g, or t
  misc_feature (486)..(486): n is a, c, g, or t
ggaaggtcagcagccccgacagccgacagtcacagcagctctgacaagagcgttcctggagcccagctcctctccacagaggacaagcaggcagcagagaccatgggccccccctcagcngctccccgtggagggcacaggccctggcaggggctcctgatcacagcctcacttttaaccttctggcacccgcccaccactgtccagttcactatgaagccctgccgtccagtgctgcagagggaaagatgttcntctactggctgcaatatttcaganactattcaagcnantatggcacaagggaaaaggcagaaggagccctctcatgctggntatanaacagacntcaagcaaatancccagggncgcatacagtggtcgagagacagtataccccaatggantcctgctgttccatcacctggaggacgcaggatctacacctacganccataatgccagttacgatctgaccagcaactnggcagctccagtacacccgtcccaggctttctgtggggcgtcgtggcatgtgtgggtctggtg

SEQ ID NO: 602398 - DNA, 1488 bp, Homo sapiens
  misc_feature (45)..(45): n is a, c, g, or t
gtcgtcgtctgttgctcttctgtacgtgtcatgtatctctttacngtggtggtccatctctatcgatctggtcgtcgtgttgtatctaagccgactatacatgtgttgtttcgtcgcagatcatccttgtaggtaccgtcggggggcgccccctcccctccgctctacagacatctcgggttttgttcctctcacacgccttgttgtcccccgcagtggtgtggggccttgcttacccccaacagggacggcggcgttcccccgcctcgttgtttgttgagggggcccgctggtccctcatgttgagcacactttgttgatagattcgctcctcgtgccacttagtttctcccgcgctgccctagtacccccctactacaggggtgtgtggaaatactactacctccccccttctcatggggcccattttttggtggcccacacgggggcttgggactcccttttacagcaccaatcttttttttgggcttccaagagagggtattattaccccgccggggttggaccctcgtggtcctggcacctccctctatggcgcccaacccttgggggaacgtttggcgccacaggggggaaatgtgtgatccctcggggagttttaccttctcccccctgggtaggaaggggttccagccccggatttgtcacgcccctttggtcaggaaccccccgaggtttgggacccccacctctctaaccacggtcacaactaacacaacgtgggtccacccttgatcccgcctcgccccgagagggtttcccccatgttccgcacctcagtgcaggaacccccggtcccgggttttctccccgccgaggggtaacacttgtaaggcttgcctgttgcacactattgcccgcccacttatgtagccctctccgcctccacaaccccttctgggctggtagaccccccccctcgcggttttttctaacccccacggggaggtcccccccgttacacaactattccagccgcttctaagtgcccccggttggccccacccaagacccttctctccccgtttatagatctcggttaccgggcctttcaatccacccgttatcccccccgcttttacaccccaccgggtttacccgtggtccatccgctgacgtaccactgcaccaagcccagagcgcctttaatggcccctacgctggcaccacttatttccatgcccttctggccagagtgtgccagcttagaccaggctgtaaccggccaggcccgaggactccccccgggggtgtgccctccatctgccagcctcccgggtagtgattcgaggaccccctgcctccagaatcctggggtgccctgttaagccatgaggattccctggaaagtaagcttcgtgggacccggaaattctctctgaattcttagaatggtgcttagtgcctaatgcgccattccaattaaatagctgatgaatgaataaattaatgccccccggaaattta

SEQ ID NO: 602399 - DNA, 405 bp, Homo sapiens
agcattaggggaggtgaggctgcagctgagccgtgactcgccactgcactcagtgcgtgagcaacagagtagatcctgtctccaaaatagacgttgatttaaaaagtgaaaataaggtccctgccacctccttctttgtgcacaggcttataccagtcagttcatctctctggtgatgtttggtttgatgatgtctgaagaccgaatttcactacaaaagaggaggcaagagatcatccgtggcttgagatctttagctggtatgttctagaattcagctttccagtgttttcagatctagtggactgttgctggccattctctgttgactctcacctgtacaggatgttgttcatttcttcttcctcctaaaacttcctagcttccccaactccctcctggagg

SEQ ID NO: 602400 - DNA, 103 bp, Homo sapiens
  misc_feature (2)..(2): n is a, c, g, or t
tncccttggacaaaaagcaaaggaactttgataagatcctggcagaatggaaacagaagtgtgaagaaactcatgctgaacttgaagcttctcaaaaggaatc

SEQ ID NO: 602401 - DNA, 197 bp, Homo sapiens
  misc_feature (62)..(62): n is a, c, g, or t
tctctccacacggatatatctgacatattaaagggtaaggacctaagtgtgaatgatcaggntgttccaggagtggaagtggttatccgttgtgcaaacagggttatgctctcaaggctagaactgttggtgtgctttgtattttcactttcattttttgcagctggacctcagagtcaatcccagggtggagagag

SEQ ID NO: 602402 - DNA, 359 bp, Homo sapiens
  misc_feature (37)..(37): n is a, c, g, or t
  misc_feature (94)..(94): n is a, c, g, or t
  misc_feature (243)..(243): n is a, c, g, or t
  misc_feature (268)..(268): n is a, c, g, or t
  misc_feature (311)..(311): n is a, c, g, or t
  misc_feature (314)..(314): n is a, c, g, or t
  misc_feature (318)..(318): n is a, c, g, or t
  misc_feature (326)..(326): n is a, c, g, or t
  misc_feature (329)..(329): n is a, c, g, or t
  misc_feature (342)..(342): n is a, c, g, or t
ttgctggcaatggcggagcaagccgtcaagcacccgngaaacgcagccagatgttcctgtgggtggccgccgaagagcaaggcctgcttgggcnagcgcccctacgtcgccaagccgctgtggccgatcgcgaagaccgccgccaacctgaacctggacagcctgaactgggtgggcctggtgaaggacgtcagcgtgccgggcagcgagcgcaccgaactgggcgtgatgcggcagccaacncccaggcgatgggtttgaccgtcgncagccaagcctgacctggctggcggctacttccgcagcgaccnacnttcnagttcgcncanacggcgtgccggngttctcggtgggcgcgg

SEQ ID NO: 602403 - DNA, 162 bp, Homo sapiens
catggatttgctggtgcagtacaactaggcttaatagggacatggtggctcacgcctgtaatcctagcactttgggaggccgaagtgggtggatcacctgaggtcaggagttcaagaccagcctgaccaacacagtgaaaccccgtctctactaaaaaaaaa

SEQ ID NO: 602404 - DNA, 426 bp, Homo sapiens
ctggctctgtacttaggacttcgcagctccagactacgcgataaattcctattgtttataagccactcagtcaatggcatcttgtctatcaacctgcagggactaagataactatgatccatttctgatacttattttaatgcaaaattggttttcctaaacatgtgggagggaacaagaagtcagatcttttccagagctcccaagtcagttgttttcatgaaacattaaaaaacatggccgattgcaaagacctttgcttcgctccccacatgtatctgaactcctctttccattgctactcctgcggctgttctgggcaattcagagtctcatttcagcagcttctcccagcactggggctggagctagaggagagcttggctgatgccttgcctaagttcagagccagggggtaccgagctc

SEQ ID NO: 602405 - DNA, 283 bp, Homo sapiens
tctagctcggtacccaccaatattttatgaaattctgtagttacaaacactcaactgcaacatggcatatctccttttctgaacgactacgacctgactgagaaaaccatttccaaaggtacagactgcaccaaacaagggaagatttatattcgattttaaagtagcaaactacctataaacctcaaacttccaaagccactaaatgaatcatattggttcaactttggcaatacctacattatactcacaaaacacacacacacacacacacacacacaca

SEQ ID NO: 602406 - DNA, 392 bp, Homo sapiens
cggcacgaggggagagtgtatttctaataagcatttaccaaattttcagcatctcttgattgatggggctattctatattctttcaatggtaacaaacttaacactttcaggtctttttagccaatgtgcctgaagctactttcttcagtgcttgacctctcagagctagatgtttatatacactgcagcccacctactgttactccctggctgtgagtcctgccgtcgaagtcaggccttttacatagacagagggtaccaaggctgtgtgttgcgatcttattgcaaaccgtgcattaaaggttttgaaacgtggtatgtcctatggcagatttgctaaggattgtttagacaactctttacatgccagagagatggcaagaagtctaaa

SEQ ID NO: 602407 - DNA, 257 bp, Homo sapiens
  misc_feature (7)..(8): n is a, c, g, or t
  misc_feature (40)..(41): n is a, c, g, or t
ggttccnncagcgagacatcaggtctggggggcccatgtnncctccagactggaagggaccactgggagcggtgcgaggaggtgagggacgaagggcagggccggcctagggctacgtacataacctaaacctactccaatgctaaaactaatcgtcccaacaattatattagtataactgttattagttttatccctatgcgtcatttgtatcacaagatccatctgccgtctacttactattctgacttggatca

SEQ ID NO: 602408 - DNA, 284 bp, Homo sapiens
gtccgtctagcttctcaggaggctgaggcaggagaatcacttgaaccaggaggcagaggttgcagtaagccgagatcgtaccactgcactccagcctgggcaacaagagcgaaactccgtctcaaaaaaaaaaaaaaaaaaaaaaaaaaaaaaaaaaattattttcctttgaaaaggggcccttttttttttcttagttgagggaccctttttttagaacttttaaccttttaattcagttttattttttttaaaaaatttaaggctgaggcccattcgtttgg

SEQ ID NO: 602409 - DNA, 165 bp, Homo sapiens
  misc_feature (155)..(155): n is a, c, g, or t
gcagctgctgcgccccggaacaaagacgggaagggcaaagtgtgtcctgattcgtgtgccaccgctcacttcttcgcccacctccaggagtttctaatcctcctcgggcttgcctggagggtagggcagaaaaggaacggcaggaaacgcagaanggatccggaa

SEQ ID NO: 602410 - DNA, 432 bp, Homo sapiens
ggcccgaaccaaggggtgaagaatttacaacagcaggcattttctcttcctcctctgtcaagggaagccgggcagaggactgctcggagtcgcttcgtcaaacactgccttgaggcctcgctgtgtgagcgccgagcactccaggtattttacaagaaccatctccttagccatggctagaccctgcggataggtgatgggagtcagggtcttctccttcagtttctcgatcgtgtctttatcatccctaagatcaagtttagttcccactaagatgatgggagtgttgggaccagtggtgccgcacctcaggataccactttgcacggaccttttccaactgatgcaggactcacaagggaaaagcaaattaagaacacatctttttgcggataggataaggggcgtaaactgtcataatcttcttgtcca

SEQ ID NO: 602411 - DNA, 298 bp, Homo sapiens
  misc_feature (73)..(73): n is a, c, g, or t
cccccagatccagctcggtacctcctgcgctgtgttggccacttggggctatgagcgaactggcaggaatacnctacgcaggacaggaactaactttttcagagcaagtgccacactattctttttctctttgccaagtctgggctccttctaagatgctgctagctattcctagcccgttccccaatacttctctgcccccaccttttggaatccttatctaggtctaaaaacggttctagatcctgacccctttgattgggggatgtagaatgggattcttttcaggggacatcca

SEQ ID NO: 602412 - DNA, 345 bp, Homo sapiens
ccgtgactgtgcatatactggtggctcagattcccctgatctctgcactctgcgactccaagtcgaactgctttcgcacaggtcctctggaatctcctggaggctgccccctcagcattccccaaatgaaaagcaccccgtccaaaccctttccctcttcctgggccaccctctcagtgactaccaccgcctccatctgccagaaacccaggacgctgccttctcctctccccttgagtcgggttcaccaagtcccatagctcgggccggccgtcctctctcctgacagatcagctgcctcctcactcatctcctgcctttgcctggccccactcccccttctct

SEQ ID NO: 602413 - DNA, 301 bp, Homo sapiens
ggcaacacaggaggactcgagccagtacaccctgacagccttccggacttctctcttggcaaccagtgcccccgctgtcttgaaccttctgcaacgagcggctggaggacacccattttgttccagtcccgtccgccctttcgcacaagttctgcttcccttgctccagacaagcgcatcacacagcaggggcgctagtagagaggtctattgcccagtggggaaaaatgccctcttgtgggctccaatgtcccctgggcctatatgcaaggggaaattacaccatccttgctggagatgt

SEQ ID NO: 602414 - DNA, 372 bp, Homo sapiens
gtgtgtcgatagttgcacaagagtagggcaggatatttagggaaatgatacattagcagtctttatgccgagattctatatttagtcatggcagatggagcctaccatgaagataatgatgaataagcctcagaatgctgactaatcctcaactatatgaaagcatttgaagtcggctaatcataatatcacgctttagtgggaaatacagcaacgatgtattggatcagggctcaatgaagattctcatatatgatcgtatttggatgattgaagtccatggtttgatcatgaacatatgtgcttcattagatcatccaaccaatgcataggatgcattgacccagaacctgacttaatggctttggacat

SEQ ID NO: 602415 - DNA, 595 bp, Homo sapiens
ttcagatcaaatacatataccagctgtttgggtgaggcagagttagataaattcttcttctgtaattcaccatatgaatatgtgataaagcaaactatacatggatgtggctattttaagaaggacaagatagggcgcacacgtagtcgtaccatcacccttctgtttaccactgtcaccacatttccatattccctagttcagcaaaactgacaaaggggagtgaaggaggcaggccaggatattgcaacacaacacagctttgctttctacacaccaaagtgtcccaacacatgggttaagcaagagcaatctgtatcatcggaagttcctaaggttcacgattgacagcgatccagtcccaggtaagccctcttctctctgaccgttaccagggggcccgggagaatgcaaagaaaaggagactgtgggcaccctgcacccagagcatttgcacctcaaggaaacttcaccagccgatatcaaatagcgaacactgcctgtcatacttccatagctagggaaaggaattttcccttttgcagcttcctggctgccaaccaggaggctacccctttcattaaactgaaatgag

SEQ ID NO: 602416 - DNA, 199 bp, Homo sapiens
  misc_feature (64)..(64): n is a, c, g, or t
caatataataaaccaccaatgcaatagtacattttaacacaggttcaacattccatgttcatgntgcaattttcaccgtccaacacaacatcaaatcaacatcccaaaaacaaaagttcatttcaggcaggtcagcagtcgcatggcatggccaacatggtgcatggcatggggtggtgggcgcgcatcaaatcagggg

SEQ ID NO: 602417 - DNA, 329 bp, Homo sapiens
tgggtagcagcattatctaacggacatcctatatatgcacacagatatattacaggtaggtacgtagcttacagaaaagtcatggcaggactaaagcctaagtcctatacagttatcctccatctgaaggtaggtgagttcatccacttcatagtaatgctgtaataccaagacatttatagcagatggacccaaaaagaatttactgctatagtgtacactacaacaggatagggacatcagacagacccagaaaccccttccagatctgatatgggactattaattaatatgctgtaaataggtattcatacacaatgcagtaaaag

SEQ ID NO: 602418 - DNA, 320 bp, Homo sapiens
agaaaactagggacaccgtccagtcagcaaaatcgatcatctgagtcctatataatcttgaattgccttaaagctttcctcataggcgagaaaattctagatggtttctttccttaaaaagctccatggtatactcagcagaaagcaccacccatctgttcagctaacaaatacataccctgtggcaatgacttccaccatgtggaaaaatatgtgcagcaaagcccattggtcataggagcaaatgcaatgtgagttttcagttccagggcccagatcctgaggagtctggatggggagagagaacatctggatattag

SEQ ID NO: 602419 - DNA, 151 bp, Homo sapiens
aaaaggacacacttgcaattttctacttttgacatgacagaccctcctcttagttcacacatgttcaaaggcacagtcctcgtttcggaacgcaggagagcatgactttcccaagagctacacggttcatactgaggatgatatgagaatt

SEQ ID NO: 602420 - DNA, 363 bp, Homo sapiens
tggggttcctggatttgttttgccagtattttattgagaatttttgcatcaatagttcatcacggtatattaggtactaagaatatctacctttataggattagtgctctctagccagcgcttaggtatcaggatgatgctttgcctcataatatgagttaggtaggattccctacttttatctattgattggcatattttcacaaggaatgatactagtcttcctcctatgatcttctggtttgaacttggctgtgacttcatctggtcctggacttatttttggttggtccgctattaattactgcctctttttcagaatcctgttattggtgttttctggcattccacttcttcctggtt

SEQ ID NO: 602421 - DNA, 362 bp, Homo sapiens
ggaagtccaggatgcagtgagccatgatcaacccactgtactccagcctgggtgacagagtgagaccttgtctcaaaaaatataaatttttttggccaggtgtggtggctcgtgcctgtaatcccagcactttgggaagcagaggcaggtggatcatttgagtccaggagttgaagaccagcctgggcaaaacagacccgtttctaccaaaaaaaacaaccaaaaatgggcctggtgtggtagtgcacacctgtagtcccagctgctccagaggctacggtggaaggacaatctgagcctggggacattgaggatgcagtgagccaagatcaagccagcgcactccagcctggacgatggaa

SEQ ID NO: 602422 - DNA, 343 bp, Homo sapiens
ttccagtgggtgaatggataaataaactgtgtaacaatgcagtgttattcagcactaaaaaaaaacgagctagcagaccacgaagagaaagggggagctttaaatgcatattagtaagtgagaggagcccatctgaaaaggctgcacactgcacgattccaactacaggacattctgaaaaaagcaaaactatggagaaagtaaaatgatcggtggttgccaggggttggggagagggagcgtgttcgagaggaacttaccacaatgatgttttcatgctcctgggtggtcaagtttgtgttctaaaggattgaatggagacagcaggaggaaaacaaaacaa

SEQ ID NO: 602423 - DNA, 137 bp, Homo sapiens
tgaacattcgtgtcccttttgatcgtggtgatttagtagggtgaactcactggaacggggatgcttgcgtgtgtaatcttactaatgagctaatagaaaggccaggatcaaagcctatggacactgaatgttcagga

SEQ ID NO: 602424 - DNA, 480 bp, Homo sapiens
acaaatacagcgcccccaagtagctgggactgcaggcatgacactattctggcttttagtggagacagggtttcgcatattgcaggctagtctcaaactcctgggctcaagcattctacccgccttggcctcccagagtgctaggattacaggcatgagtcatcgcgcccagaagagcttattctaaaattgaacttctttgccctctaagtactgtcatgccatgggtggagaaatttaggagagttctggaaatccctccctagggaattcaaatgtgtcagaacatctcccaagtgtgccggcaatttcagtgcgttctgagtaattggtacacaagaagctgttgttacggctcatcttgattcaaatattaagccaggaggcttacaagtaaactcagaacagtgagatagatgatacggcagagattccaggaactgctgagtcaggagagcgttttcaagacatctggcccca

SEQ ID NO: 602425 - DNA, 545 bp, Homo sapiens
cacagtggctcacgcctgtaatcccagcactttgggaggccgaggcaggcagatcatgaggtcaggagatcgagaccatcctggccagcatggtgaaaccctgtctctaccaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaaaaattttatgtaaaagcaattcagaagttttaaatttaggggacccaaattaaacctataacctcatagcggtttataagaactcagaaataatacttcattcaacctttacttatgagggccacacattatttcgccggttggtcctatactctaggttcgggaaaacttatccttacatagtcggtctaatatgcctaaatattgacacaaggtgggtctaaggtaattctggaaaggactct

SEQ ID NO: 602426 - DNA, 760 bp, Homo sapiens
  misc_feature (1)..(1): n is a, c, g, or t
  misc_feature (210)..(210): n is a, c, g, or t
  misc_feature (403)..(403): n is a, c, g, or t
  misc_feature (533)..(533): n is a, c, g, or t
  misc_feature (676)..(676): n is a, c, g, or t
  misc_feature (691)..(691): n is a, c, g, or t
  misc_feature (700)..(700): n is a, c, g, or t
  misc_feature (755)..(755): n is a, c, g, or t
ncgccgcggggggggccccggggcccgagtaggcgccgccgccgccccagccgagggggctgggccggagcgtgcggaggagtgaggccgcaggagacccccccgacgacccccgccccggcggggaagtgagcaaggatgattgaggaaagtgggaacaagcggaagaccatggcagagaagaggcagctgttcatagaaatgcgtgcncagaattttgatgtcatacgaccatcaacctacagaacagcccgcaaatcacgatttgtacaaaaacgatgcaacccccaccccgtcgatatccggaacatgattgaagccctccgagacaatggccttaatacactggaccacaccaccgagaccagtgtgtcccgccccgaaaccgtcaccccccccaccnaccaccagttgaacaagcgcctcccccccacccaccaaatcagtgtggaacaatccaccagccccccccccaaccccacgattgccgcatatgacagtgagggccgaggcaagttgacggtattttcagntaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacanctgtctttgaagggncatcttttngttacacagagcactcagtccgcacctgttttccacagcagagaaagataatgcnaaata

SEQ ID NO: 602427 - DNA, 178 bp, Homo sapiens
tgctgcttctcctccggggtggagggagttggcgggagcagtttttgaatgactgcagtttggggttggtgaggagagggaggttcttcagtggcctagctatttcctcgagccttcctctactgaagctttgtggaaattgacacctattttactcactgttagttgtttaccacag

SEQ ID NO: 602428 - DNA, 321 bp, Homo sapiens
tgccactgatcgatgaaaatctccataacatgtaatttcttcctcgggatcaggggcatggcttataatcccagccaggggttggaactggttccagtgtcaacggccaggtgctcggcttcaagggggaactagcctttggtgaatttttggtacataagtattggtaacaaatatttaagcaaatgctttctatttctctggctggtgcgtatctgggcgggcgtaacaaaaaaatagtgtaaacattatttccttaccggggaatgagggttttttctttttctttttttcttttttttttaaaacaaagcggggggg

SEQ ID NO: 602429 - DNA, 95 bp, Homo sapiens
cctagaaccaagcgacctcgactcttgacgtgacaattgagtagtacttccgattgaagccccattcgtattattattacatacaagacgtcttg

SEQ ID NO: 602430 - DNA, 285 bp, Homo sapiens
ataggtatgtctcacagcgtgtcaattcaagcagactcttcttagcaaggttcaggcattagcatcagcttctgacacttgcttcaatcattgtgtacatgtaaacttccaattctgcaatagggtgttctatctccgccttaggattcaagagatccgtgtacagacagcatatggttagcagagtagtgcttcagatgccatgtgcactcacatgcacccgtgtattcagtcgctgcagcatccccttgttggcccagggtagtcaatcagctgtcatgctag

SEQ ID NO: 602431 - DNA, 182 bp, Homo sapiens
tgatccagtagatttcagaggctcattgatctgcctgcaagtgatggctgcactgcaggcttaccttatgtcccttgaatggtagcagcccattcgctgcaggtgcaaacactttgctgaccagcacagtgctgcgcttggctttacatgcaatacatgttccaagtgccgcaggattccat

SEQ ID NO: 602432 - DNA, 579 bp, Homo sapiens
gcccaatgtacagacttctggaggactgtggcttgagtgcatagcacgagttcagtcctgagcagcaggcggccattcaggagctccttgacactctgcgtgaagggccttaatgtcacccaccagaaaatacgctccaaataaaggcttaccctttccttaaggtcctttgtagggttggagcaacaagagatcggcagtgtggtgtgtcaggccattcttctggagagccacaagcaggaagagcagcgcttgtgctgcagaatggcagttcccatggatttctaccagaccacttgaagggagtccctgggaagcccttgcggtaagtagcattgaagcactatttcctcaatggtttaaccggcccaccctgacgggcgacacgtggcaccctcacacttaactttcctcgggtgaacccattacggaacattttaccgggacaaacccacgctttcagcagcaccagctttccccaggataccattgtggtgctccccccaaaagtgggctctgcttccaggtgctccatggtcacctgggcagagtgcagtctccgcgcagggtcaaccgcag

SEQ ID NO: 602433 - DNA, 83 bp, Homo sapiens
  misc_feature (46)..(46): n is a, c, g, or t
  misc_feature (66)..(66): n is a, c, g, or t
tactcctgctgcttggctgtactgtgggaccctcccctgctgcatnttagtataaggccataggcnagtcacttaacctctgg

SEQ ID NO: 602434 - DNA, 148 bp, Homo sapiens
agctattgcgtgaaggagtaggctgatggtttcgataataactagtatggggataacgggtgtaggtgtgccttgtggttagaagtgggctagggcatttttagtcttagagcgaaagcctacaatcactgcgcccgctcataagggg

SEQ ID NO: 602435 - DNA, 908 bp, Homo sapiens
  misc_feature (183)..(183): n is a, c, g, or t
  misc_feature (274)..(274): n is a, c, g, or t
ggtggagactcgagcctggggtcggcggagacagctggtgtctgaagccgctcgcgcccagggtgaccctgtttgcagcacgatgtctgaagaagaggcggctcagatccccagatccagtgtgtgggagcaggaccagcaggtgagggctgcccctcccatggagcagggacagaaggtatngtgtgggacagtcccttctaggagcgtttcaggccaggtatcccgccccactcctctccttgctgggaaaacctgagtcataaaatatttnggtccatggaggggatggtctatttcctagtgggggcttaatgaggccctgggaggggagtgtctctcaaagacacccagctggcttctgtggcccctacccaaccctttccctctcctttgatccctgggtctccacctgtatccttctgtctccacgtccaccatcatggcgccctcagtaacaacaatagtaagagcagcaatcactgtatcagtcacagttccaaccgtttcatgtatattggctccttgaacacccatcacaaccctagtaacccatttcatagatggggaaaccaaaggcaccgaacagttcagtggcttgcccaagttcacacaatttgcaggcagctgaaccagaagtgaacagaggccactgtggctccaggggcaggggctctgaagcccccagactctaacatttcttcctcgaggcagacagatcggcagtggacccttcaacaacatgggtttgaactgacaggtcaggctgggtgcaggggtcagacgcctgtaatcccagcaatttgggaggccaggcgggcagatcactgaggtccgggttcgagaaccaactggctaattggtgaaccctggttttactaaaattccagaattacccggttggtgga

SEQ ID NO: 602436 - DNA, 312 bp, Homo sapiens
  misc_feature (306)..(306): n is a, c, g, or t
ccctcgggaactggtgccctcctaaccccccacctgcatctggggcccatacctggttggctcccgcggtgccattgtctgcagtgtgccccccagccccggtggctgggcagagctgcatcaatccttgcaggtgggggttgctgtgtaagttagtttttgatacagtgttcgggtgtgggttctacagccttgtccccctccccctcaaccccacccaatattgaagttgtacagaatattttctattgaagttcggaactgtccttgtccttggctttattgcacatttaaacagattgtganatatta

SEQ ID NO: 602437 - DNA, 374 bp, Homo sapiens
  misc_feature (360)..(360): n is a, c, g, or t
gcgcggaatccagtggcgcaccgaccgttggcgactcgacgatattcagcagcatcgacttggcgcgcacccagcgttgatcacgagcttcctgcggtgcggtcatgctgttgaccaagatcccacgaacggcgtccatggcggtgagcgtgatgttgcgaatgactcgcagctcttcgtcggtctgactcaccgattgacccagcgtcgagaactgctgcatcacaataaattcgaactggtccatctgagccgatagttcaggatcggttcgcgcggcaatccatagctccatggtgggcgatgaacatcgaccctgggtgcattcgccagagtgcattccagacaacggctgacgantgggtttccatttt

SEQ ID NO: 602438 - DNA, 206 bp, Homo sapiens
gcttctgcttctgcctgaatggtggagtgatggtggctatgatgtgtgggtgatgatgaggctattgttttttgtgaattcttcgataatggtccatttggtcaaaaagccggttagcgggggcaggcctcctatggagaggagggtggatggaattaatggtgttagtcatgttagcttgtttcaggtgcgacatagtaacacgg

SEQ ID NO: 602439 - DNA, 770 bp, Homo sapiens
ccactacggaggaggaccgggccgcagaggccccggagcgctcgtgctactttttcatgggccggtcccattgctccgggcgtctcaggggcttgcagttgttgctgtctctgctggccttcatctgtgaagaagtggtatcacaattgtacttaatgtggaggacttatattttttggagttgtgtaagctgcagtcgctttcttctgagtctccttatactgatgtgtgtatggactccattttatgagagagttgataccacaaaagtaaaatcatcggatttaatattacttgtgggaacaggatgtgtgtcggtgggcatccatcatttggtttccacacatgacaggattcagctgagattgctgcaatgtgtgtgggatttatagcaagttttatgttcctacttgatttatcactatgctgtatgaaaaacgacaggagtcccagtttgagaaaacctgaaaataccattaggggtgaagcctcatgagccattaatgctaaagactctgggggagcagatgttacctaaggtagtgaccctgcatttgtggtgctgaagcctggaagaagtcttgtaaaattgtgtgaattgttaaacacttctttgggagagccagggaaggtcaagaaggcagttatccaatatggtgtcagtcacaaaagtagggcagataggttaaaaagattttttcaatatattgcactttttcaatgggattgggggggagggaacacttgttttgaaacacaggcaacgggaa

SEQ ID NO: 602440 - DNA, 419 bp, Homo sapiens
  misc_feature (286)..(286): n is a, c, g, or t
atacacagtgggcctaggactggtgagtagtttcagcatcagaatgaggaggaagagaagaggctggagaggaaggtgagcctgtgttggaggctctgggaggccacgcgtgcctctgggatggcttccataagcaaaagggagccactgatgctcctgggcaggagactaagctccggaaagcagggcccatcttttgccatcaccattgcactcccagtgcctggcacatggtggcaattaaccatctcagaacgaaaggacaaactcacttagcatctaaacntccactgcccaggtctgttggagaaaggtctcatgagtgggtgctgcttctcccacagcaccacatgcccctggacagcaggagccgccgtccctcaaaagagcctcaacaaccctcaatccgcagcctcgtg

SEQ ID NO: 602441 - DNA, 896 bp, Homo sapiens
gcgcaagcgcatggccaagtccgtatgtgccatgtctgcggggtccacctcaacaggctgcattcctgcctctactgtgtcttcttcgggtgtcgcacaaagaacttcatattcccgacgcatgcgataggcgaagacgcgacaacgctggccgagtgatctgatgtatggaggcgatctacgtgttgactgtgcctagggactacttctatgacatagacatggaactaatcgccaaggaggaccaccgaacacagcttggacaaatgccaggcggttgggagagaagttttcacacgttgggaacgcaactcaagaacggggagcttgaactagctgaagcacaacccgaaaaggagaccgatcacctcagaactggcaccataggtctgcagtggtgctgatcaacacttgggaacacgatgcttcatgaactgcagtcgttgcatggccctgtaaccccgacagcgctcaatttctgcgtgagacttcttcctgtctgacaggctacctgctgtgagattagcgagagcccgcagactcctgtcgtggtctgtgagatgtcctcactgtttcacggagttttactctggacacctggtccccggctctacattccgtatatagtagctggacctggtgttggacctcacgtcgaggcacctagcaaggtctacgagcgagcagagaagcccacgagttccgtcatcgcggtcctggacgtggtccaccgacagtgtcaggttgatgcccatggggaagcaggcaagaaggccgatcaatgggttggatcatagaccagattttcaggcgggttggaagcaagaaggttacctgccaagtttgcaggggtttccccacaagcgcccttttggacccgttggttcccgggctcc

SEQ ID NO: 602442 - DNA, 796 bp, Homo sapiens
gatacactggggagatagcatataaaaatgatgctccaaaatgagaattctatatggggctttccctaagaagaatccatcccagcacatattttgaaaaggtggtgaaattaaaaagtacaagagtttgctcattataaatcaagttagccaccaggaagaatcctgaaggtgatgctatacatttgtctcatatatttatgaatacgtgatcgtcttgagagagagactacggcattgcccgggcacttgcagatgccttagtgaagtgcccctttgagtattggaagtgtggatatatttataataagcaacatggattgttattccaaatctcatcattggatttagtaactcgaagccgccagaagaagtaggccagctttgaaatagctagttcgtggaatttgaacagaacgcttgatggaatgcagttgcatgtgtgagggacgagaaagaaaagaggttgcttgcagaacctcatggaggaataatgagaattgtggtagctaggttgactttcatgtgtcttgggaggttgagggtgtacaagatacgttaaggcactcggcaaaatgcaaagcttcctttgttgaaatgccaattgtacatctacattaattcatctattgcaaaagttgtgttgtcatggttgtatattacactatatttctcattaggttctgtaaacatcaggtgttaatatcgatatttatgaattgattttttaaaccaaagtatcctaataagttgggtgctgtgttttcctggatgggtttgaccaaggtcaaacatc

SEQ ID NO: 602443 - DNA, 199 bp, Homo sapiens
agcagagtgcgtccatatgttgtacctaggaagattgtagtggtgcgggtgtatattatcataatgtttgtgtcttcggctatgacgaataggaggcgaggaggtggcatattcgatgttgaagcctgagactagttcggactccccttcggcaaggtcgaagggggttcggttggtctctgctagtgtggagataaat

SEQ ID NO: 602444 - DNA, 126 bp, Homo sapiens
ggaaagaataacattggagataaagcaatagaaatgaacaatagagaaaaaataaactggaaaatgaacagagcctcaagagcctggtgaacattaacaaaagatttaacatttagtcatcagagt

SEQ ID NO: 602445 - DNA, 225 bp, Homo sapiens
ggctaggacataaaaaatcctcaataaaattaagaaatacagaagctgggcgcggtggctcatgcctgtaatcccagcacttcggtaggccgaggccagtagatcatgaggtcaggagtttgagaccagcctggccaccttgatgaaaccccatctctactaaaaatacaaaaaattagccaggcgcggtggtgggcacctgtaatcccagttacttgggaggat

SEQ ID NO: 602446 - DNA, 335 bp, Homo sapiens
tagtctctagggcgcgtgctatcatgtatctgtgtccgtgtgtgtgtgtgtagcctgtctaggtagtatctagtgtgtccatgtgtgtacctgtcagtgtatctagtgtcctgcatgtgtccgtgtatagcatagtcttgtggcgtgtgcttgcaatgtgtgccttagtgtactgcatttctgtgcatctggatagggtatatagtgtgtagtgcctgtgtctagatgtctgtagcgtccgtgggtctgcctgtgcgtgtactctctgcgggtccacacagacacgagggacatctccaaacaggtggacaaaggctgggcacaccattatggag

SEQ ID NO: 602447 - DNA, 898 bp, Homo sapiens
  misc_feature (213)..(213): n is a, c, g, or t
  misc_feature (218)..(218): n is a, c, g, or t
  misc_feature (290)..(290): n is a, c, g, or t
  misc_feature (305)..(305): n is a, c, g, or t
  misc_feature (316)..(316): n is a, c, g, or t
  misc_feature (330)..(330): n is a, c, g, or t
  misc_feature (333)..(333): n is a, c, g, or t
  misc_feature (342)..(342): n is a, c, g, or t
  misc_feature (358)..(358): n is a, c, g, or t
  misc_feature (382)..(382): n is a, c, g, or t
  misc_feature (385)..(385): n is a, c, g, or t
  misc_feature (389)..(390): n is a, c, g, or t
  misc_feature (413)..(413): n is a, c, g, or t
  misc_feature (450)..(450): n is a, c, g, or t
  misc_feature (483)..(483): n is a, c, g, or t
  misc_feature (493)..(494): n is a, c, g, or t
  misc_feature (531)..(531): n is a, c, g, or t
  misc_feature (582)..(582): n is a, c, g, or t
  misc_feature (588)..(588): n is a, c, g, or t
  misc_feature (608)..(608): n is a, c, g, or t
  misc_feature (610)..(611): n is a, c, g, or t
  misc_feature (634)..(634): n is a, c, g, or t
  misc_feature (645)..(646): n is a, c, g, or t
  misc_feature (654)..(655): n is a, c, g, or t
  misc_feature (660)..(660): n is a, c, g, or t
ccgagatgatcccgttgcctgctcgaagctctttgttgtactgtgccagagaaactttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgtngtttngttgcccacatcctgttttcacccctgagctgtttctctttttcttttctttcttttttttttttttttaanagggattctcactcnggggcccaggntggagcgcaggggngcngatctcgantcatgggaacccccgnctccggggttcaagcgattctccngcnccannctcccaagtagctggggaggacnggtgtgagctggccgcacccagccggtttctcttttnccactcttctttttctcatctctttctggggtngccggtcggnnttcttatctggccggtttggcaagcaccttctccggngtcctggggagccctgagattctttctctccttgctccacccacctccaanggtgcngagtcacatccaaacccctngnnagcgtccatgccaaagcccccanggggccccatnngccaaagnnatgcntgccaccctcgcttgtgccttagtcagggtgtacgtgtgtgtgtgtcgtagataaccagagaagcaggaagggacgcaaacggggaattgggacctctttctccaaggggagaacagggtgcagctgtctcccccttttaaattaaaacacctttttttcttctcaaacacaaaaaaaacaacaaacacaaacacaaaacaacaaaaaataaaaaacaaacaaaaaagggggggcaaa

SEQ ID NO: 602448 - DNA, 170 bp, Homo sapiens
  misc_feature (38)..(38): n is a, c, g, or t
  misc_feature (69)..(69): n is a, c, g, or t
  misc_feature (105)..(105): n is a, c, g, or t
  misc_feature (124)..(124): n is a, c, g, or t
  misc_feature (134)..(134): n is a, c, g, or t
  misc_feature (144)..(144): n is a, c, g, or t
  misc_feature (165)..(165): n is a, c, g, or t
attgggtgggggttttcaggggtgggggcagtagtttntccttcacccccaccctggtgtcctctcctnaaggacagacggtcacattccaaaatgggtgttttnttctaccgtgtttgttcantgtaggaggntatgtttatntcatcaggcagctcactaatnttgac

SEQ ID NO: 602449 - DNA, 264 bp, Homo sapiens
gaccagtgcagagcgtgaattcagtaagccaagttgtctagcaagcactgtcccccgactttgagtgagcggtgcttatagtgagtgtctgggcattccacattcaggattacggctgtgcacctaatagtatgtctaacagtatgctaagtgatggcaagtgtgagatgagtataagcttcgcacgtgatcatgtccattgagagcatagaccccagcaaactatgattaagaaggcacatatcactcgatactaggtctcat

SEQ ID NO: 602450 - DNA, 287 bp, Homo sapiens
  misc_feature (1)..(1): n is a, c, g, or t
  misc_feature (47)..(47): n is a, c, g, or t
nggtcgggggaccaaaaacaaaacttctgtttgtggaatacccagtnggaattcggatggctctgaggatttcgttggaagcgggattacatataacatctagagagaagcattctcaggaacttctttgtgatgtttgcattgaagtcacagaattgaacattcactttgatagagcaggtttgaaacactcattctgtagtatctggaagtggacattttaagcgctttcaggcctatggtgagaaaggaaatatcttcgaataaaaactagacagaagcatcct

SEQ ID NO: 602451 - DNA, 853 bp, Homo sapiens
agctgccgcggcctcggccccggcgactccgccccagccccccttccctccgcgggcagcggtcgctccctccccagaacagctgaaggtctcagtcacctccgaggggagcgcagggggaggggaggggcgggggacgcggcggaggggacggtgggggagcctggacgctgcgtgcccggggacgcggcccggtggctggtgggaacaggggcgtccatccatgcgcgccccccatccccaagcgtcccaccgtcccggcggcggcggggaaagtctctccgaaagcgtgaagggggattggcggaggtttatactttccctttgtgcgggtgcgctggggccggactcgagtgctggtgtggggccgcgggattgggggctccccgtctgagcgcgagcaggaggcggcgacaaaggatgcgtcccgccgggggtcacagtctccgtggcccaactttgcggcgcggcgccctgcgcccctggggagccgcccggatgcaggctaagaacccaggcgtccgcggcctggggagaggggccgcgagcggtccgcaggtggcgcaggccccggagtctcccgaccccaggagagagaatccggacatccatggaaagaaagcgagaaggcagagtacggacaaagggaaccggcctagccccgggaaacacacggagacacgagaaacccacgccaaaaccacatgaccgggggtcggagccctagaagacccccatcacagaggggcacaggaggaagagggacataccaccacgacagttcacaacacaaactcataaaacaacaaacgagacgagagaaaaacacaggagaaagacactaaaaagaaag

SEQ ID NO: 602452 - DNA, 687 bp, Homo sapiens
ttttttttttaaaaggaaaacccggtaatgatgtcggggttgagggataggaggaaaaggggggataggtgtttagaccatgagggtgtttcctcgggtgaatgaggtgttaaatgtgggtaaatggtgggtggggtgaggtgagccccattgggtgtgtgtggggtaaatattgatagaagggagttattagggcgtggtgactagtatagtgtgtgagctccgtgtgtaagatagagagagtgtgattattgtgattcagggcaaaagtggtggtttactaagcacagaagaagtttctccacagtatgaggtgtataaatagtgtgtgggggtataaagggcgacggtttagcgcgaaggccctgagacatagaaagttcattcaaaagagcctatttaggtgggaagttaaagtttgttgaagttcctgggagaagaaggatatagttgaatggcacaccgtggtgaaggtggcgcttcgcgtaaagaatgtgagagagattgcgacatacggacagaaatatagcctaacgtagacggatttgttaaagcctccgggggagaccgaatatattagacaaaattgtaccgtgggcgcccgggtgaaaagcatccagggggggttctggggaataaaaaaagggggcgtgggaaacatcgcaagggactatattggggtctgat

SEQ ID NO: 602453 - DNA, 133 bp, Homo sapiens
  misc_feature (1)..(1): n is a, c, g, or t
ngtgtggaggagtgtggagaggagtcagtttaggagtctgggctgatgaagtgatgagtctgctcttgagaatggcggtctgacggtcgaaatgagaggaacgaggtgaagactcgtgtgaagaataggattg

SEQ ID NO: 602454 - DNA, 1455 bp, Homo sapiens
  misc_feature (282)..(282): n is a, c, g, or t
  misc_feature (591)..(591): n is a, c, g, or t
  misc_feature (1164)..(1164): n is a, c, g, or t
  misc_feature (1249)..(1249): n is a, c, g, or t
gtggttgtggggtgtgggggaggatggtgggtagggtggggtgtctgtgagtgttgggggttttggtgtgtgtggggtgtgtgtggggtggcacggtcgcgtgggtacgggggggtgggtggagcggcgccgcgtaccagcaggtttaggtgaacagatgttgcgccccctttgtaggtgggtgtgtcccgcaggtacccgccacatgtgccggggaattgtttttaagggggtggcaacacccaccatgtagttgtatgggaaccgcttgcttcgaagagngggggggctcctcccccccaccaagagggtggtgtttggtcgaacaacacaagaaatagaagcgcacctgggccgcctttgtgtttgtaataaaaagccggagccccggcgcgcacacagggtgtgacctctttatgatatccaccccgggtgcctctcttaataaaaggggtgtatgagcccacgagaggcgcccacttcgtggtgtttgtgccccagaaattttttcgggccacacaacgacagagtgtggggagacaccccctcgccacggctccccgccacagagagaaatggtgtagagatgcncctcttcatatagagaggagatcccgccgcagagttttgcgcccaccatgtgtgatgtgagacactcccccctctgtgtgtaaaaggagagaggggagagttacacactgggttggcccccacacagagatagagagattgtttcacacacacatggccttatatgtcacctccgcggaggtctttgtggcacagacacacacagagaatgtgtgcccccacacccgctgtcacagtgtgtcacagtgagaaggccccacatgccacgctgtctgtctcccacaattgtcctcgcagaggggctacacgctggagaagagagaccacagctttgcgcctctggagagacacactcttgtctgaactggggtgacacctctgatccccacactgtgagagggatgatatcccacgtggagttgctctccgctcgagatttacacgctctacaattctcggcccctctgcgagagagatttgttgacctcgcacacacctctatgacgccgcgctaagcccgctctccacagaagagatctcggccacaggacctccggcgctctataaagtgtntctcgagagagggttgagagcagacacctcggcgagagaactcacccaagaagggggaaagcctcgacacacagagagaatatcnctcaccacgaccgcgagagtgcctgtgcacaccctcggtggccgcacaccacagagaaagccgcaaggtctggggtctgggtcacaccacaccccgaaatttcccagatttagaaggcggatttggtcctggacgtggtccagacccccctccagtataaattggagaggattctttttgcccttgaataaaccttaccaccccca

SEQ ID NO: 602455 - DNA, 104 bp, Homo sapiens
gtccgatgatctgaagcacgggaatttattggacgggctttgagacagctcatgtatggaaagctcttaagaactaggtttagaaggtgagagaccaggcaact

SEQ ID NO: 602456 - DNA, 175 bp, Homo sapiens
aaacccccaattttttggggggaaaaaaaatcccccggggttgggtaggacccggggttgtttttttcgtttttcccccccccaaaaaagatttttccccctgggggaaagcccatgggggttgttttaaattcagggggtttttttcccccccccccccccttttaaaaccggg

SEQ ID NO: 602457 - DNA, 1212 bp, Homo sapiens
  misc_feature (1138)..(1138): n is a, c, g, or t
gacatctctttccattgccataacgcagccatggcatcgtggtcccaagaagcatctgaagcgggtggcagatccaaagcataggatgctggatacattgaccggatgtgtttgctcctcgatccatccaccggtccccacaagttgagagagtgatcaccaccctcatcattttcctgaggaacagacgttaagatatgccctgcacaggagatgaacgtaaagaagatttgcatgcagcggaaacattacaaatcagaaggcaaggatccgaacagatacataaccataccctggcgtgggatacacgggatgtcaatcaagacatagacacagacgggagcaacaattgccagctctgaatccatgacgcaaccaaggggagatcagcaaaggcatgctacaatacgaacatcaccacacaatgaggcaggcccaagaaccaacgacgaagcacacagatggagcacacagagtcatcaaggtgagagccaacaacaaaggacaatccacaatcgagaaatgagatgaccatccaaagaaatgcacacgcaaaccaaacacaggcaaaaaccacagaatacaacctacaatcaacggggaacaatgactaaccaaaaccagacaatgcacaaccaagaaaacactgggcacagaaaataacaggatagaccaccacagcaaacgatcaccggacacccacggggcaaacgcccatggtgagtaactgaagtgcaactggggacaggagctgaacacaaccacaacaagggcaacagaacacagtggccatggttagacaaaccacccacaccaagacagaagcaagggcaaacacctgtgaacatcacaataaggaacagagatggcgtaccacaggatgaacacaacatcgagccacacggggacaaaaaacagacgagatggcgcaaccagaccggaaaggaagtcacaaacacaaaaaaacgacgaaaaaatagtgcaacggatgggggacagccaaagaacccgtagggacattcaccacgaaacacctgcagaaagagcacaacggagtgaaacactcaggacaaagaacatccccaataggcgcgatagacaagcacaaagcaaacaaagacaacacgatgagacgcgntccaaacacgaaacgagctaaggagaggtgtacaacaggggtccccactgagattgcacagttactcaaacttt

SEQ ID NO: 602458 - DNA, 332 bp, Homo sapiens
gtctgcgaattcagctcgtatggacaggcacctattggtcagctccttctctaacaacagccaatgctgtcccatcaccaaagccggtctgactggacccacatgggagcacttagacgatgtggggtccgtcgccctgatgtagcgagtaacagctcctaaagatgagcgttgctctatcccactactacccgtgcatgacccataccacaggataatgagtatcgctgatacccttcatctgagagatgtgaagtgttcaagcatcatacaggacatgatgcggcccgaggctacttggtagccacccatgatcctccaccacggtccct

SEQ ID NO: 602459 - DNA, 407 bp, Homo sapiens
cctagaccttacctctgacagagcctactccgttgacagggatccagacactgaaccctggatatatcacacatcatggctcttgaacactcaacactcatcacactatctcaccagcaatggatccaaatacagaagaaactgatgattgatccgctgaagaatctaagtgtcaagttactaagctaatgacggagtgaccagactaaggcaaaggccaacgcatggatgttcagtccataatgatactggaagagaacggagaaatcttcaaggatatatatcgcataggattatacactcacagcttctggcatcgtacacgctgacagaacgcagaatgctcaggaacgtctcaggagtctaattgaccataactagcgatacttagagctcacagcttggtc

SEQ ID NO: 602460 - DNA, 467 bp, Homo sapiens
  misc_feature (450)..(450): n is a, c, g, or t
aacgcgctgatagcctcctagcctcccaaaatgctgggattacaggcgtgacccactgcaaccagcctgtagttttatttttaagtagtcattagaacacagggattttacataatgtgcttcaaacctcctcagtatctttattaatgcttcagtgttaataagaactctcacactttttgcttaggcagtctttgctattgcatcggttactgtttttaggaaacagaactaggtaaccaggccgggcgcagtggctcaagcctgtaatcccagcactttgggaggcagaggcgggcggatcacaaggtcaggagatcaagaccatcctggctaacacggtgaaaccctgtctctactaaaaatacaaaaaattagctgggcgtggtggcgggcgcctgtagtaccagctactctggaggctgatgcaggagaatagcttgaacctgngaggctatcagcgcgtt

SEQ ID NO: 602461 - DNA, 480 bp, Homo sapiens
  misc_feature (253)..(253): n is a, c, g, or t
ggctcgagtcggtgcgcagaccgtgcgccgatatgtcagtgtaccgctgagtatccacgtaggacgcagccgggcagtgaccaggttcgaccgtcggcagattccgggtacaatgggggcataggagcgagcagcctcgcgctcgacgctactcagaggcaacctctgtccttgatcccctagtgtgaagatgcagagagatactgcttgactataagataggcttgacttcggctagtaggatcggacgtcncttgggcatgcccagtgttgctgcgagttggttgaacgccggggggtcgttgtgagtagggtggcctggtatcgtttggcataaaacgtgtgccgcataataacccctaagaacctgtgccattagagcgtctcaaaggggatagtcggaagactttaggttgaaacttgaagaaggccgtttcatggagccggcatgggggaattagcacccattgatttccagta

SEQ ID NO: 602462 - DNA, 170 bp, Homo sapiens
cagaaaaatcacttggacccgggaggcagaggttgcagtgagccgagatcacagcactgcactccagcctgggcgacagagtgaaactcggtctcaaaaaacaaaaacataaacaaaacaaaacaaaaacttctagtccaaccacctaatcatacagacaaagggaaaca

SEQ ID NO: 602463 - DNA, 642 bp, Homo sapiens
gaattcggtacgaggacaaccttagctatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcaatgtttagaggacaacaaattgccactgtaaactgaaagttagttaactgtgatttatgacttcgagatagtcttttaataagtgatacactttacaatgtaaagaaccatacttgataaatcaaatcgtgaagggactgctaaaatgtaatgcagggttttcttttttctttgatcacatattttcccattttaaagccgtagtatcccgtattaaagagctcatttttaaagacttttaaatttttggaacatacccatgttgaaaggttgacttgcttttaaccgctattgctttcct

SEQ ID NO: 602464 - DNA, 192 bp, Homo sapiens
atgacacttgaaaaaaaattacacaatccctaaattgatcccaaatcatgagagggacatgaagcattatagaaccatgtcactgtattccaagcaaaaagttattccattttaagtctcctgtacatttctgtttgcttctgtaacatgccaaaagaagtggtgagggatagcagaatgtgtggggacttg

SEQ ID NO: 602465 - DNA, 286 bp, Homo sapiens
atagaaggatgtgtgtacctgagaatgtataattgagactcagaagaagtgggacccaaaggtagctggccacagtgaggactacctgggcagtggcaaaccattgaaggatttcacgcagaggattcgatgagctttggcctgagttttaagacagtcgttcattgagaatagactatagaggttgaaaggctaaagtcagagaccccaaatccgtgggtttagcagatagttgtggcagtcaggatgataggcaggagtaagatgtctcaatagggcagggtac

SEQ ID NO: 602466 - DNA, 907 bp, Homo sapiens
attgccccttgctgctgccatgcaatatctttctcccgagggcacacaaccccttgtggtgggcacaaggggtgacatatattgcgcgtgcccagttattttccggaggcccattttttccggtcccgagtcccactgtgcctgggggaaccaagccatggtataaagctctcttccatggtagcgtcccctcttggtccgtctacacgccctggtcaccgagtttactcttccggtccccgggcaaaacttaacatgggcggattttgtgcccatgtcttagagcatgccggagaccgcagtgttgtgtcgcccgcaccttcttttctgtacccccaagaataaacctttgtggaaaacccagggaccacaatttccacaaattactgtttgcccgaaccccctattttgtactccacatttcacaacatcccacacagatattttcccacaaaatttgaaatcctgccccacttcgtataatatactctatgccaatagtgccccccccaactggggcccaccgccatcttgcttggctttacaccccccccttcagtcccacacacaccttgtggaaagcacactacagtgccacacgacagaccaacgacggccaccacgacgacatgagcacccccccctcgggccaaacacacgcgggcgaaaccccccccgttgcggccaaaaaacatacccccgcccacctttttagccgcggcgctcgtggcacggcgccccgtagtacccacgagactccacaggaggcccgcgaggccaaggaccactatggggtggacactatagcgaagggtcgcgagcggtgatcccgcgagtgcccgagaaccaatgcccagtcaccgccacccctcagggccacaaaaaccagaacccgcctcccataaca

SEQ ID NO: 602467 - DNA, 156 bp, Homo sapiens
gcagccctgctaccatcaatgaaacagatacatgtggtccgtggagatgatgatgaacttcagtctgatgacattggagatgatgatgaagatattgatgacatctaacttgaactcaacattttacattccatcctttctgaagccgtgccctgt

SEQ ID NO: 602468 - DNA, 219 bp, Homo sapiens
aaaaaagggggccctttttgtcccctataggggagaattccccccaaaattttgggggaatgagagaccttttcccggcctggggggggggttttttttggcccatattgggggggggggggcccccttttttttttatttccttttgggaaaaatttaaaaggggttttttgttggggtttgaaaatttttggggaaaaattttttttttggtccata

SEQ ID NO: 602469 - DNA, 945 bp, Homo sapiens
gggcgacatctcaggatggctgacagaaagggctggtccccggctgcgtggggctgggtcgttagaagcgctcgtgcgcgcctgctgcaaagtgacgctgacgagcgtgctgtgtcggtacttttgaaacgctgggccgggtcggtgctgtatggagcccgctgtgtgtttgcttgtccgcgggagtgcatgcagctgtggtcttagtgtgtgtccctgcgccactggcgctgctcgcatctcccggggagccgggaatcgaccctggcgcctgtgatgcgcccgaacttgcgtggctctgagtgcttcgtcatttcgggcatcaccaggggtttatatcgagcgtgtctggtatatccagtctgaagaccttaacctcgaagtagctcaagtacggactcatcgcttgcttggaaactagcgtgatcttgtgcagctcgtaattataccctaatcttggtgtggtccggagcacgggtgtaaaaaaactgtgggtacaatgaccatggttgttcatggtacagtaaacttgtgtgtagctatgcatcgagaaatattggaataagtcgggtgagggtcctgtgatgaagagagcccagtttacggatatttgcgtcgttgacatacgaccttggtatgatgacagtgctccatgggatgcggtctcagaatggtttgcccggagtgagatcccggtgccggggtccgagcgattcaaagctacgggggacttcgctgaccgtgccggaagtttcgtgtcctttggctgggggttaataccgagcctgtttgggtgtcctgaaactgggaggaggctgggcccaggttttacccttctgaggggggacccgggtgtgggatacccctccccagtttaggggggccgagatccgtgagggggcgggggggggaaacagagttgggtggagcggtcgcgacggggct

SEQ ID NO: 602470 - DNA, 256 bp, Homo sapiens
aaaaccgtgtgctattagcatgggtcaaccccaccgtgtttcttcgacatagccgtcgacgcgagcccttgggccgcgtctcctttgagctgtttcagacaaggtcccaaagcagcagaaaattttcgtgctcttgagcacttgaggagaaaggatttgggtataaggggtccctctttaacaggattattccaggggttattttttcaagggtgggacttacacgccaatatgcacttgtggcaagtcactattg

SEQ ID NO: 602471 - DNA, 404 bp, Homo sapiens
  misc_feature (25)..(25): n is a, c, g, or t
  misc_feature (56)..(56): n is a, c, g, or t
  misc_feature (75)..(75): n is a, c, g, or t
  misc_feature (77)..(77): n is a, c, g, or t
  misc_feature (121)..(121): n is a, c, g, or t
  misc_feature (209)..(209): n is a, c, g, or t
  misc_feature (274)..(274): n is a, c, g, or t
  misc_feature (278)..(278): n is a, c, g, or t
  misc_feature (283)..(283): n is a, c, g, or t
  misc_feature (286)..(286): n is a, c, g, or t
  misc_feature (293)..(293): n is a, c, g, or t
  misc_feature (295)..(295): n is a, c, g, or t
  misc_feature (307)..(309): n is a, c, g, or t
  misc_feature (324)..(324): n is a, c, g, or t
gtaacctcctaggaacctggaaccnacccaggaggcaatcattcctgtggggtccncaggcaatgtccttgtccnanaaaactgtcctgtcctagcttggccaggaactagttgtcctcantctttgcctattattttccctagtgagacagtactttgaagagggcagagagaaatccccaaagaggcagcgtccctcattggtgggnccatgtggtccctctctttgggaagagaggtagagtctttcacagcatcagttgtcttaagaatncttngtggncanggtggtncncacctgtaatcnnngcactttgggaggcnagggcaggaggattgcttgagcccgggagttaagagactggcctgggcaatatggtgagaccttgtctctacaaaaaaaa

SEQ ID NO: 602472 - DNA, 258 bp, Homo sapiens
  misc_feature (27)..(27): n is a, c, g, or t
aattttttttcccaaggttttaatttnctgccggggaaattattttcttttaaaccccgggactgctttttggagaagaaggctggctagaggcctctttttttggagcgggtttgggccccccctaggtaacttagccttttggagaatttttccggggttttattttttttggagcccctttggttttttaaatgggatatactttgggccctttttaaaaattggggggtggatgaatcccctgttggggggtta

SEQ ID NO: 602473 - DNA, 427 bp, Homo sapiens
  misc_feature (25)..(25): n is a, c, g, or t
  misc_feature (56)..(56): n is a, c, g, or t
  misc_feature (75)..(75): n is a, c, g, or t
  misc_feature (77)..(77): n is a, c, g, or t
  misc_feature (121)..(121): n is a, c, g, or t
  misc_feature (209)..(209): n is a, c, g, or t
  misc_feature (274)..(274): n is a, c, g, or t
  misc_feature (278)..(278): n is a, c, g, or t
  misc_feature (283)..(283): n is a, c, g, or t
  misc_feature (286)..(286): n is a, c, g, or t
  misc_feature (293)..(293): n is a, c, g, or t
  misc_feature (295)..(295): n is a, c, g, or t
  misc_feature (307)..(309): n is a, c, g, or t
  misc_feature (324)..(324): n is a, c, g, or t
  misc_feature (386)..(386): n is a, c, g, or t
  misc_feature (399)..(399): n is a, c, g, or t
gtaacctcctaggaacctggaaccnacccaggaggcaatcattcctgtggggtccncaggcaatgtccttgtccnanaaaactgtcctgtcctagcttggccaggaactagttgtcctcantctttgcctattattttccctagtgagacagtactttgaagagggcagagagaaatccccaaagaggcagcgtccctcattggtgggnccatgtggtccctctctttgggaagagaggtagagtctttcacagcatcagttgtcttaagaatncttngtggncanggtggtncncacctgtaatcnnngcactttgggaggcnagggtgggcgcatcacctgaggtcaggagttttagaccagcctggccaacaaggcgaaactntctctactaagantacaaaaattagccaggtgtggtggcac

SEQ ID NO: 602474 - DNA, 164 bp, Homo sapiens
gacattgaagcccactatcaggacccttcacttccttaccccaaagaagataacacactttttatatgaaatcacagccctatcttgcaggccagcctggccattcacaacccacttaataagcatatacataacaacaaagcgctttaccctattttccaatt

SEQ ID NO: 602475 - DNA, 115 bp, Homo sapiens
ggtgcagtgcatatatttcgagtctgtacattcgggcgagtagcgtatgtgggcagtgaggggcgcaatgcatctaggctataatatcggagtatacgttagcggtaatgaaaaa

SEQ ID NO: 602476 - DNA, 674 bp, Homo sapiens
  misc_feature (636)..(636): n is a, c, g, or t
  misc_feature (654)..(658): n is a, c, g, or t
ccgggcccaattatttgtattggaatctcagctttactccctaactgttacctttggcaaataacctctctggatatcaggcaggtctggaaaataggaaagataactatctcattaatttgtttagaaagtagttatgttaattatgtttacttaagtacttaatagttcctaacatagtagatgctctaaatattagcttcttttccttcccttccttgaaatcactggtttgcccctcaggggacacttagcaatgactggagacatctttggttgcataactgagggagttaaggatatgttgccaacatctgataggtagaggctacagatgcctctgaacagtctgcaatgcacagagtaatccctcccaacaaagaattattcaacctaaaatgtcaaaagtaccagagttgagaaaccctgcttagatgtacggcatttttatttttcacttaatgatcatttatgggtcttctaaagagaattacaaattacttcaagaaagctattggtcttcagttaatatagccttgaaagttcttggtttgcctttacatttttatttcttctgtatttcagccaaaattgccttggaaaagagcatgtttgcctttaaaatttttgtttttnctgtatttcagccaaaannnnntgtaaaagagcagtgg

SEQ ID NO: 602477 - DNA, 132 bp, Homo sapiens
gaacaactcctacatctaacttatcataaatccccagttattcaaaggcaggtcagatttgagactgtctcacctgccctctcactttggccaaattgaataacctttctctgctcctaagcactgatatgt

SEQ ID NO: 602478 - DNA, 1415 bp, Homo sapiens
  misc_feature (264)..(264): n is a, c, g, or t
  misc_feature (496)..(496): n is a, c, g, or t
  misc_feature (828)..(828): n is a, c, g, or t
gaactgacattaacctgcattggtcgtctagtgttgcttaacgcacttttgctcttaccctgtgtggtgactcctgtgtgtcctctaaggaaccttttcccccatcctctcgtgagcaatgcggacatatcctctcactgatcaggcgctatgaggctaaatgtatggatcagcctgacgtgagagggtcgtcacgcattcgaccgagtcaagcagaaagtgatataataccggatgtaatctgactcttaccacgattctgtntggcactttgagtacgcacgaaacggtcatggctaaggacctgcttagactcttccttagctaccatcgtagcctctggcaagtctacccccagatacaacggagcgtgatatcatgacatggtgtgggatagggatctcgatcgataaggccattggagtgtgtgtgtgctgcatgtgctaggactagcgatgatcttgatcgaggtgtactcgatctgtagtccatctanttatctaggacctcattctttggagctttgtatttttctttgcgtctgttgagaacgcgttaattaaaagcacttggtacaatctcgccaggaatgagttggacatatagatgaactatgaggcaccgcaatggtaaagggagaggaaattacaagtcaagaggcgtagtaaatcgactgtttagtaatttgaaacagttttcttgattacagatatttaagacctatgctaaaaatacgttacctttgtaaatccgtaacacaaggaatgcacacactacgcatgtattgggtgggcgagtatgacacagccgtttacgtattgtgtgtangaatattactagatatacctggggaggaaaagcgagggttctggggggaacgtttgaaggcccatggaagaaagctgttgtaggaagtgcattgcattggaccgtgtgaaagcaggggatattaatgcctctccaacggcaatgttacacacgtaacgattatctctaggggttttgggaaaagcgaaattacactgacgttaggggaaatgggaactgttaagcggaaacaagggaaaggaacaaggaggggtagggggaaagacaaacttttgagccattatattttaacaccacatacaggcgttaatacgggagttttacgacgcgctgagacatttgcggctcgattagtatgtggagcgtgccagtctaaactacacaccggattggttacgagtttcctcgcgaacagcccacattaataaggggcaaatgctgcacccaaatatcgcggcttgagaggcaaacgcggattccaaccgtgattggcgaggccccacccacgtcgtgaatgagtttcccttggagggaaaacccacaggcccgtagcagcgacaaatacgcatcacaagtgtacaaagaag

SEQ ID NO: 602479 - DNA, 806 bp, Homo sapiens
ggcaggcctcaggactgtcatcgcctctgggtgtgagggtactttggccaccgtccccggaaataaccgcgcctgcctctcaagataccccatcctctccacgccgttgccgttgccgccatgcaaggggaggacgccagatacctcaaaaggaacgttaaccggcagggactctagatgtacatccatcagaaaaagcatcattgttcactatgaagtgaagctaccattcttggagaacatgggggaccccatgttgggagaccgacaacgaatgtcaacacaaatcattcgacttaagagtctcaatgccaccacagattataacttccctggcaaggcacggtggttgccacgacatgtaaaactcattcatccttcaaaataacatgaggtaccaacaagctgtggtactatctacagaaccgccgtgattcaatggtcaggcacccgcagaccacacagaaaacttcaagcaagcctaaagatccacctcctttgaaggcaatggagcattgctgaagttgctaaacattaattgacatggttgcaatatatggcagtgattcatattgacagatattcctgaacaaagttcggaggatacttgctatggatcctgcagttggttcggaaatccctggataactttgaacacactacttattcgatggcaactggccatggttgcattagcacgggtccctgaacagcatgatctggcaccacatgttagagttagctacaacctaattaccactttgtggtcccagcttactcaattccagggcgtataatcacataaa

SEQ ID NO: 602480 - DNA, 262 bp, Homo sapiens
tatcgactgccaccccctccagccgtggtcaacggagggagtggcacttctgccttgagtccccaggtaaaaaaaaaaaaaaaaaaagatttttatgaaataaagggtaattggtgtaaattaagctttagggttcccaaaatatgcaattgggtattaatttatccaagggtgtacttggcggtgtccttatttttagagattacctcatacttttaaaggttttttccatttaacggtgggcatcgataaacacggggta

SEQ ID NO: 602481 - DNA, 742 bp, Homo sapiens
  misc_feature (588)..(588): n is a, c, g, or t
gggtacaactctcagtatgatgagccaatggcacagttccagcgcaatctattgaagtccttgagaacagaatggctgtacttaacgacacggtgaaggaggcttaagatcgtctgctgaataccaggaagaaattgagggaacttaagggactgctaccccggaattagagagaatgattgaagatgcgccaaggattctcccgcctagtgggaaatgtaagctgaactggcttctgaaagctactctggtggagaagttctacttcacggtttcactccctggtggaggaggctcttccagtctctccatgattgcccagtagaaaagcccaccagaccggtgcttcctcatccaaattgtgtgactgatatttccccacccttgtccagaaagaagagaggaaacccgaggaagagagtccccggaaagatgatgccaagaaagcccaaccagagccgcgaggtgaacgcgaggcaatggggatgctgtcccccagtggaaatgaaatttcggaaaacacactggaggaaggaggctgagaatcacggctgtaaagccgggcacccacgtggaaggggaccacantggaaggctggaagctaccacgttgaaaagccctgcactgttaaagaagggggcaccacgccctcctcccacagggaaagtgtttttgtatataaagtattttttcacttttggaggattctttttgtataacttccataaagattgtaagcca

SEQ ID NO: 602482 - DNA, 750 bp, Homo sapiens
gggggagggtgggaaagtttggggggggggttgtgaagatttcagggggaccttgatagagaactttataaacttcttcctcttaataaagactggtcttacaaccgtgctgcccattaaaggcacgtgttctagagtttcagtacacctaagtacacccacaaaaactaattatgaatatggagatcttcctttacccctcaactttaattggccccagttatacctcagtgtggtagcacgtagctgtgataccttggacagtgctttgatcttacgatgccctcgtgtactgacctgacggagacctaagagtcccttatccctatactaggagtttagacatcatacgccttgatgtcggtcttctctgtacaatgtccttgtcccctacattgtaaaagtgcttaactgctcactgtggctggtatcgggtagcactcggggactaacggattttaactggggtactcttgaactgggcttttaaaaacttaaaccaattttatacatccctttacacttttattcaacctatacgaaaccatatgcggtggtcatttaccagaacagggcgatcttaagaccctaatttcttggttggagttgagccacctagcttcggcaggttccagattcttcccacagggactacttacgtgtgcataaacttctatctccatgttggtggcctatacgggcacccatgtgaccaaggaacgttgccttgcacacatcactttgccggga

SEQ ID NO: 602483 - DNA, 1549 bp, Homo sapiens
  misc_feature (412)..(412): n is a, c, g, or t
  misc_feature (1020)..(1020): n is a, c, g, or t
  misc_feature (1182)..(1182): n is a, c, g, or t
  misc_feature (1187)..(1187): n is a, c, g, or t
  misc_feature (1190)..(1191): n is a, c, g, or t
  misc_feature (1204)..(1204): n is a, c, g, or t
  misc_feature (1224)..(1225): n is a, c, g, or t
  misc_feature (1250)..(1250): n is a, c, g, or t
  misc_feature (1253)..(1254): n is a, c, g, or t
  misc_feature (1261)..(1262): n is a, c, g, or t
  misc_feature (1281)..(1281): n is a, c, g, or t
  misc_feature (1292)..(1292): n is a, c, g, or t
  misc_feature (1395)..(1395): n is a, c, g, or t
ttgtgagacttaattaagtgcgtcttcgctcgtggaggtatatcgtggttggtgtgttttcgttcgatccagaaacgagcctctcgttttttttagtataaggtgcccactataatccctcgatttgtggttcgctcctctcgttcgtttttttgtttgcctcgtccccccagggggcataacatttttttttgaaacccttccggggaaaaaaaggtttttgttgggtgttgcaatattgtgtcggaaaacataaatgtggtcacaaacactgttttgggaagagagaaggtttcgaccacgttgtccgtggtcgccccctttgtatcctcttggcacagggggtagccgccggttgatccctcttgggtgtatgcctcgcctgccggaccctcgtttgttgccccctttngcgcatagatgggtcccctccccgtttccccccagagtttgggggccctttgggtcttttatattgggggtttcacccaaaacgttgtgcccaagtttatggttattaggaagagccccagagtggggccccacacaatttgtcccaccccacaaaaattcgttatttgggaaatgttcctcaattgtggagtgacacccaggtgaaattgggccgtgtggtttaacttttagacccggagctcccacgggtttgaaaaagggagaggtctcgtataaagggttgtcttggtcctggtcctgggaattatccacacgagagagtgtaaaatatttgtaggggaaaccttataaaaaggggaacacctgggcttatccccccgcgaaaatgtatagataggagagaaagagatttatagatgaagatattcccacacaaggagagtttttctcacagcgcgctgacttttggggaaaatcgttaaagcctgtgagacaactcggggctctcttgagaaaaggctatcactctctgggggttggagaggaagtttttctaactctcccacaggttttttcacactcccctcgtgttgagacagagagcgngctctttcacgttgctccacatgagattgcccacgcgtatgagaatactctctgctactcacgagccgcggtgtgcgtcctcctcacatcacaaaatgtgtgtgtgtgagacgtgagatatattttgccgcacaccgttgtgtcacgaaaagaaagaggganaaccncgnnggaaagaagaggntccccgcgagaaagaatganngcccacagagaaagcccacacccangannccgcgannggtgaaccgcgagggcacnctggggaatgnctgttccccacgtggagaaatgaaatttcggaaaacacactggaggaaggaggctgagaatcacggctgtaaagccgggcacccacgtggaaggggaccacantggaaggctggaagctaccacgttgaaaagccctgcactgttaaagaagggggcaccacgccctcctcccacagggaaagtgtttttgtatataaagtattttttcacttttggaggattctttttgtataacttccataaagattgtaagcca

SEQ ID NO: 602484 - DNA, 429 bp, Homo sapiens
tttttaatggttggatatcactgagttttttctcttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcac

SEQ ID NO: 602485 - DNA, 485 bp, Homo sapiens
ggatcctaggggattcttagcaagaaaaagcttgaattgcaaggcctggaaacaatgtaatatgtaaccaaatggtaacagtaacagctgggaaagagagaaaggctggcttatggcagatgacaccaggatgaatagtgttccatttttatcccctgtgggacactaacattcccaacacgcatactatttagcttatttttagcatatgcagccttgcagggaaaaccgctagagaacattccacgtgtaaactcctcattcagactttctgacagtcagacattgtctagatgagtaacctgttacagaaggagggtttggggtggctgcgctgtgttccttcataggaaccgttgacatgtgtttaggggtgtctgggcactgtgacctcgaggcagtgtccgctgagagtgccagaggatggatggccccttgaagttactccgttttctctgccatccaatgaattgcttgttccgctg

SEQ ID NO: 602486 - DNA, 181 bp, Homo sapiens
tgttgcccctgaatcaacgggattggataccaccgccgagaatattgttagccaccagcaaggccgggtaactccgccgactgatcattcaacgcaaatggcaggatcgccaggtagaaagcattcgccttgtccggcgtttctatcgatttcgactgggattctgccgtcagattcagag

SEQ ID NO: 602487 - DNA, 380 bp, Homo sapiens
gaattccccccccccccccccccccctataaaaactttaagaaatgccaagtttaggcagacgagggctttctttcatacagtggagcaaaaaagattagagagaaggtgggaagggaatggcagttggagattgaaaaggttagattttagattagagaatgttttaccctgaagtcagcatgttcttaggaggggcacagaatgaatttttaagttagctcagattgagggtagctcaaagttcaggagcccacgtaaaattttacttagaccactgaagacaaatttagctgatttttttccccccgggatggagtcttactctgtcgccaggctgaagtgcagtggtgcaatctcggctcactgcaaccggatccg

SEQ ID NO: 602488 - DNA, 232 bp, Homo sapiens
tgcatgatcgctgctactattacatcaactacaccaccattgacgctcttcagtcatgtccctcaagtgccaatgaccaaggtgcgaggtgcttatctgagatcatctccaatgcagccagagtatgctgaacattgcccatccggcaccactgaagagccattctcctgatggcatgttggctcagagaggtcccccacaatgctgaatagccctaagttcataagccagg

SEQ ID NO: 602489 - DNA, 106 bp, Homo sapiens
tcctgcctcagagtcctgagtgctgaaattacaggtgtgggccaccatgcccagccagaagcatcattgaaatataggtgacatactagtaagagatacttgttat

SEQ ID NO: 602490 - DNA, 340 bp, Homo sapiens
cccgtaatgcttatttatttatttttgagacagtctcactctttcacccaggctggagtgcagtggcgcaaatctcggctcaccgcaacctgtacctcccgtgttcaagagattctcctgctgcagcacccggagtggctgggattgcaggcatgcgccaccacacccagctaattttgtatttttagtggaaacagggtttctccatgttggtgaggctggtctcaaactcccaacctcaggtcatccgcccgccttaacctcccaaggtggtgggattacaggtgtgagccactgtgactggccaaaattgtatttcttagcacctgcttttaaaaaa

SEQ ID NO: 602491 - DNA, 989 bp, Homo sapiens
gtcgagacgaacctgggccagtcacgagaggctgtgtaggtaacgatcacatctacaacgttttcgtcagagtccatgcatatgtaataatcttcttcatagtaatacccatcataatcggaggctttggcaactgactagtggcccctaataatcggtgcccccgatatggcgtatccccgcataaacaagataggcttctgagcgtcttacctccactctcgtcctactcctgcttcgtcatctgactattagggggaggccggagcaggaacagggttgaaacaggtctacccgtcccttagggagggaagctacgtcccacccctggaggcgctccgtgaggaccgtaacgcagtcgttctccttgacagccctagtcaggtgtctcctcatatcttaggggccatcaagattcatcaaataccaagttatcagatattaacaagcccctggcatgtaacctgcaagtaaccaataggaccccttcttcgtctgagtccgtcctagtcacagaagtcctaactgtctcctatctctcccaggtcgctagactgctggacaatcacgtatactactaacaggagcggaactcgaaaacaccttctgtcgtacccggcggaggaggagaccccattgtatatcaaaagctatttctgaattgtgcggtcgaccctggaggttcatattcttatactaaccaatgctttcggaataactctcccagtaatgtagattactactccggaaaagagatgaagccacttcgggtaccagtaggtatggcctgaggtatgaagatcaagggattctaagggtacaacggggtggagacatcaatatatcccagaaggctacagcgtgaccacgagaatatataccgcggggcgcaaacaacaccagcgtagcccacgggggagagaataaaaggagccccaccacgagagcataaaagtcgcgcagctcagccagaaacaccacggagcaca

SEQ ID NO: 602492 - DNA, 429 bp, Homo sapiens
tgagggaaggagttgtagggccaggagagagttgggtagtaagcaatggaagatggtgggtcagggacatggagagagcatcgagacatgtacgggtgttgccgagtgggaggagaccagaccacccataaggaatgtttggcaaaaaagttgagttggaaggcgataaaatatatagaccagcgattctcaagcggggaccattctgtcccccagggacacttagcaacatctagacacattttgttaatgtgtcacaacttgggggaaggggactgctactggcatctggtgcagggaggccagggatgtcgcgaaatatatgctagcaaggcacaggacacgtcccagcccagggaatgatccagccccaaatgttaagagtcaaacctggtctggacactatctcaatttctgtgcccatttcaa

SEQ ID NO: 602493 - DNA, 581 bp, Homo sapiens
ggtcgacacattttcataatcaaaattattatttacccacattgatgtgatgcgaatagaaaattgagtggggagtaatattgggagcaagggtaaagagagctaaatttttatcctccacaatatcaaaccaatagaaaatgactaaaagtaataaacataagaactgccacattttatttagagatacagaaataaatatcaaattatcagtgaaaaatagggagtgctggtttccaataagaaaaaaggaaggatcagggactactgtttttcataacacaatttgtggtactattgaactctacttaactatgtgcacacataatttttatttgaaagctgcatgatatgaaaacttgtaggtgaaaacaaaatgaaagtcataaatagcagcgtttgtattagccagcattgaaatagtgagctcatgaaagaaagagttgaaaaattccaccagagacagaaagtcctaataatcagaagaacagagtgtccaaaaaagaaaaaaagtttggctcaagtgggcgtattacagtcgcgcggcgcaatttgtagtgtagtcacccggaattcgaccg

SEQ ID NO: 602494 - DNA, 834 bp, Homo sapiens
  misc_feature (13)..(13): n is a, c, g, or t
  misc_feature (83)..(83): n is a, c, g, or t
  misc_feature (106)..(106): n is a, c, g, or t
  misc_feature (136)..(136): n is a, c, g, or t
  misc_feature (142)..(142): n is a, c, g, or t
  misc_feature (364)..(364): n is a, c, g, or t
  misc_feature (377)..(377): n is a, c, g, or t
  misc_feature (410)..(410): n is a, c, g, or t
  misc_feature (457)..(457): n is a, c, g, or t
  misc_feature (508)..(508): n is a, c, g, or t
  misc_feature (512)..(512): n is a, c, g, or t
  misc_feature (533)..(533): n is a, c, g, or t
  misc_feature (616)..(616): n is a, c, g, or t
  misc_feature (722)..(722): n is a, c, g, or t
  misc_feature (759)..(759): n is a, c, g, or t
  misc_feature (771)..(771): n is a, c, g, or t
  misc_feature (809)..(809): n is a, c, g, or t
cgagcggatttanaaagaaaagctctgaattatcggtttccacgagctttagggagtgcatcttcacctgtaggtagcaatgnggttctgatgagggtgatgtgcnaaaccaatcacatccttctcgtgcactgtnaaagtnctctccagtttgccagtcactgtactgaaacagtagagcacaaagctcgctcccctacacagtagatgccagtgtcacctacggggagagagggcacagcacaacaaagtccccaccttctctcttctaccagcaactgaagcttgctgacgaactctgcgcgcctggcatgtccgatgagtgaccaccgtgtttgatctgttgcacaccacaaagtgctcngggtttttacggnagtagaatcacactgttgacggtaatatctgtncctgcggtgctgcccagggatttaaaggtatttgaacattctgtggncttcatattccagatctttacagtgccatcagaggatgcactaataatgtnatgnccatctcgtgtcaatgttgcntcgttaacaaaggagggatggccacgaaattccttcagggttttcccagactttaaaccatgaattctacattgtctggtcanaagaagcactaaggatctgactgcaatccttagaaaagcttagacaggtgacacccttactgtgtgccctctcaaatctccttaaacattgtccactctgaatctnccacaccttgatttttccatctcgggccccagtcgcnaacatttctgtntctctgccgaaacacatgcagaggacagcatcatccancaacataaagttatcttgggcctgg

SEQ ID NO: 602495 - DNA, 262 bp, Homo sapiens
actgccaatatttcgtctccaaagagggtaccaagtgattcgtcccaattgtcagcagctgcaagagagacacatgtattcgcaaatccggtcacttcattcgctatctaagcgtgatcttcaatggggtctcggaaatctgggacactgtgacccccctcgctcttgtgtgcctctatggtaaccgcgcctctgcaataagccgaggtacagagacaaaagagggacataggggtcccccctcacagtgttgcatctcgtg

SEQ ID NO: 602496 - DNA, 465 bp, Homo sapiens
gatgccgcctggtgcttgatgttcgtgtccatctcctgggtcgcctggcggccactcgtggatccacaggtctgctgggcggaaggtggtggtcagtacgctgtgaatgcatcaccatttctggcactttctacagacacaagtagaagtaactggctttcctccgcaagcggatgaacaccaaaccttcccgaggcacctaccacttaccgggcccccagccgaatcttctggaggaacgtgcgaggtatgctgacccacaaaaccaaacgaggacaggccgctctggaccgtctcaaggtgtttgacggcatcccaccgccctacgaccagaacacgcggatggtgcttcctgctgccctcaaggtcgtgcgtctgacgcctaccagaaagtttgcctatctggggcgcctggatcacgaggtcggctggaaataccaggcagttacatcgggataccgagct

SEQ ID NO: 602497 - DNA, 496 bp, Homo sapiens
  misc_feature (61)..(61): n is a, c, g, or t
  misc_feature (144)..(144): n is a, c, g, or t
  misc_feature (317)..(317): n is a, c, g, or t
cctgctcggtagaacctttttgtgggccgcgtgggggaaaaagggttcctcccccgccctnggatccacaaaaaaattttataaattgggccggggttcccttttaaggggggggaagtggttaaaaaaaaagccccccccttnttttcccttttttccaaaaaaaaccaaccctttggggggttttttccctattgggaaaaggcccaaaacttttttctttttaaaaggttttggggggggaacaaaaaaaggggggtccccccccccaaaacccttttgggggaaaaaaaaagggggggttttggaaaaaattncccttaatttttttacccccccccccaagttgggcaagggggctttccccccctggggggaaaaaaaaacttttttgggccccttaaaaaaaaccccattttcaaagaaaaaaggggttttttccccggacaaatttttccggtggggggggttccaaaaaaaatttttttcccttgga

SEQ ID NO: 602498 - DNA, 450 bp, Homo sapiens
  misc_feature (46)..(46): n is a, c, g, or t
ctgttcataacaatatatgcatcctgttaagatgataggagatttntctgcacctctcctctttgtgagcctgcagggacattccctttaatgtccatatttctaccagcagtctcttcaaggcagtctaggtttttcctaacatacacctcaaaattcttgcagctttggccaggcacagtgcctcacatctgtaatcctaacactttgagaggccaacatggacagattgcttgagctcaggagttcaagaccagcccgggcaacatagtgaaaccctgcctctacaaaaaatacaaaaattagcccagcatgctggcgcaggcctatagttccagctacccaggaggctgaggtgtgaggatcgcttgtgcctaggagattgaggctgcagtgagctgagattgggccactgcactccagcctgggagacagcaagaccctatctga

SEQ ID NO: 602499 - DNA, 420 bp, Homo sapiens
  misc_feature (100)..(100): n is a, c, g, or t
  misc_feature (217)..(217): n is a, c, g, or t
  misc_feature (220)..(220): n is a, c, g, or t
  misc_feature (224)..(224): n is a, c, g, or t
catggttttaaaaccgggtgtaccttacgttgggtgtcctgcaggttactataccttgagtttaaagtcgacttcctcttacatttctcccctgctttgnatctgctttgtgcttggctgctgagagagcagcacaggctaagacagtgtattcctcccaggtctctcgcccttctcatcgtccgtctgtccgtcagtccgtccgtccttccctccntcncacnttaaattctttccttctggttcttccaccgggccattttccacatctgcatcagaagagatgcctcccatgttagtatctgataatatcagtctctccttatcagaggagagaccttttatttttaagatgactacagacctatttttagataagttttcagtacaattttgaactacaacttttttaacaaaaca

SEQ ID NO: 602500 - DNA, 938 bp, Homo sapiens
gcttggctgtgattccgtcctgcgcggttgtatctctggcgtaacgtccttttatctccgaccgccttctctcctacctaagtgcgtgccgccacccgatgagtaacatcacgcatgtgcacatggcccctatgagtcctcccttgaggccccagcaatgtactcctcttacgggtgttggtgcacatcttacaaggccctgcactaaatgattcatccagcgttctaaggctgggataattgactgaaatcactgatgccactcaggtcattctctatagcatacggcctaacttatacgcgggctggctgcccagtgattgccgttgcatcggtgctagtagatgccgaggcaatgacatttcgaagggagaccaattaacatcagatctggcaaggttccgacgaaatgctcgtgattcaggccctaatggatttcccctcggaggctttgaacattacaccaaccaccagctggtcatgtcccatgttgacagtgccggttcaaggccagttgcatattagtggaccaggcactgagtagctggtggaggatcgatgcggagtcagcacagatgaaagaggaggaaggatgtgaacactcttaagtatatctggaaagacggtctggcccctgggaggtggtcccaagggttcctagagaacaaagtgaaaacttggtgttgatgaagatggtgacgaggatgatgaggacggctcatgcttgcccaccgacgatgctcagaatcggcgatcccgctttctgcataacacggcggcttgtagatccaattagtagttccaccggtacgcggaaccgttatgggcaaattcacctattgggcccggccaggagatattttctcacaggacagctcaacccgctatggtgacaagccacccttcaccgtgccgtgaacaaaaacaagcgcgcgaaa

SEQ ID NO: 602501 - DNA, 281 bp, Homo sapiens
tgaccagatatgcagagaacccttgtaatacttgtgagtctagtgccgacccagcatcagttcaccccgcaggctgcgcttctgggtccctgctcaggtagaaggagaagatgttctggtccagcagcttctggtgcatcaggttgtcgaagaggggcagcacgttgttgacggagatgcgggggtaggccatgccctggatgccatcgaacttgtgcttgcgatgaaggtgatgcctggctgcttggttgggctccccaaagacctgcctctccactttg

SEQ ID NO: 602502 - DNA, 858 bp, Homo sapiens
  misc_feature (858)..(858): n is a, c, g, or t
gagcgggttccgggcggagaccgcttgtgctggaactcggagttgtaacgctccactgactgatacagcgaccggccgaccatggcgcccggagatgggcctgctgggccgacgctcgtactggatggttgtcgcctcggtggacgcctgtgacttgctcctgtctgctcataccctggtggcctgcctggctgcaggagtcctcccgtgtaggctgacttgttgctctagaacacaatacaaacacctagtgaacgacgtgctctgaagaaccgtctcactgatacttatggatgcaaacatctaaacaacgagcttgctcttggagctagccccaggtatagcatagagcgctctttgcacatgccgggcttgccctttggtaacacttgacgcgtctgcagcagcgtggtggcacgtttcgttgagcgtgcaacattctgacggcggcgttgactcatcacccattgtcggctcagtccggcggtgaacgccttccttccctggcgctgttggccattcctgcattgccgtgtcgtgctggctgcgagagatggacacgcatggcagccgcgaatgcccggacacggacgtgacggacgacacggcccatgccgtagcagcggcgagggacgaaggccggattacgcgcatgcacgcgtacaccgtgacgaacgccgcgtaggacttcgacgggaaccataagaacacttgcactgtacaacattcatggacaacacacaccgtttatttcgggcccctcgtttgttcaacatgccatgccaccacagccccgggtaattgcctgagacatttttcgaaccaaacctacactttacaaaagtgccggcttcccan

SEQ ID NO: 602503 - DNA, 121 bp, Homo sapiens
cagtgtattatgtgtgtctccattggtgtgctgtagtacatacccagaggaaagaattagaaatataaagtatattattttaaaaaattagctataattcccaacacctaacatctactgc

SEQ ID NO: 602504 - DNA, 347 bp, Homo sapiens
cttcaatgttgccatgcacatcctcaacaatggaaggtttgtcatagctgcggccctggcaggtaccatgacaggcatcattgctaatgcggtgagtaccctgcccgagtacataagtaacccacacagaagtctcactgacccccttgccatgtgtccctgatcactatcaagctctccctacactataaacttctcccctaccagcagcccgactcgctagcttatgtatccatccagcgtagactgaactctggttgtatgccacactgatccacagcgggatgtgcggaccctcttccaagtagatcatgccacttcgtacccattacgcggagcttcacgct

SEQ ID NO: 602505 - DNA, 485 bp, Homo sapiens
gtatcttcagttttcaaccaaaacagtttcaacccagtcacacaccaacacagtaatcaacatttttcaacacatcagcaaacaggcttcacaaacatcaaccaggcaagcaaagtcatttctcataccatctagtcacaatgtggtttgtagttttcaagcctcaagtcactcatcaagcagtccaagcacaatttcaaaacattcatgcaacttcatcacaagtcaaaaaagctcacacggtttctcaatcaccagcatgccaagcaaaaaagtgtcttcgctgtctgcactgtcagccagccaagcatggattgcaagcaatggggggttcaggggcagcagtcaagctcaaggttcaagttcattcatggcaagcaacaattttctatcacacatttcagtgtcagcctcaactgtacagtgtttcatcacccagtctacaatcagtgcacaatcaatgtccttggccttgccatatgcaa

SEQ ID NO: 602506 - DNA, 296 bp, Homo sapiens
aatcaagcatagtagaagtagctccgtagtgaaatctaatgcgggatgccctattacccagataatacttgtataattttaggagtgacaaaactcagatccagcttgtgagaagcacttggttgaaacagctccagagcccccaactctggcctactgtggagaccataaaggatcttcataggacacaccccaagatgaagtcataggcgcgttcgccttaactccctgtacccaaggtttggctaacctatgctcatttagcatgaacactacactacgtgcttgtagctggc

SEQ ID NO: 602507 - DNA, 133 bp, Homo sapiens
aaagggtgcatagtcgatttccagagttatccccccaggtatcgtaacacgataaatattttctcataaccccatgttttgaaccaatcagtaacttttaaggtttcgtttgttctaaatgtaagatttcaga

SEQ ID NO: 602508 - DNA, 227 bp, Homo sapiens
ggtcccgcggttatgtttacgaatatactgcattcaatcacgctgctatggaattcactgcattcaattgggattcattgcgccacgatgtatggaatccactgcgttcaatttaaatccattgcaccacactgcatggaatccactgcattctctcgagatccattgggccacgctgcatcgaatccactgcattcaatcgggatccacgtaagacataaccgcgg

SEQ ID NO: 602509 - DNA, 630 bp, Homo sapiens
tggacggagagagagaaaaagcaaagaaaagaagaaagaaattactggccttaagttcccatttgggcagtgctgcaggaagctgacggctattgtgaagctccaatctagcactggcccttagcatggggacttagctgtctttctcttgtcctcagcacccgtcatgtggcttgagcgagcagtccttttctgtggggtgctccggacctcttttggaaagctggggtggggaaatggcgttcatgtgtcagttatctatcttcatgggcttctccagaccttttctccactctgcactgggcggtgtgagatgacacgaatggacgtgaatgggctcttgtaactgcttgggctgtgccagtagggagctctggtaggagggagcacggtcacagtctccccttgtcaggaagcctcatccacagggtcttgtcccagggagcaccccctctcctcccagtatcaggccagaggtgactatcactataaatagcccggaccctgtcctatcccttgggcttcctatacatgccacagttttgtaaattgtcccttaccaaatctcctcaatcaccaattcgagtgtctctggcgggtcctgacacagagccatataagggcttgtgg

SEQ ID NO: 602510 - DNA, 334 bp, Homo sapiens
gggggggcccccccccccctttttttcctttggatggaaccgaagggacccttgggggggggggttttttttttaaaaaaccccaaaaagggggccctcccaataaatattccccccccctttccgggttttgggggggggctttttaaaaccccgttggaaaaaaatactatggggggggccctttccccccccccccatgggggaaggaaaattttttttttggtttttccaaaaaaaaagtttttggaagggttcccccccccccttggggccccaaaaccaagggttttttttcccaaaaaaaaaaaaaaaataaaaaaaccttttttta

SEQ ID NO: 602511 - DNA, 406 bp, Homo sapiens
cctcatcgagtgccagttaccccccaaacactcaccttgggaatatatgaactgcaagcagataacacagttaaagatacctgctgcccaacctgactagagccagtctctgggacccacctagtgattccataggttgtcctctgaccctcactcacacattatgacacacatgcactcatatgtgtatgtgtgtgtgtgtgtgtgcgtgcatgcacacataaaagttgattagtaaatatgtagcaagtaatctaaaatacatgaaatgaattaaacctgtaaaatatgttttattttgagacggtgtcacgaagcccaggctggctttgaacttgctatgtgcctttggttggccttgaacttggtcgacgcggccgcgaatttagtagtagtaggcggccga

SEQ ID NO: 602512 - DNA, 305 bp, Homo sapiens
gaggtgactctacggatcctaaacggtctgttaccttcttcgctgtgttatactgagctcgctgtattgggacctgggcatgcctgtagacgtatccatgcacaggcgcgccgtgttgatctacctcatacgggtcttgcataaacgagcgaagcttgtgtatttcaacgtaactgatgcgtttcacagagataggttcgatccatggtctcgtctcgcaggtgcgcaaactggctttgcaacgcttgtaccacctgtgcattggatatgggcatgaaacggatcctggcttgaaaacacttgga

SEQ ID NO: 602513 - DNA, 182 bp, Homo sapiens
gtttcacgaaaagaagcctacaagaagtacatcattgattacatgaaatcaatcaaatgggaaacttgaagaacatgagaccagaacagagtataacctttatatgacatggagctgcagacacaaatcaagcacatccttgacaaatttcaacaaactagccagttctttattgtgtagaa

SEQ ID NO: 602514 - DNA, 357 bp, Homo sapiens
ggggcatgggtctgtagtgagggttagtagccggggccacttgagtcgtgaaggcctctgttcccactgcttctctgttagcttcagcagggcgtgttggccgagcggggcgccatcaggactgtgtccaccatggtgtggtcttgctttttcccggcattgggctggtggcggaacttggtcctggtggagcttgtgtacccgggagatctggcttgtagacctcgttcaggttctcctccaacttctggcgcagctgggcgcactcccgaggtgtcaggcttcaggaggttctcgggtcaaaggggggccaggcgcaaggacagcccgtagggcaccagctctgtgggggttgat

SEQ ID NO: 602515 - DNA, 929 bp, Homo sapiens
gagagcgcgagacgccagcctaaagagagcccggaggccatgcgtggagagggccgctgacgtgcgcgcgctcttgccatcgagctccacaaagacatgactaccaacgcgggccccttgcacccaatactggcctcagcacctaagactgacaactttgtacctcatgaccgcgccccagctggcatatactggtcgtggccgcttctatgtcacaggggtcttagtcgtgaccacatggctgttgtcaggtcggtgctgcggtagtcccaattgtggacttggcggcgagtgtccctgatgctggtttgcagtgtgtgggttcattcacctggttgatcgaggggctggtccggtctctactacgaatgacctgcttggaggaacccacgccttcgttatctcaactctgaaaagagtatgccaatgggtagacaggcgatacatcctgggtgacaacttcacagtgtgcatgaaaccaatcacagcttgccatgttgggtgaccactcagtcctgtgggatggtgattcgcctttctccggcagatcccctccgttcattacaacagttgtggacgctgaggggacagaaactattggggggatgtgcgtctaacttccgtggatagagcaaccgctaaggagttccagtacggggagctggagcagcctctctagatacggttgagtgtgtcttcatgaatgcctgtggtgcgggtgctggagtcctatgctaatgtgggagcacttcatcatggcgaaatgctgtgcaggtcaaaaaggagtagacagaataggtggtgcacgcccaccgcggagggcactcccgcaaaaatttgccccatgggaaaattttgcaccccgggcaagaaaagggggcgtggcacaaacggggggttgtgagtaaaaaacggctggagtatagcaa

SEQ ID NO: 602516 - DNA, 233 bp, Homo sapiens
aaaattgaaacgtcatgtttagatggagaaaacagaagagttctgatcaatacagacattggattgcccaatggcttaacgcttgacccgttctctaaactgctcttctgggcagatgcaggaaccaaaaactggagtgtacactacctatggaactggacggcgtgtcagtcaaaacaacctcaagcacccctcagcatctaggcattagaccacttctaccaaaaacttga

SEQ ID NO: 602517 - DNA, 753 bp, Homo sapiens
  misc_feature (414)..(414): n is a, c, g, or t
  misc_feature (532)..(532): n is a, c, g, or t
  misc_feature (548)..(548): n is a, c, g, or t
caggagttttagaccagcctgagtaacatagggataccccatctctattaataaaaattttaaaaaatttgttctaaaaaaagaagaaatataaatcctcactgagagattagttatttgtggattttaaataaccattacaagaaagtctcccagagataaccactgtttaacatttcagggaatgctgtaggtactctctgggctggtacagatgtgtgttatgcatatatataattttacttagaatttgattatttttcacccaacaggaagttggaaatagcttttcgtgtcaaatctacatctgtatctttttaagtggctacaagctgttttattgcgaataattatttatttaaccaatccccttttggtggacacttagattatttcctgtttttcgcaactaanaacattcctgtgatacatcttttagtattcatctttggatagttgtccagcaatgagttctgcttctgatggacataacagagaatgtatcctcattaccaaacaagggaatcttccnctctcttggcaacccnttttatgtttacagccattagttttttaatttacctaatctactagcttttaaggctgagagactgctccccattgcagattagcgtatagtcagatgggctacagtttttctcctcttaacattttcttgttgatttcacttgacatttcgggggaccagaggttccagtagtcatctgcttcagacctctgtgaaggttggag

SEQ ID NO: 602518 - DNA, 1448 bp, Homo sapiens
  misc_feature (1448)..(1448): n is a, c, g, or t
gggaatcagtgactgagggggcctgcctgagcgcgaggtgtcggtgcccaccttcagctgggaggagattcagaagcataacctgcacaccgaaatctgatggtcattgaccgcaaggtttacaacatcaccaaagtggtccatccatgacaccactgggggggccaagacgaggtcatcgaggacaacatacgctggagaagactgcaaacggagtgccattccgacgccattacgaaacactgacctggagattacgatgaggcaacgttctttgaacatccccatgactgacttgggtgaaactgggacacccggggagggcacgccccaagaaccaggtagccatcggacaacgaaacttcacaacgagtcacgtagagcgaacattcccgagagcgccctgaaggcaaaaggacgggcatgacgggaacgatgagaaccctgcaatcaaagaagcaaaaagcacggatgatatcctttccatcacatacccatcccatatgggcacacacaatacagatacgacaccctgaggacgcacgccgattttagcaaaatcgaggattatccaacataaggtagtcacaacagcactaactgggacgaccaaacatggtggattaagtgaaaaaaacagtaagacacacagttaacagttcaccagccggagaccgcctatatcgaccacagcgtaaggacgtaacaagcatcatttagcgggaggaacccagaagggcataggggacattgggccatgtggcgaggcccaatacagacacataatctggagcgcgcaaacacatatgacacattgggtccatcagacaaggacaaagagaagccagcaacacaagattacgaaacacactcaagacacaaattgacatcaccacactcaaacaaatcttcaggagtcaaccaattagagacaaccaaacatataaacaacaagcagagatttccgcactatcatagccacacacacatatagcatataggcaaaataccaaattcagaacacaaacatataccaccaggtcagaaccacacacatggacaccacacaagatcacattacactcaatttacattaacccaacaagaagggataacaaccaccgaaattatttagacaacacaattttgactaggcaaacaagtagattattatagatccattagtcaggacacagacaacgtagagagaccaccacaaatacagcacagatataccagcagacaagaagcacaaacaaaatcagccttacaacatctacaacccttcgacccctaacaacacaatcaacacaagcacaccagaaaaatacacatatacattcacaatcgatatcacggcacgcgcacagataagagaccaaatccaccacacagtgattattattatcaaaaagcaccagcaacatcatcatccacatagcaaccan

SEQ ID NO: 602519 - DNA, 141 bp, Homo sapiens
ctaacggctaacataacggcgggccacctattcttgcccttaatgggaagcgccacactagcaatatcacccataacccttccctctacacttatcatctccacaatcctatttctatggactatcctagaattggcggtc

SEQ ID NO: 602520 - DNA, 150 bp, Homo sapiens
tgttctatagctctatcgcttgtcaacgatgtgctttgaagctgttagtgtatcacaattgatgtttgtgttctgtttgattttaaacagagaaacaataacagggggtaatagctccttatatcttctcttctttttttattttccata

SEQ ID NO: 602521 - DNA, 521 bp, Homo sapiens
acagaaggggtggtatgtagagcacatgatggttatcgaagtggattggaaggttgaggaccatgtattcggcagctatgctgttgtctcttattctaacgtggaaatctgttttgtaacttgtagtaataaggtagaaattaaaaagaaaaagtattttcctgtacttgcttggctgcaaggtcaggaacacatagttccttagcggatccttggtaacgctatctgaaaaaccacatcgctgagaaatgagttctggagactctcttaacagtctgttgtccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgcc

SEQ ID NO: 602522 - DNA, 1221 bp, Homo sapiens
  misc_feature (350)..(350): n is a, c, g, or t
  misc_feature (589)..(589): n is a, c, g, or t
  misc_feature (878)..(878): n is a, c, g, or t
cacaggtgtcgtgaaaactacccctaaaagccaaatatgggaaatggaaaagactctatatcaactattgtcgtacattggctcacgtagattcgggcaagctccaccgatctatctgggccagtactgatctataatatgcggtggcatctgatcagacaagaacctattgcaataaattgtgagaaggaggctgctgatgatggtgaaagggtctccttcaagtatgcctgggtcttggattaatactgaaacagtctgagcgtgtaacgttggttatcaccatttgcatactctcctggatgagaaactttgagcaccagtcgaagttactatgttgcactagtcanttgattggcccctagggatcatcagcagtacttttagtcaacataaccatgattgacagaggatatctccagtgctgacgtgtagctgtacctgcattgtctgcatgctgggtgttaggtggaattttgaagtctgagtatcatcctaagacatgaggcagaaccccgagaagtcaatgccctatctgggctataacacactgggtgtgataacaacgttaattgtcggtagctaacanaaatggcattccacttgagccaccctatcagccaggaagcagatatgaggaaattgttaaggacagtcagcacttacattacgacaaattgggtacaagcccgaccacagtagcatatgtgccaatttctaggttggaatggtgacaacgatgctggagccaagtgctaacatgccttgtgttcaagggatgggaaagtcacccgtaagggatggcaatgccagtggaaccacgctgattgaagctcttggactggattctaacaacaaactcgtcccaactgaccaangccttgcgcctggctctccaggatgtcttccacaaatggcgggaatggcgactggtccctggtggccatgggcaactgtgtttctcaaacccggattcggtggtcccccttttggtccacgaaccacggttcacacgggaagataaaactgtccgaaaggtccccatgaacatctatgtgacacttcccggggaccaacggtgaccatggagcaaacatctttacaagatctgtgacaaccgatgcgggagaacatgcccagagtgaacgtactcccgtggttcatttacacgcgacccggcgcatagtattagagacaacagttgtagaagaaacaattaca

SEQ ID NO: 602523 - DNA, 237 bp, Homo sapiens
aaggggggggggggcccccccttttttttggcccccctcctggtttttttgggggggcaaaagaaaaaaagggggttggtcggggcgtgggggcaaccggtttttttttccccccccccggccccccccaaattttggttttttttttcccccctttttccccggtttggggggggggcccccttgggggggaaccccaatttaattttggaaatttaacccccttcccttttgcca

SEQ ID NO: 602524 - DNA, 119 bp, Homo sapiens
gcaccgggactccagcctggagaacagaatgagaccccctctcaaaggaatctagaaaatgaccatttggttcttcactcatatcttctatactgatcacatttgctctccagaggtct

SEQ ID NO: 602525 - DNA, 154 bp, Homo sapiens
tgtgcgtgtcgacgctgagaggatccccaccacagtcactatctatcaacctagccatggccatccccttaggaccgggcgcatgtggttataggctttcgctctaagattaactaatgccctagcccacttcttaccacaaggcacacctaca

SEQ ID NO: 602526 - DNA, 897 bp, Homo sapiens
ggtaatagcttttctttttacttcagaaatccacacattagagaattcaccaaagtaatcctctttagaagggcatcttgaattatattatccatccgtatttatggagatggtgaagtagttgaaccgttgattggtgattctgaaacataataactatgtcaacaatcaattcagcgtatttctggttgtgtattcaattttgggaaatttcatcttccttgtgattttcatttaatcattttttacatttcttcaagttcaagcaggtagtggcatgtgcatgtgtaacaagggccaatctgagcaattgtgcacttatatgtggcacatttttccctttaagattctggaaaaggcaccccattggtgacttttctcaaaattgcagaccacactatcagacacccacccgataccgcttcttttcacacttacataaaacacacacttcaacaccttctccaccacccttttgggggcaccccacacaccgggggggtctttttcccccaaaaaaacccccccccccccgttttttttttcttctctttcccccccacaaaaaaccactaacccccccaccaccgtcttcttttcactactatcattcagtcatctcctccctcccccccccccacaacacaaacccgcgcgcgggtgcgcacaacccaacaaacaacagtcgctggggccactcccccccccctccagccccccccacccgtcccacgaacaagcagccgtgtttgttctttattaactcacacccacagcgcctcgccccctcgtcacaacaaccacaccacactcgctctttttcttccttttggtgcggcggcgcgcccacaccaccaccatccttggtgccctcacacacccgcgaccgtctgttga

SEQ ID NO: 602527 - DNA, 104 bp, Homo sapiens
tccggttgcgacgactgctggcatcatctctcctcctgccggctcacctgcagcagcggcttgaccttggtgaagagccgccaccactgccagttcctgcagct

SEQ ID NO: 602528 - DNA, 403 bp, Homo sapiens
  misc_feature (48)..(48): n is a, c, g, or t
  misc_feature (381)..(381): n is a, c, g, or t
aggttcgaggagactctcaataactaggtatcttccttcaatacctantttattgagagtttttaacatgaatggatgttgaattttctgataaaccttttttgcacctattgagataatcatgtggtttttctctttagttctgtttatgtgatgaatcatatttattgatttgcatatgttgaaccaaccttgagtcctgggaattaagcctacttgatcatggtgcataagctttttgatgcgctgctcgatttgatttgcagtattttgttgaggatttttgcatcagtgttcatcaatgatattggcctgaagttttctttttttgttttatctctgccaggttttgctatcaggatgaggctggcctcatagatngcattagggagagtcttcgtcg

SEQ ID NO: 602529 - DNA, 638 bp, Homo sapiens
gcgtctctcggggggcgggtctaattacccgagccttgtttgttgtacgccccctcgttcctcccctggtgacagccccctcccccgcttgttgttgaccccccctagaaggaagccacccgggtgctggattcctcccttctcgggctttttgccctttggtgccccggggccgggatgaaccctatttttctccacccgggagaccacctttgtcccccttggcgctcattttgggggcacccaccctataaggaccgaccgagtgtgtcgccacaagaacgcagcgttggtcccgtccgcggatattcgcgcggagagattttcttagccacacacgtgcccctcctcgacgtgcccctctttccggtccacagaggggagttgaccaaaatgtgttgtgcgaaagtcttcacttctcccgccggggcgcgtgttttgcctacaatcacgacgcgcgtctctcttccctataagaaagccggggaggctaccccacaggcctcaaagggcacattgtgggtacccgccccaaggggccccccccgccccccgtttttaagggggcccctggaacccaaaggagtttttttagggcccccccccgttttcaaaaaaaaaggtttttaattggccca

SEQ ID NO: 602530 - DNA, 182 bp, Homo sapiens
ggagtctatgggtggattgttgttgttgttgtttgaattgaggaaaacaaatgaattgatagccaaagtgagacaatttcagcaatctgtaagcagtatgtatgtttagttggggtaatgaagtatttcagtttgtgaatagatgactgtttttacttcctcaccctgaattcgttttgtaa

SEQ ID NO: 602531 - DNA, 343 bp, Homo sapiens
  misc_feature (7)..(7): n is a, c, g, or t
  misc_feature (67)..(67): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (87)..(87): n is a, c, g, or t
  misc_feature (89)..(89): n is a, c, g, or t
  misc_feature (96)..(96): n is a, c, g, or t
  misc_feature (161)..(161): n is a, c, g, or t
  misc_feature (164)..(164): n is a, c, g, or t
  misc_feature (169)..(169): n is a, c, g, or t
  misc_feature (174)..(176): n is a, c, g, or t
  misc_feature (180)..(180): n is a, c, g, or t
  misc_feature (245)..(246): n is a, c, g, or t
  misc_feature (251)..(251): n is a, c, g, or t
  misc_feature (315)..(315): n is a, c, g, or t
gggaganggggggacgggcttctccctgcatcaatcaacaggcagaggtgggaggcctttgcgagcngctntntncggaggagcggntnggcgctnagagcccggggggtccgcctgccccggcccccgctgcctggttcttcgggctttggcccaaaccncgnttctnggtcnnnaccnccccctccctcccccaccccctcacacacccacccacccaatccctccctacactcccccaaccnnaaccncacaacccccccccctccccccctcctcctcccctcctccccaccccccctccactccctcccngcccgtgcccacgccccgccaaacaacg

SEQ ID NO: 602532 - DNA, 719 bp, Homo sapiens
  misc_feature (196)..(196): n is a, c, g, or t
  misc_feature (201)..(201): n is a, c, g, or t
  misc_feature (232)..(232): n is a, c, g, or t
  misc_feature (235)..(235): n is a, c, g, or t
  misc_feature (251)..(251): n is a, c, g, or t
  misc_feature (260)..(261): n is a, c, g, or t
  misc_feature (301)..(301): n is a, c, g, or t
  misc_feature (379)..(379): n is a, c, g, or t
  misc_feature (388)..(388): n is a, c, g, or t
  misc_feature (407)..(407): n is a, c, g, or t
  misc_feature (416)..(416): n is a, c, g, or t
  misc_feature (630)..(630): n is a, c, g, or t
  misc_feature (715)..(715): n is a, c, g, or t
ccctgattccgatttggttggtactccagcgatgatggcatatttgtttttttcttgctgtgttgccccggctggtctcttacgtcctggcctcgggccgtcctcgccgccttggcttttcccaagtgctggaattaccggcatgagcccccctgcctggcccagaaaccatgctgttattactctagctagcagnaaacnaaaatcattttctggagaattagactatttnacnaggcacatgcttatcngtacgtgcnntacctcttctagtgttctgctgtgttgatattagtgaccnagatctgcatagtttgagaaccctctatttcaaggattaggaggtagaaagcttatgagaaagaaatctggcctggtnaatgcaccntcgtgggctttttgaaagntgggactcnttctttgtctttcagtggtttattataatctattaaaatttacttatgacctgagacaaagccattttactatttaggctcagtttaacattgttaaacctgtctactattcagagtgtaccaaggtgcttttatttcttaagagttctgttgtatttcatccataaaaatgattgaagcagggtcaggaaccagtggctcatgcctgtaagtntagcactttgggaggccaaggtggaaggattgcttgaggccaggagtttgagaccagcctaggcaacacagcgagaccccatctntacg

SEQ ID NO: 602533 - DNA, 614 bp, Homo sapiens
  misc_feature (460)..(461): n is a, c, g, or t
  misc_feature (540)..(540): n is a, c, g, or t
  misc_feature (569)..(569): n is a, c, g, or t
  misc_feature (591)..(591): n is a, c, g, or t
cagcttcgaaatcttcagagatccacactttattgcatgagcttcagtagctaatcagtcgtataagagataatcgctccactcatcgaagtcatcattttatccaccgagatcttctgccaactatctttcgaatcaactttaatagtttctacacacatccttctttccccttagaccctttgcactacattcgaaaacctgacttaaaaaagataagagggagaccccctaagatgaggcatgctgtgtctgaaatgccttttatgcacagacttaggtctcctctttctaagactggattctatccatcttatggcatgccttactctccttcaccccttacagctgctcccataggattagcctactatggaatgtatcctcccactctatatccacctcgtccatctccttctttcaccacgccacttccacctcctttctatatgcatgctgnncatttacttctcaatcctgccaaataccataagaaaaagcataagctacttcgacaggaggcctttcttacaaccagcnagactccccttctttccatgagtacctancccagtgttcctcctgagatgncctatggttggatggttgagcac

SEQ ID NO: 602534 - DNA, 1801 bp, Homo sapiens
gggttggacctggctttgccgggggtctgtcatgtcaggaagattgttcatctttggcgtgagcgagcgagctagaggaggctgatcttattatgttgaacagcgtggcgtgtttgttcgttcggtgaatgcgcagctgctagtggtattgttgtagctctgagcgctgctcactcttcgtagtgagtgacataccatggtgtgtgacccccccatcgctgatgatatttggtcgaggggccgtctttcctgctggggatggttctgcccgacaccgctcggcggcgtggtgaagaatcgagttgtgctgctggatcctgctgtgtctatggaagttgagttgtcccacgtgtgttggcgctcgtgttgtgttcgtgtgtattagtctcgcttgtatgatgtgctgctcaccctcctttgtttttgctccctccgcccactatgtgctctttttgtgcggcgctggcgttcctcctgcctctgttattgttgctccgcgtcctggtcttgttggtgatttgggggccctgtgtgttcgcccatctcgcccgctctagtgtgtggggagtgagctacctctacgcggggataacgtcattcatggcttttctgcgtataccgcgtggcccgctgtgttggctgtttagccccgcagagtgtggtgtgtgatgacgatgtcaaggttgtttgtgagcggcgccgtttgcgggaagataacgtgtgtagtggcccatgtacaacattgaggccgagactgtggtgtgtttagttgtcgtttttgtgattgtgggtgccaccccccacttggatcccgactatgttattgatggggtgtcagtttcttgttgtgttctcgccatcagaatcttcacttgtgggggggtggagcaagatagaataaggatttgtgaggttgtagatctaagttcgtttgttgttatatgagccgtgacgtgtgcccggttgtccacctgcgtctcgtttgtgtggttgttggggcgtttgtaggagtcgttacggagtgtgaagtgccccgccgcagtggggggggccccccctccgttcctttggggggttcgggcgtgtgtgataagattatggggagggtgatgggcccacctcgttttttctctggtgtctcggcaccctgcttcgtatgatgttcacgtctatgaggatatatgtggtagagatacacagacagtgtccacggtagatctgggattgtctctcttatggaataattggtacgcagagcgtctgcctacaatagattattttggggagtgtgttgtgtggtgtgtgtgtgtgcgtgtgtgtggtggtgggttgtggtgtgtgtttaaaatatgttttgtgtgttataaaagttttgtttatgttgcagatattactctaagtctcttatgtccgcatgttatagcgtgcgtccacaccgcgtgctgatagagagtggcaccaagtgtctcagagtgggtgtgtggagagtattatttctattagaaagagtgttatgacctgtgcgggggtcgttatttgcactaagactttgattatgccacgcacttattgtcatatactaagaggccactgatgcaccacgagggcactatcgatgtcatgatgatgttccacgacacgtgtgtgcatgcaccccttatataaggaaaacgccttgtaacccctgtgaggcacggcactgtcccccttctctccctaccccttatcgtccctatatccctgggaaccccccatttgctgggtatttcatctatggcccaccattcatattaatggcatc

SEQ ID NO: 602535 - DNA, 950 bp, Homo sapiens
  misc_feature (834)..(834): n is a, c, g, or t
cttaaagatcttagacatgtgttcacatgttagaaattctactgtgggggctctactgatatgtgcatatatgaggtatgctggtgtgagagaggtgaggagagcatcactttcctttcagtaagcttatgtcggtttctctgtcattctgagctagatgtgatgttcagatgagaactagaggggaagtgttacagacacataatgagatagttaggtcgatactgcgtgtgagaaccaggaagtacattctggaagattggtgttacggagcctggtgccgtgtggtgagctcacagtcgtagtagtcacgcagcaacttttggagaggctcgggggtcacggcatgacacactttgaatggagtgtcagagtacgcagcagtggcctaacgttggtgaaaccgctgtcgtctacttagaaattacgacaagaatccgccttgacgcatctagtggtatacgagctaatagataatcacgtaacaatggtgatcgcattggcgtttgccattgctgaacaagaacgaacgtattagctccatccgaacgaccgggtctgccgtcgactgaatcaaccccagtgcactgcccttagtcgatagctgtgctttcacaaaaacgtcagcagtgagttagtgttggatgctagagaactaaggaagcgaaggaaatacagtatttgacagttctatctgtagcttgagactatatggtaataagttaagacttttggtggtgagaagtcacagagtattatttgtgaccactctcatttgcaaacttgtgacaattccagtgggcgtcaagagtgagatcttggaatctcctagtngaagcgccttttaaagaaagctgataccaaaacgataaagtttaacatctatgtctattggactcatactctagaaaccacgttttaactaaattgtattgccggtggaaatcccg

SEQ ID NO: 602536 - DNA, 149 bp, Homo sapiens
ccggaatgctgtagaaggttggttcatatgaatagataaattaagagtggttatgttagggtcgcacggtgggactgctattattcatcctatgtgggtaattgaggagtatgctaagattttgcgtagctgtgtttgatttaatccac

SEQ ID NO: 602537 - DNA, 315 bp, Homo sapiens
cagttattttgaaattttcagggttatgatggatgttgcaggaattatttttatatatgcccagaacccccagaggacatgactactgaaggctgtgctggcagggtcccaggtaagggtttagcaaattgtcccagcttcattggctgagctttcatccctgttgccctactttgagctgcccttttggtcatataataatgatttagtagagctcttttttggttcccccccccggtttttggatcagaactgaaatgtttgattttataaatttgaataggggcccaaaatagagttccctattcccccata

SEQ ID NO: 602538 - DNA, 115 bp, Homo sapiens
tacaggcagcacattaatggaagatagatggtagcgtggccaccgtgcggcctcccgcatcgctcaccccgtccaaacactcgacccaccacttcattttcaccggcggctgctc

SEQ ID NO: 602539 - DNA, 125 bp, Homo sapiens
tagaggaccttagcggcctgccttttttgtatttcagtagagatagggtttgcatgtaggccaggctggtctcgacatcctgacctcaggtgatccctgccacctcggctacccaaaagtggctg

SEQ ID NO: 602540 - DNA, 721 bp, Homo sapiens
cgcccgggcgcggccgggcccgtggcctgggggcggggcgggaagacggcggccgggagtgtattcagttccgcctccaatcgcccattcccctcttcccctcccagccccctccatcccatcggaagaggaaggaacaaaaggtcccggagccaccccggatcgtgacaggggcgggacctgggccacttggaggttcgatagagaggtgttacctagcgtggttgctgccttgtggtaagaacatgtcgtccatcttgccattcacgccgcagttgtgaagagactgctgggatggaagaagtcagctggctgggtctggaggagcaggcggaggacgagcagaatgggcacggaagaaacagtggtgtgcagaaagcagtgacacagtctggtgcaagacgctaacagacaacaggacgattagatgagcttgagaaagccatcaccactcaaacactgtaaatactaactgtgttaccagtaccacgcacttgctctgacaatatggggactgagtacaccaaatacgatagatcagctggggataccacagggctttacagctactctgaaacaaaccagggtcacttgaatggtcgtctccgaggtaatcccacttcgcaaagggattgccacgctgttatattattgccgatcatggggctgggcatgaactacagcatcatcatgaaactcaacgaaactcgacaaccgcgat

SEQ ID NO: 602541 - DNA, 892 bp, Homo sapiens
  misc_feature (627)..(627): n is a, c, g, or t
gggcctggagcttccggtaccggccgaggtgtgggtcgcctccagagatcctgtgccttcaaagccctacgagtccatactttaaaacaaattgaagaaagtaaggctaaggggaactagagagtcgcctgcaacaagtggagtggatttgaaaagcccaagctagttctggaacagtatcctacgaggccgcatattgcagtatgtatgtgcttatacaatccataacactgatgaatgactttgaaaataaagtcgttgcatgatctaggatgtggttgtggagtacttagcaatcggaactgcaatgttaggagcagggttgtgtgtgggattttgacatagatgaagacgcatggggaaatatttaataggaatgcagaagagttttgagttaacaaatatgtgacatggttcaatgtgatgtgtgcttattatctaacagaatgtccaagtcattcgatacagtaattatgaatcctcccttgggggaccaaaaataataaagggacagatatggcttttctaaagactggttggaatgggaagaacagcagtatattccttaacaaattctcaatagagaacatgttccaaagaaggtggggcaaggcgaaatccggatgnattttttgcgggactggtataacggcggccttacaagggtttttccaacgaaaacacgggcgtggaggggcgcaatcgggtgcttttaaaacggacgcataaggttttttaaaaaaaaaaaaaaagtggtgcggggggggcgaaaataaaaaaaggggggagggagaagagaaattacagcatggtgtaaccagccgggcacattgttttgcttccctctttttgtgccgttaataataagaataataaaaaaaggaacaaagaa

SEQ ID NO: 602542 - DNA, 90 bp, Homo sapiens
gggggggggggcccccttccccttttttgggggatggggggggtccccccccgggcccccttttttccttttttgtttttgggggcccca

SEQ ID NO: 602543 - DNA, 1114 bp, Homo sapiens
tctggcgatgacctgtgagatcccagttgtggtgcgacagtgtctctcctgtaccccgtgcctgtgctcctggatgattcgctaagacgactaggttcgtgccttggcagcgtgcttagtgcctacactggatgtcagagacatgaggctgctgtgcccgaaggtaaccctctgcgtctgagaaagaggggttgtcattggagactcagaggagaaggcgtggagctcagctcgtgcttcttgaatgcccagggatggtcgtggatgcctggtggtgcccaatggagcctcatgaatccatctgccaagtgcagcaccaggtaacccagagagctcgaaatgtggcatggacagactgaagcagcacggagcagccagcagccgtgtgtggaaggctatagccaggaggctgaccgtcatcttctcgcgggcagactacgtgtaggtaccatgaagtgacctctcaggtagacaacttggcagaaaagcggcctcagtgaggaacttcaaacagatgtctgggcctctccagggttcaggggaagccccgggcttggggctcgaggccttgggcagctgcctttgggatgaatactagcgctaaagaactttggacgaagaaggtggctggacacagtatgtcctggctaggagaaggcctctaggactctaccaaaagctgagtgacagtatccaagaccaatcctatagcaagccagtctctacattgggcgactcttggccagcagcgcatggcaggttgctcttgtgagagtgaaccagttgagatggcctgactagctggcctgtctgtgccctgggtggcagacatgggtcaccaaggcaagaactgggtacgcaacaccagagagcgaatggagcaacccacacttgtagccaagcaaacgagccccgagaggcccacatcaaaaaatcccacaaagacagcaggtaggaagccaagagaacaggaggagcaccagacgcgacagcaagtaggagaagacagaaccgatggaacaaacggatgagaccgatagagaaacgatcagaatgcgagtaaagaacatacacatcgtcgcccgccgcgtcgtcccgctgtgcgaaaaaaaga

SEQ ID NO: 602544 - DNA, 338 bp, Homo sapiens
gctcctccggtgtacactagggttatgttattcagacttggcaccatgatctaccagagtttacaatgcaaaatgagaaaagagaggatgtactataaataatgttgtccatgtgtttgtgtggagcgtgagtggagcatgtagattttgagattaaatctcttgatgaacagtgtgtggttggtaaaatttccaagcactggactggaattttgagagaggcatttacagacgctgataactttggaatccagttccctttagaccttgatgttcaaatgaaagctgtaatgattggtgcctgtttcctcattgacttcatgttttttgaaagcact

SEQ ID NO: 602545 - DNA, 548 bp, Homo sapiens
cgcaccatcgccatggcccacggtgctgctcgattggctcggctactagaccaaacaaaccagcgcctcgtcgagcaaatcatctttgacggcatccgtcgaccagcgtcactggcacctgtttctagggttactaggaaccacgctagatgacccatgaccataaacgccgatacgtcgactgccaagtcaagtcaaggtcctcggaacaacccatgtctggacacacgcccgcgaccaccctgtgcggtgccgactttatctggcacgacatagggcctagaaaaccttattgccgacaatacgccacggttcgaaataacgacctggtgcggctaagatttatgagcatcgagccagcgcacggggtgccaataacgcagatcgaaggcgatgatcgccataaaccaggtcggcctgggcaagttccagtatggtggatgtcccagcgaagccgtgatgtaggcggccgtagaccgctccgtgcgcctgaaggaaaccgtggtgtactatggttgggcaacgaacccgatgaacgtcaatgtggc

SEQ ID NO: 602546 - DNA, 580 bp, Homo sapiens
  misc_feature (428)..(428): n is a, c, g, or t
  misc_feature (462)..(462): n is a, c, g, or t
caaagttgagttttaactgtgctaaagccactcaagcaaaaaaagttgataaacacacgtctgcggttcctttacaacccccacgataaaaaaattatttgtgggaaaaaaatgttttcttacattagatgtaacaatattgtctgggcgcggtggatcacacctatgatcccagcactttgggagcctgaggcgggtggatcacttgagctcaggagatcaagaccagcctggtcaacatggtgaaaccctgactctgctaaagaaaaatccaaaagttagccgggcatggtggcaggcacctgtagtcctagctactcaggagggtgaggcaggagaatcactgaacctggtaggtataatgaaggacgcttcatcatacctacctttagcaataacgatgtgagtttgagaagcatttctgagcnaacttgctgagtacacagtggctctctgcctggncattactgtggacattttgtctgtatcttactagagcactacaaggtcctgaagatggtggtaggtatgggtaggacgggtaggtatgataaaggacgggtaggtatgatgaaggacg

SEQ ID NO: 602547 - DNA, 352 bp, Homo sapiens
aactttccgtcaactaacactgtgcctcctctgtggaaatgcaccaaacccttgctcataggctaacacatactaaccttcccaagatctctacaatgcaagtagaattactgccctcatataaatagataagcaaactaaggctcggagaagttcaggtactatcaagatcacacaactagcaagtgcagaaactgtggtacctatgcatggtcatagttactgtttttataatagttatttaacttccttggaggccaaaagcttggcaatagctagagtctggggcctgagtgaagtggcaagagaggatattagggtgccaggaaagaggaagggtgttcttaaacca

SEQ ID NO: 602548 - DNA, 361 bp, Homo sapiens
  misc_feature (36)..(36): n is a, c, g, or t
  misc_feature (66)..(66): n is a, c, g, or t
  misc_feature (327)..(327): n is a, c, g, or t
aaactatgtagggaccatgtgggattcatacatggnctggcaccctgtccctgttttgggaatgtnagtaggacagtggttctctaccctcaaaatgactgttggtctggtctgttcatgttcagaaggtagccataggcttcatcttagagctggaaccctttgaatgagtggtaggctccctttcctgtttgtatctttgggttcacataaagtatagacctactttagaactcaaattggtggcggaactagctccttaaaacgcagctggttagcacattgcctcatcctaacaggcctctgcttcccctatgtccccttcgnttatattagctgccctgtgcccattctatcatgt

SEQ ID NO: 602549 - DNA, 398 bp, Homo sapiens
agggaggacgacttatcaactacgagatgagtaagcggccatctgcatagcggtacaaggaccagctcttgaaagagacagtgctccagccactgctgcagccacagatcatgtcagcatgagtagtcgtgctgaagggaaaacacagaatgctatcttaatgaccatgccaacattattgaatagccgagagtccctaaacccactctctgctgccttatcaatgctaaaccttatttgtcttcatcaagagtagttcaaaatatgcaactaatttaataattttgaatgatggttttatctatagcaatctgtagtaatatgtatattatctattgggatttgtgtaataaaaaatctaagggaacaaaattttataactacaagcacttaagtac

SEQ ID NO: 602550 - DNA, 266 bp, Homo sapiens
ggtcggaccctttgtaaatgaaggagatataaggtaattccaggagaagcaaatgctaagggaatttgtttgttaccactagactgcagccacaagaaatgctccgaggagtcctaaacctgaaaacagaggatgacatttaccatcatgaaaacacacaagagtgtaagattcactagtaaagcaatcacacaaagaggagaaagggctaatatggtagcacgacagaaattctccaacccccagtatttaggggaaaaaaaaaa

SEQ ID NO: 602551 - DNA, 1074 bp, Homo sapiens
tctgcttccaaagtctcaaacaagcagcccatagagttagatgatagtcaagttgactgggtctgtccagtgctagacgtacagtaagcatgcgcgcatctggtgcttgattaggtctgctggtataaagtagcatgaagagtccatccacgccaggttacgtccatgtgataggagaacgagcagtgcactatatctagtattcgaagaaccagtgtagccatcaagctggtgcagatgactaatagtcgtagtgctaatcaacgatagtgcgatgccattgaccagagggatcctgaatagctcacagggaaaaccagaaataccgggtatatgtcgtgataccagttctgccagggttcgaaggcatacattgtcaacgcggcggatggaaagtggtctacagtgcaatcatgtcagttcaagtagagaaccatgtgcgagaggagaaaattaccatcgcttgtgactagttaaaagcagagggttgggaatcagtggataagattacgtatcatacgggggtcttagaaaacatgcagagctcgaaggaaagctaggtcactgaggttatctatggtccacaggaaggttggtagattgctggtgataacactgtcattataggctctgtcgaaatcagtgatcgcaataaggtggagaaaagcgtgacagtgaaaatgtgtgtcacttgtggcagattacagtggactggtccgttagtaatgggtggaaacgaagtaacaagttgacgcgttgcgcaggaatttggtaaagggattagggcagacgcggggcatcttggagagcccagggagaacatcatggacacacgggggtgcaaaactacaggagggggggtgacacaaagagggccagcgcacaaaagaaaggcaggggaccggaggagcacaacaagaagaaaaacaatactcccggcgaggattaaaaagcccgataaaaaagaaggccccaaagtagggaacagaaacacactcgaacgcgacatttagcaagcagcgcgaggagacggcgaccagaaggagagaaacgaacgacacggggtagacggtg

SEQ ID NO: 602552 - DNA, 93 bp, Homo sapiens
tcaagcttctaacgatgtacggggacatgttcatgccctgattttatatacttgtatctatcaataaacattgtgatacttgaaaaaaaaaaa

SEQ ID NO: 602553 - DNA, 190 bp, Homo sapiens
ctgacagaattgggacacttctctgcatgtgggcacgagccctgcggtagcttcacacagaagacatcgacgcttgggggtaacccacccatgtcaatgtgtctgtagtcatgcggaggtgacggcacctgtactgagcctgcctggtgtacccaattgtcgggtacccgagctccgaaattcgtaaatc

SEQ ID NO: 602554 - DNA, 148 bp, Homo sapiens
  misc_feature (57)..(57): n is a, c, g, or t
atgctgcgcgatggttccataatgtgcgcgtagggcctgccggcctagtgtgcgtanacgaataagcttggtatttttctctctactactcgctgaacgtcatgctatgttcatgcgttaactttcagtgagtagtagagagaaaaat

SEQ ID NO: 602555 - DNA, 495 bp, Homo sapiens
tcagtgatctgaggttaaaaccagactatggaggattcatcaacagaccaggaagcaacagcctgggctccagaattgaccagtagtccgtgcacagacgaggagaggtcccatgaaacttcggcgcagtctgggaaccgagctctttttgtaacaagttgtttgtcaggaggcccggtcatgaaagcccttcctgactgggctcaaggaatacaaaaaggacaacttgtttttgccattgtctgttgtttttcaataactagttctccgaaacagcactggatgaatgcctcaaggggctcacacaactcgttccaggacttagtgaccattgtttctgtccctgttcaatagagttcaaatttaatatttaaattttgctccacaatgtgccatattatctgtatccaacctgtcattgggcatttaggttgattccatgtctttactattgtgaataatgctgcaataaacatttacgtgcttgtgtcttta

SEQ ID NO: 602556 - DNA, 797 bp, Homo sapiens
  misc_feature (43)..(43): n is a, c, g, or t
  misc_feature (95)..(96): n is a, c, g, or t
  misc_feature (162)..(163): n is a, c, g, or t
  misc_feature (215)..(215): n is a, c, g, or t
  misc_feature (250)..(250): n is a, c, g, or t
  misc_feature (483)..(483): n is a, c, g, or t
  misc_feature (691)..(691): n is a, c, g, or t
  misc_feature (762)..(762): n is a, c, g, or t
  misc_feature (792)..(792): n is a, c, g, or t
gagctcccagagggcctgagacgagcaatgaaggactgtgcanagcagatgcaggtgctctggcccaggtccagaactcagagcagctgctcganncctgcaaaggaccgtgagccaggcccagaagcgggtgcagctgcagatggtgagtacctggggccnntagggcaggagggcgaggagtccagcaggaatcagttgcacatggtggaagngggcacgtgggaagtcaaggaacctgtcctgtccncagctgctcaggccacaccctggaaccggtgccaggtaggtaagagggttttggggcagctggtgccgtggccagaacagggcccctgcagccacacagagctgtttgatcttgagctgatcccagactcccagcctctgcctcaccatctataaaactgacataatgggccctagtttgcagagtcatgaggattaaaatcaaatctgactgggattacaggcgtacacctngagcccggcctcctgttttttttttttttaagaaatggtgtgttgctctgtcgctcaggctggccaggctggagtgcagtggtgcaatcagagctcactgaagcctcaactttctgggctcaagcaatcctgcagcctcaccctcctgagtagctgggactacaggctcacaccaccatgcccagctaatttgtaaatttttttgtangagtcggggtctcactatgttgcccagggttgggtctcaaactcctgggcctcaagtgaccctccccccantgggcctccatggacttttttcaaaaaaantaaag

SEQ ID NO: 602557 - DNA, 730 bp, Homo sapiens
  misc_feature (43)..(43): n is a, c, g, or t
  misc_feature (95)..(96): n is a, c, g, or t
  misc_feature (162)..(163): n is a, c, g, or t
  misc_feature (215)..(215): n is a, c, g, or t
  misc_feature (250)..(250): n is a, c, g, or t
gagctcccagagggcctgagacgagcaatgaaggactgtgcanagcagatgcaggtgctctggcccaggtccagaactcagagcagctgctcganncctgcaaaggaccgtgagccaggcccagaagcgggtgcagctgcagatggtgagtacctggggccnntagggcaggagggcgaggagtccagcaggaatcagttgcacatggtggaagngggcacgtgggaagtcaaggaacctgtcctgtccncagctgctcaggccacaccctggaaccggtgccaggtaggtaagagggttttggggcagctggtgccgtggccagaacagggcccctgcagccacacagagctgtttgatcttgagctgatcccagactcccagcctctgcctcaccatctataaaactgacataatgggccctagtttgcagagtcatgaggattaaaatcaaatctgactgggcgaggtgactcatacctgtaatcctagcactttgggaggcctaggcggttggatcacctgaggtcaggagttcgagcctggccaacacagggaaaccccatctctactaagaatacaaaaattagccgggcatggtggtgggcgcctataatcccagctacttggctgggcaggataatcgcttgaacccaggggacagaggttgtagtgagccgagatcacgccattgcacttcagcctgggtgaaagcaaaactgtctcaaag

SEQ ID NO: 602558 - DNA, 289 bp, Homo sapiens
gcacgaggatgaccagacttcaggggaagataatcttgctcaatatccttttctgctccccttcctgctgagagtcactttgattggcaataaaatatctcacatttaccatcttcaatttgttcttgcaacctcattcctcctggatgccagacaagaactcaggtgccatgagtatgggtgcaaaaggctatcacactgtccctccactgagctgttaacacttaagctatccatggacagcaaagctaaaagggcactgtaagagtccttctggggtttcagaagt

SEQ ID NO: 602559 - DNA, 444 bp, Homo sapiens
  misc_feature (432)..(432): n is a, c, g, or t
tctcaggggacggattacatatatacacacacacacacacacacacacacacacacacacacacacaccacgcacatatgtggggccaggcacagtggctcacacctgtaatctcagtttttgggaggctgaggcaggaggactgcttgagcccaagagtttgagaccagcctacgcaacatagtgaggcccagtctctactaataatttaaaaattagccaggcgtggtggtgcacacctgtggtcccagctactcagaaggctgaggatggaggatcgcttgagcccatgaggcagagtctgcagtgacgcatgatcgtgccactgcattccagcctgagcaacagagagacactccatctcaacgaacaaatatatacatgtatgtggggagtatattggatatatcacattgtacctcatatattacnttatatactaca

SEQ ID NO: 602560 - DNA, 328 bp, Homo sapiens
actctgtgtatatttgaatatacttgtgcaaaagagtcgtttgttgtgattaactctgcacacatctttctgtcctgaaaactctcattcttttctttattttatgtgctttacaaatgacatggaacactttgtaattactcagtaaatctgtgctatcgtatgaaaaaaagttcaacattcaaatctggtttttatttaatcatgtgtacctgtgtttgtctttgttttctgtttttgttttcgttgttcttgttacaacatagattctagcttttgagtgggtttttgtgcttacaagccaagtgcttggctgcctggtcgacgc

SEQ ID NO: 602561 - DNA, 304 bp, Homo sapiens
acataccctccagcgcagcttggcctcagtgtcccccgcagtccctgcattcttgtcaactcctccaacttgctgatcagcctcccccacggcctgcagctcctgtcctccccacaaacactgtgtcctcggctgagcctggccccgcatgttagtgcatcgccatctcctggtgactacgaacactccagcgcatatggcttcagtgtcccctacagtccctgagatcttgaacactcctccaactgcagatcagcctcccccacggcctgcagctcctgtcctccccacaaacgctgtgtcc

SEQ ID NO: 602562 - DNA, 252 bp, Homo sapiens
agacttgggggttcctggtgtgtgaggggtcctgggatagctaggggttttccaggagttgtcctttgttgtttgtcgtgaagaattatactttgtgtgtgtgtgggttgtcccatgtgtatgcgtgtagtgtgacagtatatgacccccagtgtgtgcatatgtttgtgtggttgtctctgagtgatatccacctctctctccccctctgtctctctgcagagatatgtgtggcgtcactgtactcttgtg

SEQ ID NO: 602563 - DNA, 333 bp, Homo sapiens
ctgcaggtcgactctagaggatccccgacaaacaaatggtgcatttatatgaagtcttggttttaagtcagtatcaaattctttatcccaaatttgaccatttggataaactggtggtacattatttaatgcagttaaaggaccataagtattaaatatattagtatagttaattcctgttttacctccaattggatctgttggtagcaatacattatcatttgttacaggaaggttaaagttaatattctgaatccaatctccttctggatatcttcctgtatcttgatgtgctatatatgtaaatctctcaggttgtttctcctgttgtag

SEQ ID NO: 602564 - DNA, 1268 bp, Homo sapiens
ggcccaatcctttgcagcacgaatgagcggtcagcgtagtgccatatgcacactgcaccctggggctgacagacttgtgccccctagccttcatgcatgcccaatgcactggcatgctttgcatgcccctgccccaccatgccccttgaccgctcttctttttgttctctcctcgtgtggatgactgctctgctgctgagtacgtgtgacgctttttgcttgcttgggatgtgctctactgcatggacttttttttggttgcacccatcaccatgctacagtgtgcttgcagtgcattgtgtgcacaccagtgtgcaccatgcagtgtgctcttgtgcctcatcgccttcagcacagccactatcccatcccattcctttcacctcaccccaaaactgtgtgcatcccccttccaccattcttccatacaccccagtcacagcattgccacatgcacaccatgtgcacatccatcttgcagcagccacatgccatgcccctgctcccatgtggtgcccccatgtgtcattgttgtcaggcaagtgccccagttgggtgtgttggcccactttggctggtttctaaccaacccccgtggctccatccccaagtcttggcccccccaagtgaaaccttacacctttgtgggccagaggtactagggttaggtcaccttcttgtgccttttcaacaaggttcaccttttccccatttgccgtttatcaatgttcgcaagttgcctttgcaagttttcccccccaaccgatggcgccacgcggtgtgggcccatggtggcaacacatttgcacacggtgttggccaacttttccatgcatttggccaattacccccttttggcccaatgtggacactttacaccaatcgccactgtttgggagttatgtggccccgttagctctaccaatgatgcccccccaatgagtcaatctcgcagccaattggccctttttttccgccccccaaaggggcccgcagtgtgactgacaggacacccacaacgctttaacatcgtgtggcagttccagcaccagtggtgccaatggcgcatccccttggaattagagaacgccgttagagggcatacccctttggttgggacccacccgtttcctggacagcgtccatttggcaaggcccccactgagccgccccgtttcacaagtgggaacaattgttggctcgtttccaacagacactggcattgaccacatcaatgcaaccagtacctagcagaggtgttcccttac

SEQ ID NO: 602565 - DNA, 825 bp, Homo sapiens
gaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcaagcacaaaggcttgaactggcgaaggtcaggaatggcccatatttttcggcaaggtggtcccttaaaccaaattacaggtcacgagaagtgtctagaggccagtatcccaaaagctcttccacgtcacgtgttctttccacccattctccctgtgcatcttgagcagttatccaactaggatctggcaagtggatactgcggtgccaatcccctgagaaaagactgagccaggaactacaagctcccaccagattcctcccagcctggacctaattctagagaggggctctctcattcacggactgtgtctggaacttgagcaggcttctgcacccttgcgtaggctctttgcattgacacgcatcaggtggggcgattcagagcctggagtaagtgcgccagaatactaccgagagccaaagtacgagcctggaaagcccaaaaccgacgagcctctactgcatgccaggagtacatcctggggacagtggtcacacccagagaagtgggactcatggaccaatggaactaagcc

SEQ ID NO: 602566 - DNA, 293 bp, Homo sapiens
gaagccctggaggctgcctgaatttgtgccaataagtacatgatgaaaagttgcggcgaggatggctttcatatccaagtgcggctccaccccttccacgttatgcacatcaacaagacgtcctgtgctgggctgacaggctccaaacaggtatatgaggtgcctttgaaagcccagggcactttggccagggttcacattggtcacgggaatccggggcccatcgggaccaaggttcaagacaaggggcattttatttgggcctcacaggcaaaggcaaaggttcctggcac

SEQ ID NO: 602567 - DNA, 1037 bp, Homo sapiens
  misc_feature (375)..(375): n is a, c, g, or t
  misc_feature (674)..(674): n is a, c, g, or t
tccacgtcataagtttatggacaagacatatctcagtatggcatatgagtcctagcttggactccactttccagaaggctgccaccctcttaaaagtgctctgtcaatatctgtctaaagtggagggaacgtgaaacatccttagtgtttacaaccagtggggtgtctatactagcaaggaagggtgtagcaaagtgcatactccaaagttacaagatcgacattcttatagccgtagttaagcgaccgagttgggttgtaccagtgtgaaacagagtggcgagaatttctttccgcagggccgctccgtcgataggtgggctccatagggaccactgagaaggttcgggtgaacccgtccggagtgctcgtggncccagacaaataccgccgtgcgtggacaagtcatcgtgcgataagagcggcgccagagagagaaagtggcaggcacgagaagtgaaagagtgggcgagacaccttcaacgctagagaaaccttgtctgtgatatctcggcccgaggttcccccggcgcgggaacatcgaggcaagaacccataggcggggtgtcgcgaggagtgggggcacaggtaaagctgggtggacacccggggcgagtttcctggccgtcctaccagtgctgcgaagtgttaggcccatggcgcgcgcgaagccncgagtgggtcctcgttcggcgcgcatgcgcggtagtttgcagtttgacaattggttgggcccagactgttgacagggtcgtaacgaagtttccgacagatatctccatctcaaggcattacaggagacacaagaaagacttctaagcgcaaatgccagttgatgagttttcaccccgcggcgtcacgcagccctgttgggaaaccacttcagtggccgcggctgacagggggggaatacctaccccccagggggtcccaaccgcggggggatccccgtttgtgtcagaggacttgacattgaggtataacaggccgtgcagaacacggatggaatgtttccacatcctaagggaaacacgaca

SEQ ID NO: 602568 - DNA, 247 bp, Homo sapiens
tctagaggatcccgctgctgctactatacacggggtgatgatctcactgatgcttgaaccatgctcttggacttcctagcctctggacccaagagccaaataaacttctgttcattataaatatgcccagtcttgtgatatacttgttaaatgcagcgagcaaaatgaacttgacgacacacagatcatatgttgtttcagagtagttgaaatgtagctacaacgaatgaacttgcaaattggtgtg

SEQ ID NO: 602569 - DNA, 108 bp, Homo sapiens
gagggactcaggtagttgggggctcagagaagaggtgatgggaactgatggcactgggacttaggcaaacaaccaatgactggccaaacctggtggatgccaggtctc

SEQ ID NO: 602570 - DNA, 104 bp, Homo sapiens
tttatatcgcctagttctagagcagcctccaccacgttggagtcttacaatttcggtctataagttgaagttcgtcttaatcattaactttcggatagctagcc

SEQ ID NO: 602571 - DNA, 322 bp, Homo sapiens
cccccccctctttttcccaaagtttcctttttggggggggggggttcccaaaaaaattttaaaaagggggtttttccccccccccaaaacccagccaggggatttgcccattttgggtttaaaagtttttgcccctttcccccccaaaaaacccaaaaaaggcccccctatttttatgggaacgcccggaatattttttgcggcccaattttttccaggaggggggcccccctttttttattgtaaggggcccggggccccccttttttttgggtacccctttcccccccctaaaaaagggaattaaaaaaatttttgggta

SEQ ID NO: 602572 - DNA, 367 bp, Homo sapiens
cagaaactggaggagacaggctaatataatacggactctccctgacgatcctgtctgtgctcaccccatggaatccatcttgccaggaccaaagccacctctgtccacaacacccggccccctcggaagcctccatcggtccccgccgcggacccgtgtagccgcctcgatcatcgcctcctctgccaccacgacgatcatccccgtagttaccccccatgtgagagccacctggatcccccatcgtgggccatctggtttaggggccttacactggttgcatacattcctccaagagaagttcatattctcacaggtgggattaggacactatccagtcaccagctcgctgctgtcctccaccgcc

SEQ ID NO: 602573 - DNA, 1580 bp, Homo sapiens
cgcagggcgcaggcgcgctgttggtggtgcgcgcctgctgcgcgttgtccgctcgtctgggtgggcgcgtctctgcgcctcggccccgtgtttgttgcccgctcccgatcttgagtggagctcctccccgggggcgccagttgtttctacttgcttctcgctggtgtctttttagtgccgtttagggctcccgcggggggctgccgggtgtatcacccaggtgttgtccaccagccaggggttagcgccggtctttgagttgccccccctttgatgggcgccttactttttaggggggtggcccgacccttgtttgggtcgacccccatcggtgttgtgtgtacaccactaattagaattgccacactgggctctggtgtggtatcctcccgggttctccccggataatgttcccccccgcggtggtagtattttttgggtgcgcgagctcctcccacccgtgcggttttctcctctcccggcaggattcgccccgccttctggggggcgccccgggggatttgtgtgagttgccccggggcgtggtaagtgcctcggcttgagaaattggccacgcttgtgtagtcacccccatccaccgacttgtggagaccctcaagtgtgttgtcccccgggtacttgtcccaccggcgggttgatgaccccccctcttctcctcggtgtaatattttgataaaacagaagatggtgtattataaaaaaaatattgcgccggcgggaagagaaaacctcttcgtaatagaatatgtaaaaaagggcccccaactcgtggagaagggcccacccgcacttctcgcagcatgtgagttgtcactctctgaatatattatatatctcgctcatcccaccggctgatgttgtgtggtggagtgccgcactactgtgtcacagatagacactcctgtgttgtgggccaccgccccaacacacccacagacccacagtgtggcacacccctctctcacccacacacacctctggcgagaataaatatgagagagacccacacgagaactctctgagtgtgctctcactctgagagagtttgatattttctcacacccctcttgtcccgcgcacacataaatacccacataatagtttccacagagagggctcttgtgagaaaaaatagtatcgtgggtgattatctctcacacccacacactattgacacacactctctcacactattctctatattgtgtgtgaccacatctgagaagagagaggagagagaaaacccacacatataattccacagagagaatatacctctcaatatttctctccacgtatagagagaggtgcactccacggtgttgtcttctcggaaaaattcttccttcgagaaataaatgagatatttaccacgaaagtccacaaaagaataatatttaactcttcttcacccaagaagaaagtattcgggaccacattatattggaatgctattcacatttgtatagaaatgtccacccacaaagaatgttttatattaaatgtcccgaaatatttacccaaattttccagcctttaagaaaaccttgattttccca

SEQ ID NO: 602574 - DNA, 279 bp, Homo sapiens
tttttttttatttaaaaaactttattttgctttaaaaaaacaattatcaattcatgaagattaaccaaaatacaaaccccatcaaagtttattacaataactttcataaaatagcattaaaaaaagttaatattttaatgtaaaatcacaatgtaaaataaaactttgtttagtgactaaataaagctagataataacttcttcacagggaaaaatacttgagggaaaaacatggtatacatgtgtaagcaggaattaatatcagcttagttcctcatt

SEQ ID NO: 602575 - DNA, 177 bp, Homo sapiens
tgcaaatatgtgtggaataattcatccacattcctgtcttttttccccgtactgccgtcttatgtagatactgagaatattaaacctgtactcttttcattagctacataagcacccattatgtatgtccagctgtataatatgggttggagggttaggtctgcaataatcatgtta

SEQ ID NO: 602576 - DNA, 1114 bp, Homo sapiens
  misc_feature (311)..(311): n is a, c, g, or t
aagatctggaagaagctaccacagcgtcccctctgaatgctgaggagcatagcagagtgaatgcaagatgtcgttagtataactttgtttattcgctatgcgttataattggtaatccaaattaaacgcaatagcatcactaatatttcaccaagagtaaatgcatatatttgcatcttgcagttcataatttgtaggtgtgtctcaaactcagtctaatgatttctatataatgttctagttaatccagcgtccagcacatcaggtcaccttctggaaggaaagctggaactagatcacatttcggtttnctgagacagcgctgggacccgcgagctgtggtaaatgtagacagcattcgtgtcattagggctggttttcccttatgtgatggattccctgggatcacttgagcataacgtacgctgggagcatattctaagccacacgtaaatataaataggccacaggtacggacagagccgcagaggccgtttctagaaaatcaaaaaatactccgagaggtgtgaaaggtttttcatgaacgaggtctatataaactttgtgtaatgcttattacaaacgatggatggtgcgcaagagttccgaaggcctccgatttcttgcaaagagtctgaactgctcctcgggaccattgggacgagggaattttaaacacacccctgcacactcggtcgcgactttctaccacagcacggaaacagccttggcaaaaccattccccaattggagccgggccagcggcgcaccgcaaaattcggccgttgccatcttctaagacagggccctaaggtttaaaaccggacattttcttaatcttaagagactcggccatgcaagcgcgaataacacatttggcgccacaacacgcaattttcaaacttttggggagggaaaggttggggatgcaagaggacttcgcaacaaacccaaaattattcggggcgacgaacaggcaactcaggcaaaggtttttcgccagaaggtttggcggaaacaaaccgttgggcgaaaggaaaccaaggaataagcttcaacggggggaaagcggcgcaaacagcaaacaagacacttacggacgcacacgcatcag

SEQ ID NO: 602577 - DNA, 846 bp, Homo sapiens
  misc_feature (18)..(18): n is a, c, g, or t
  misc_feature (63)..(63): n is a, c, g, or t
  misc_feature (105)..(105): n is a, c, g, or t
  misc_feature (114)..(114): n is a, c, g, or t
  misc_feature (116)..(116): n is a, c, g, or t
  misc_feature (136)..(137): n is a, c, g, or t
  misc_feature (147)..(147): n is a, c, g, or t
  misc_feature (163)..(164): n is a, c, g, or t
  misc_feature (167)..(168): n is a, c, g, or t
  misc_feature (172)..(172): n is a, c, g, or t
  misc_feature (202)..(202): n is a, c, g, or t
  misc_feature (204)..(204): n is a, c, g, or t
  misc_feature (282)..(282): n is a, c, g, or t
  misc_feature (289)..(289): n is a, c, g, or t
  misc_feature (304)..(304): n is a, c, g, or t
  misc_feature (321)..(321): n is a, c, g, or t
  misc_feature (348)..(348): n is a, c, g, or t
  misc_feature (362)..(362): n is a, c, g, or t
  misc_feature (379)..(379): n is a, c, g, or t
  misc_feature (384)..(385): n is a, c, g, or t
  misc_feature (420)..(420): n is a, c, g, or t
  misc_feature (447)..(447): n is a, c, g, or t
  misc_feature (449)..(449): n is a, c, g, or t
  misc_feature (460)..(460): n is a, c, g, or t
  misc_feature (476)..(476): n is a, c, g, or t
  misc_feature (485)..(485): n is a, c, g, or t
  misc_feature (490)..(490): n is a, c, g, or t
  misc_feature (512)..(512): n is a, c, g, or t
  misc_feature (528)..(528): n is a, c, g, or t
  misc_feature (580)..(580): n is a, c, g, or t
  misc_feature (700)..(700): n is a, c, g, or t
  misc_feature (705)..(705): n is a, c, g, or t
  misc_feature (749)..(749): n is a, c, g, or t
  misc_feature (801)..(801): n is a, c, g, or t
gggggtaaacaaataagnaattgtgaccaccaaattcttattacattcaagataaaagttttnttcacaccacaaaaagataatcacaacaaaatatacactaanttaaaaaananaagattatagtgacataaanngttatattcnctttttaggggggtannggnntttngtttgggtctacataaatttctattcatgngngaataacaaatattaaaatacagtgatagtttgcatttcttctatagaatgaacatagacataaccctgaagcttttngtttacngggggtttccatgangccacaaactaaactanttatcaaacacatcagttatttccagnctcaaatagatacncattcaaccaataaacnggganngaggcatttcatgttctctttcattttgctataangcattttttcttttgcctaaatgcaangngggaaattgtnttttttctccttttanttggcctcngaggntgccctatctaattcatggganatacgaaatttcgggngtttatcttcttccttacttttggggtctacaaccagcatatcttcatggcngtgaaattcatggctgtggaattcacggctgactttggaaagttcctgactatcaatcacatcggaatgctcattgctctcatcattagctttccgcttatataatctggactgcttgtngctgngggtttcagcactctggtcatccagctgactcgtttcataactntccttcccacggctgtcccaatcagaaggcgcgttcaggtcctgggcaacgnggatggccttgtatgcaccattcaactcctcgctttccatgtgtg

SEQ ID NO: 602578 - DNA, 441 bp, Homo sapiens
  misc_feature (76)..(76): n is a, c, g, or t
  misc_feature (262)..(262): n is a, c, g, or t
  misc_feature (282)..(282): n is a, c, g, or t
  misc_feature (362)..(362): n is a, c, g, or t
  misc_feature (386)..(386): n is a, c, g, or t
  misc_feature (419)..(419): n is a, c, g, or t
  misc_feature (425)..(425): n is a, c, g, or t
attgaaaatattattctggagacttgtagccaggaaaaattgtaggattcagtccaaattgtaaaaaatataaaanttgaaaaatcctggacaaggctacaatctaataacaagtctattatagtttttcttgagacataatttttctctttccaattccccaattttgttagagacaaaatcatagtaggaccaatttatttgtaaaattacgttttagtttaatgatagttagcttgattatttgcataaagtgcagcangaattatctggccgtatagnttttaaaaaaatttttgcttggctgggaaactttgttcataaggattctaagatttagacctttccaaaaggcttggagncccagccaagggttttatttgtgncctgcaggataccggtaatgaattgggtggacngccgcnctttttcgagggtccc

SEQ ID NO: 602579 - DNA, 161 bp, Homo sapiens
  misc_feature (23)..(23): n is a, c, g, or t
taatgtcggtacctaaagcaacnccgactgcatgtgatgagggttctgagcttgtacttgttgggcagctctgcctacctctacttcacacctcagctgcaaacaccacacagcacaccccacaccacacacatacaccacatacacaaataccacaccag

SEQ ID NO: 602580 - DNA, 1118 bp, Homo sapiens
  misc_feature (786)..(786): n is a, c, g, or t
acatatcatggcgagtgtcgcaaacgataaagcagcccatgactcgcctaatgcgcccgagtgacagaaggaggagaaatagcaggcattgctcgtcagagaggttgctatacccataagcactcatttacatagttgcccctgtatatgaactagcatgtggacacatgcgtggtgtggttgtggaaatacactggatatgttaagcgaaaagatagtataggtatgagtcagaagaatctgtgagcgtgagtctgcctagatgttactagactacatgtgatgaatgacatattccgagagtgtcgtgtatcatactctattatgccactgtgcgtactgtgagtacacttaataatagacctcggatggtgcacttactcctaacttattatcactgggcatgtgatataagtagaccgtgatggtggggcagagcactcgagaaaacagaacaaaccagggggtagcggaacgactggtctcatgtctctacaattagtaaatacacacacgaatgcaagagcagcgacattctgtaactctcgaaataactgcgtattctcgagttagcatgtagcaagctatactgtggaccatttgattgggcccgtaattgctattatgcatggagctaacaccgctgaatttgcatcagtacgttgtcgtgacagactagataagtaaaagtggtctaagagacgctcacacgacagtggttgagtaacttgcaatgaggcacaatcactcgggagcgtactgcgaactccttcgtaaatactacangaggtatacagctttggtcgtcaccaccacttgatcagagagaaagtgcgttattagcaagaaagagcaagacgcgttgcaggaaccctgtcccgttcacatcaccggatgatcgtgggataggattataatcaagtacaccaatgcagtctaacactgttaaataaggaagccggtccaaacaactgcaaacattagcgtcgaggggcaaggcaagcagacttgttgattttcttcactatggaacattgggctcaagacaacgacaatcggggagttgaacaaagcttttacaaagcagacgatgcgtttaaatggtccactctatggaa

SEQ ID NO: 602581 - DNA, 130 bp, Homo sapiens
tcatagtacctatgaccataattagcaatatacttttagaggtgggcaagctgcatgacactatacagacaatgaactattatcaaaacaaaatgtataatttcttaattggaataataacttaagcgtt

SEQ ID NO: 602582 - DNA, 355 bp, Homo sapiens
  misc_feature (99)..(99): n is a, c, g, or t
  misc_feature (122)..(122): n is a, c, g, or t
  misc_feature (174)..(175): n is a, c, g, or t
  misc_feature (177)..(177): n is a, c, g, or t
  misc_feature (180)..(180): n is a, c, g, or t
  misc_feature (223)..(223): n is a, c, g, or t
ctttttccccatttaaaagcgggggcgggttcctaccccctgtttgtgttcataccccccccttagatagaagagctggaaggaggcattgtccacttncccccccagggagcaggacttgnggttgaggtgagtcatggccctcttgctggcaatggggtgggaggagtaccnncnccnagtcctctcactccctccagcctggaatgtgaagtgactcccncaacccctttggccatggcaggcaccttttggactgggctgccactgcttgggcagagtaaaaggtgccaggaggagcatgggtgtggaagtcctgtcagccaagaaataaaagtttacctcagagctgcaa

SEQ ID NO: 602583 - DNA, 606 bp, Homo sapiens
  misc_feature (4)..(4): n is a, c, g, or t
  misc_feature (21)..(21): n is a, c, g, or t
  misc_feature (25)..(25): n is a, c, g, or t
  misc_feature (51)..(52): n is a, c, g, or t
  misc_feature (60)..(60): n is a, c, g, or t
  misc_feature (66)..(66): n is a, c, g, or t
  misc_feature (76)..(76): n is a, c, g, or t
  misc_feature (117)..(117): n is a, c, g, or t
  misc_feature (119)..(119): n is a, c, g, or t
agtnacacaagagcgacgcancgcnagagcgtcaacccaccagaaagccanntagctagnctacangagccatagngaaggcccccgggaagtcgggcaaatggccggggagaaacnancagagacgggagagcttacaagcccccaggatatgagccgccaggaaacgagcggacggaaccagggcagcgtgagcacgaccggcaagcgcaagcgcgaggcgccggagagcgcagcgagccacagcggagccgagccaaggcccagcccagacaaggagagctgaagaacagacaagcgagacgcgtaacgacaaacgccaagcctggccacgcgaaacagatcaaagaacggacagcgagcgacaggggaccacagagagccaacacagaagccagcgcaaagcaagcggacggaagagagctctgtacggaacccaaggagaacgggccgcaacgagacgcgaagacgacacggcagagggccgacagccccaaagaacacgcatgccacagcaggagacaagaaccagtgaagacgacaccgacacatcaagctccagacgaacacaagcacgaacgcgggcacaagaaggcacagcccccc

SEQ ID NO: 602584 - DNA, 115 bp, Homo sapiens
  misc_feature (9)..(9): n is a, c, g, or t
gggaaaagntctcccttgttttaaatttcatgtcccgctgggttgttatagccttggtttttggggtgtgtttagttctttggttcctggtccttttttatcatttaggtggttg

SEQ ID NO: 602585 - DNA, 467 bp, Homo sapiens
gatactcatagacagccgccaataacgaagaaaggcgttatctcgaggaaaggatacactgcagtggaatatagtgaagactcccaacaaagtacatccctggaacaaagattatcttggacgacattaatacgagaggaagaaagggcaccctgaatagcttatctaccaagacgctaactaatgagtaaataatatggtcactagcctgataaattacaaaaccgaaatgtcccatgacttggctcatagtgtaccaacctataaatagatctcatacaccagaaatacagatcatgaatgactgacagactataaagtggaaacctcatcataaggccatttcagtcaaagtcctggaacattaaccagttcctccatcgctgtacccattataaaagaacacagattcttactgaactatatgcaatacaaaccacattgccacaaataaagcatattcacaa

SEQ ID NO: 602586 - DNA, 366 bp, Homo sapiens
  misc_feature (106)..(106): n is a, c, g, or t
  misc_feature (144)..(144): n is a, c, g, or t
  misc_feature (259)..(259): n is a, c, g, or t
gggggatcccaaagagtgggtaagaggagggggaatttgatccacaggccttccccagtgctgagggtgttggacaagagaatggtgctttgaaccccaatactcngtggccaaaggtggccgtggaggagcagacctgtaagnggggtttgcaacatgaattgtcctaaaggaatctatttccagagcttcaaactccatgtcattcctaaaactgcctgcaaacctgctttgggttcaggacccgatcacccctctntccactaaaaaaaaagaaagagaacaaccccccatctcagtaggatgcagtgccccgaggtggggcggatgggaggacaagattaaaacctccagggcaccaaacaa

SEQ ID NO: 602587 - DNA, 194 bp, Homo sapiens
agcctcagcagcatgacgaaaacctgtttctactaaaaatacaaaaaactagccgggtgtgaatggtgtgcacttatactcccagttgcttgggaggctgaggaaggaggacgacctgggcccaagaagttgaggctacagtgggccgagatcatgccattgcactccagcttgggtgacgggaatgagaccct

SEQ ID NO: 602588 - DNA, 403 bp, Homo sapiens
  misc_feature (7)..(7): n is a, c, g, or t
ccccggncttggttcctgcacttcgatgccctcgttctcgtctagagggatggcctggcgctcctccaccggctggattttggcagatggcacatactccaggggtccgcggatgagccagtggtccccagcctggtgtgagaccttctcctcatcctccccctcctccaggggctgcagggccctcagcagcagcccctgctgctccgacagcacatacacatcctggatgccttgttccagctgctctcctggctggaggaaaaaagacttctctcccttgaccacgcgcttctgccccagctgattcttgccatccggtccgacagggacgagaatcacgcagtagttgtgggggcccagggtggtgatgggcacaacccccagcacctcctcgtggaca

SEQ ID NO: 602589 - DNA, 106 bp, Homo sapiens
gtatgttatcgcccacacatgcccagtcttaggtggtaggctaagtctgaagtcatatttcattctttaagattgtcatatgcattattggtgtggggataaatca

SEQ ID NO: 602590 - DNA, 714 bp, Homo sapiens
tgtcacaggtgattcttattttgggacgagatttttcgtccatcactttactttgagcctatcagtgtcattgaatgggagatcgttctcttgaagacagcatacaatgggtctgcttatttattcaattttctacctctgtgccttttaggtggggtggaaaggcatctggaaacagaggaaaacattccatttagaagaaaatctcaatgtgtccttgggttgtgagttttcagatctctcttgtttgaaaatgagaagaccaaatctggatttttctatgttctcctggctccagagaaatagccatggttttcccggaaatgatgaggcaatagaaatctataggcccattcctataagtgccacctcagccatgctaatccacctggtaggccctgggttcttcaggacattgagaaatatgaaacttttctaaaacagagggagccttcttggattacgatctcatccatcaggggagcaaggtcagtgtctaagctccagtacactgtaagaattctaggtaaaatctctactgataaaccttcatatctctctgtctaacgtaatgatccttctctgggggcctggaatatatctattataaaactttcttgggaaaagttactatttttattcgtatcctattaagttaacaaggtttattttaaaatgtaaaggttagggaaaggggggggtaagggaaggtgg

SEQ ID NO: 602591 - DNA, 133 bp, Homo sapiens
cctgggagtgcttttataaattatttcccttgtagattatatttttaatttatctctgtgacttgtcaggaagaggggagagagagagagatgctgttgcgcacatgacaaaataaaataaaatggatgattc

SEQ ID NO: 602592 - DNA, 116 bp, Homo sapiens
ctggatttgtcggggctgacatgaaaacgagcgctgctggtttgagagtcgggtgtgattgtgattagtgcgtcggctaatcgcgctgcgtgtatgcgacaattcttcgtccgact

SEQ ID NO: 602593 - DNA, 241 bp, Homo sapiens
  misc_feature (3)..(3): n is a, c, g, or t
  misc_feature (103)..(103): n is a, c, g, or t
  misc_feature (161)..(161): n is a, c, g, or t
  misc_feature (201)..(201): n is a, c, g, or t
  misc_feature (212)..(212): n is a, c, g, or t
ccntctccctccaccacccccagtcgtcagctccttccctcaattatttttgttaagttgtgtggattatttttaacccatttatcctgtttgtgcatagggnttttaaggagaaacagcacagttcagcgagccaatctttttggggtgtgtggggagcnagggagggaggacatggagaaaagttctttaaaccaatanccaactattgnacatgtgtgaaatcctgtatcatttatga

SEQ ID NO: 602594 - DNA, 298 bp, Homo sapiens
cgggaacaaggggccccggctggggggtgggctcctgagctcttcaaaaaccaggctgctttcaggaacattgctgtggattcccagggcctattccgctaaaagcaaaatgggtggactcaatactcatgtgaatgtcaaggaaaagatttatgcagttagatcagttgttccccaccaaaacaataatgaaatagtcctggggctcccccagtttgtttttaatgtggataaaaccgggccagcctttgtggatggcagggccattcaagtttttaaaaaatggaatatggcagga

SEQ ID NO: 602595 - DNA, 1030 bp, Homo sapiens
tgtctgccgaaccgtctgttgagtcgtcgctgcctgctgcctgctgccactgacactgatacctcgacggtatcaggagccagctgttgttctgcccgactgcctcgctgcctgtgtgggaggaagcgagagggaagcctggattgcgggtttgtcgcctgctgctcgcccacctgctggaagagcctgagccccgtgccagtctggtctgcttgccacctgcatctgtagcctgttaccctgctgggcctgccgacagcctgcccggccggtgtgcagagtgctgctgctgccaattggcgttcttggatgcctggattcaaaatggtgattgacgctatcaaacatgccagttctcacaacaggaatgaacctggtcccagatcgggttactttgtttgatgaaatgccatcaaattgaggacaacagttgtggtgtcacttggtcacaagagcccaagatggatgaattgcagtttgttcccggaggtgaacaaagtgtttgcttgaaaggaactggaagagaggagaagcgtgtttgcaatcgtacctttctgatgataccttggttctgatgaagcacgattccggatgaatagacgtggtcaggaataagccttcgatgtacggcctatggggactgtcatccgacatcacgccatgccctgactgtgaaggtacggcaaacgtatcgaatgtgctgcccaatgtcatgatcatgttgtaaggggattacttgggaaactgcaatcaaagagggattcaggttaaaccgaagaagaccattagacagggtatttaagccagtctgaggagggagcgaatataattgggcggggaagtgaacagcgagcgagcgcaactgtggtggaggagtatacctattagttgtgtagactaatggacattagtagagcggcaagaggagaagaacatcaaaaggatatcagttgcggcgagacacaatagacagagcaacacagtagattagtaaggtgcgtctctttttttgttcgtttgattagagtgc

SEQ ID NO: 602596 - DNA, 2088 bp, Homo sapiens
actagctgggcgcagtagtgcgcacctgtaatcccagctactcgagaggctgaagcaagagaatcgcttgatcccgggaggcagaggttgtgtgtggtgagctgagatcgcgccactgcactccagcctgggcaacagagcaagattccgtctcataaaacaaaaaaaaattatgagatttttaatgtgtggcccaattcctcttcttgcagtgtggcccagggaagagaaaagattggacaccccagcataaagccttcctcccattctgcagtggcgtgggatcagggaacagaaactcattttcatcctactgttgtggggaaccattcagtacttcctacagggcaggaggacgccaacatgcgaccaccttcctcccctcgccgacctccgactcccgcccagcccaggcgccccccaggctcctggaggttgctccgcgttgctgttgctgcaggtgaagggacacaggttgaggcccctccttgtaggacttctgagcctcacccccgagccctcgtaagatacctgtggagctgatctcaaagaaatctccacatctaattcagaaccatcatctcaccagaacacaacggccttgctcctgcctgggtgctgtaccatgatggcaccacaatggtccaagtgaccaccacctttgctggaacggctgcatgcacacagcactgggcacaaccacgtctgcaagtgcccatgactgttcaccatgtcagccctcagcacggcagcagggggcagcagcaccatgaatatcctccagccaactgaccctgccgcacccccagagggcacgatgcccattcccagcctccctgagcacaaccgctgtcctgatgctctgaaagggatgatatttggctttttactactggcctgggggccagaagcaggggctcacgcctagagtcccagcactctgggaggctgactgggcgaatatcttgagaccacgtgttcaggaccagcctcggcaacacaacaagatgctgtctctataaaaaacacaaaacctagttgagcatggtggcttacgtctgtaatcccagcactttgggaggccaaggagggtggatcacctgaacgcaggagttcaaaaccagcctggctaataacggcgaaactccatctcaactaaaaatacaaaaattagccagacgtggtggcgcgtgcctgtaattccagccactcgggagactgaagcaggacaatcgcttgcacccgggaggcggaggttgcagtgagccgagattctgccactgcactccagcctgggtgacagagtgagactcaacaacaacaacaaaagactgcctctggagtcaataccaggcttttggcctttcctcctccatctcctcagcaactgcctctggtgtgaataccaggcttttggcctttcctcctcaaatcgcctcagcaactgcctgtggaatgaatacgaagcttttggcctttcctcctccatctcctcagcgactgcctctggactgataaatcaggcttttggcctttcctcctccaactcctcagcgactgcctctgaagtgaatatcaggcttttgacccttcctccatctcctcagcgactgcctctggagtgaataccaggcttttggcctttccttctccatctcctcagcagtttttcttgcgaaggtccggtctgctggactctaggagacggccacatcacggaaagcactgtggtcctgtctgctaccatggcttcctgaagctatatgttcatttaagatgtctcaagaaaacgggcaaaatagggccgagtgccatggctcccgcctataatcccagctctttgggaggctgaggtgggcggatcacgtgaggctgggagttcaagaccagcctgaccaacatgaagaaaccccatctctactaaaaatacaaaaattagccaggcgtggtggcacatgcctgtattcccagctactcaggaggctgaggcagaagaatcccttgaacccaggaggcagaggttgcggtgagccgagatcacgccattgcactccagcctgggcaacaagagcgaaactctgtctcaag

SEQ ID NO: 602597 - DNA, 702 bp, Homo sapiens
ggttttactgggatgataggacggatgagtggattcgtcaccaccatgttcctgtgactcttctctccacccttcttagggcgggaggagtggcattatatctctagatgactgtgtcccagaggcagatgccacgtctgcgtctgccttactagggggacaggagacgaggaagccactcagtcctttatcacgcattcagagagttcaactgatccattccccgaccatcattcagatctagtagcctctggagcctcgactgggcggggtgcgggatcggcgagcgccagggcgtgtgcgtagaggaggacccaggggcaaataggcgggaacgggaggcggaacggcctgagcgtcccacactcgacaacgcaggcgtcccttatgcgactgctagggtcgagggcagtggtgcgaggtcccagttcgcgtggctttccgggctgccccacccgacgccttttgatgcaaggcggtagggagtgtgggtcgctcgttgtgcctgtgcgtcacccgtctcctggcgctctgaggtgctcctagtggcattggccggggcttgactggtgtgatctctgagtgagagagctggaaccgggggtgtgcactgtcactgggactctcccttgcatccgccctctgttaccttgcatcgctcatgtactgtgaagctcctgcctcttcgtgccgccttactca

SEQ ID NO: 602598 - DNA, 400 bp, Homo sapiens
taccctacctctgcaagacatcatgcattatgactccataccacccacaaaaattttttccaccccaacacttcactattgtgttcgattgctcttattaatataagatgacaggaatgtcaggcctctgagcccaagactgcaggtatacatccagatggcctgaggcagccgaaaagtacagaagaggtgaggcagccagctcctgtctgaactgattgaccaaccttatgactatgcattgtgacttgttcgtgccctgacccaactgatcgatcgaccttgagaaattcttctggacaatgagtcttatgagctccccacaatgcaccttgggacgctcttgtctgctgacaatcgataaccacctttaactgtaactatcgactgcttaccccag

SEQ ID NO: 602599 - DNA, 299 bp, Homo sapiens
aggacgtcccccactctcctttaggatggccgtggcgctgatcttggcctacctctctctgacggggagactctctcggtatttatggcagcacgaagaactcccccagagcccctggtatcgagcgaaggacctggtcaatgtgatcgaggacgtgctcacagacacgggcatgagactatgctgaccatattgaaggcgttctccttgtgctgacagctaactctacagctacctgacaactgggaccgttagctccaccttcagtcagctgcgcctacagatcgatcatgtgaccc

SEQ ID NO: 602600 - DNA, 692 bp, Homo sapiens
gggatttctttaaatgggggcttctcctgggatgcgtatcgcccccgtggatgcgccagaaaggagttttcccgtggaaaaccacccatttgtttggtgaaaaagggggtgtacagtaaagtgcttgctatggtgtggttcgaaatggacccaccttcctcggtgaaggttctcccgcttctgcggagcccgcaccacggttcccgtgatctattgaaaactctctggtcacacaatggcgtggcttcgttgttgggacccccgtttgaaggacccacaacactgtgcgtgcgaagtttcaaaccccattgttcgccgccacctataagctgaagaccacacgttataaatattccccgcccgctcaataccacgctgtgttcacatatggtttctcctctccccctcacattaattacgtgcttacttgtgcagtaccactcttgggctatcattcaacccgacctctgtaaaaggttatatatagcactcgtaccccactctcaacactgtctatgcactcaacaagtatttgtggagtatcctcatttattccacctatagtatgacaggtacgaataaagacatttaaaaggatttcagttttcctcataagacaatatgcgataaatttggtcccctttcttataaaaatcaaactttattaagactcaccatacaacaataacaca

SEQ ID NO: 602601 - DNA, 843 bp, Homo sapiens
  misc_feature (116)..(116): n is a, c, g, or t
  misc_feature (129)..(129): n is a, c, g, or t
  misc_feature (168)..(168): n is a, c, g, or t
  misc_feature (172)..(172): n is a, c, g, or t
  misc_feature (187)..(187): n is a, c, g, or t
  misc_feature (190)..(190): n is a, c, g, or t
  misc_feature (206)..(206): n is a, c, g, or t
  misc_feature (209)..(209): n is a, c, g, or t
  misc_feature (215)..(215): n is a, c, g, or t
  misc_feature (225)..(225): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (242)..(242): n is a, c, g, or t
  misc_feature (257)..(257): n is a, c, g, or t
  misc_feature (260)..(261): n is a, c, g, or t
  misc_feature (264)..(264): n is a, c, g, or t
  misc_feature (272)..(272): n is a, c, g, or t
  misc_feature (288)..(289): n is a, c, g, or t
  misc_feature (312)..(312): n is a, c, g, or t
  misc_feature (322)..(322): n is a, c, g, or t
agaattcaagcctctgttgttaaatgatttgctgatggtgctgtctccacggttggatcacactcgtgcagtcaattatttcagcaaggttaaacagctaccactggtgaaaccgnatttgcgttcagntcagaaccataacaacaaatctgtgaatgaatcattgancaanctttttattacagangangattatcaggctctgngancatcantagatgcttntgacaanttnganaaantctcgcttgctcagngtnnggnaaaacatnaactcattgagttcannagagttgctgcttatctcttcanaggcaacaancgctggaaacagagtgtacgagctgtgcacagaaagacagcctttacaaggtatgcaatgcagtatgcttctgaatctagggatactgatagtttgggctgaagaactcctgcagtggttttgcaggaagaaaaaagagagtgcttggagcttgtctgtttacctgttacgatcttttaaggccagatgtcgtcctagaaactgcatggaggcgcaatatcatggatttgccatgccctatttcatccaggtcatgaaggagtacttgacaaggtggctacattagatggttcagaatcactgagaacaagaagaaagaacaagctacagagacacaaccagtgtttatggtcgagccccagtgtgatgctggcagcaggagccagtgttgccgtccctccccaggcaactttggtttatggttataccgcaccagcggtatggacggccacaaggctggtttgggtccggcatgtggaatgaaagggtggatcctgtagtcacctattttcggacctgaa

SEQ ID NO: 602602 - DNA, 235 bp, Homo sapiens
tgcaacaaccgcctccagcagcctgcagtggtccagcctttttcctcttgccccaggttggtcctcctcaacctgcagggtaacccgtttttccaagcggtgggcattttggagcaaatggttgaaatgcttccttcagttagcagcgtcctcacctaagaggccctgccccctacccttgccctttaaatttttgggactgaataaagaatggggggccctttcagggttccca

SEQ ID NO: 602603 - DNA, 659 bp, Homo sapiens
  misc_feature (24)..(24): n is a, c, g, or t
  misc_feature (143)..(143): n is a, c, g, or t
  misc_feature (597)..(597): n is a, c, g, or t
tcaaacggaaagatactctaagancaaaaatttctcctgaattttttttttaaaataaggattctattaactttactcagtgggcaaggaaattttccaagagacaaaatcgttgtacctagtattcagaatggagatacacntggagatgtgtatctagtattcagaatggagatacacagaatggagatttgtaacaaccaacttcacaagttttaaactgacatatttctagttgtctaccactacttgttgctaacagaatcagtgctgttagtacaccagcagtctagcttaaatgctgggagtagattcaaatgatctctctacagctgaatctcattctctatgctgttattaaatattttgtattttgcaacatttttatatatttgcccctggaagactggctcaagctctgtaggtgttatgctaaaatgttttaacagcctcctgccttcatcctctcatccttcgtgatctaccacacaatatactaaacaactatctgctttgtgtgcatttaaattgtcttaaattaatccatcttattgtagttgcttaactagtatagcaagcactttagcactcattcantttttttcacaaagtttcttatattttctgtcgacgcggccaagaatttagtagtagtaggc

SEQ ID NO: 602604 - DNA, 102 bp, Homo sapiens
cgccctgtgtgaatggggagggggcacagtgtgcctgccctcttcctgatacctgaaggcagtggggcctgggagagaatcagagcgaggttgtgcgaggag

SEQ ID NO: 602605 - DNA, 413 bp, Homo sapiens
ctatagcaggagaatcacatgatctgaggaccattcataacagcgtgataaataacctactctggggagtcttccactcaagtaatgcatggagcaaacaaacaggattaaactaggtttggttccttcagccctctcaaagcatagggctgagcctgcaggcttccttgggctatctctgtgtgtgtcgcttagtaaacactatagcatctgtaaagatccagtgtccatggaaccattcccacatgccgtgactctggactatatcagttattggaacgcagggttcctctgcctgctaacaagcccacgtggaccagtctgaatgtctttcctttacacctatgtttctaagtagtcaaacttcaagacacaatctaaacaagtatctgttgcagtgtgcttccggggca

SEQ ID NO: 602606 - DNA, 282 bp, Homo sapiens
ctcagatgctatgggtgtcatcccccaacagcagacgcttacgacgggcaggattacatcgcctgaacgaaggactgcgctctttgacgcgggggacattggggctcagatcaaccagcgcaagtgggagacggccattgaaggcggagcaggtggaagaggctaccttggagggcccggtgccgtggagttggctccgcagaataccgtggagaaacgggaagggagaacgcttgcagcgacagggaacggccccccaaagaacggcataattgatctcaa

SEQ ID NO: 602607 - DNA, 469 bp, Homo sapiens
gcaaagccaaatgtagccacaagatgaatagggtaatgtgctgtaactatgaagatagccaggagtaagaagtcagttcactacgtttgttctcttgtccccacctcaccattcttttctaaaattgtcttgttttattaatgaaagcactaggaaaggagaagaaaaaaagaagtgggactttctttttattttttccatttcagcattcctctaacccattccccacactcagttccatcagatgaaaataaccatttctctcatgagaaccaaactaaagaaagttgatataacagtggaagtagtgtggtccttggactgatccaaaataaagtcttctcggtgggcacagtgggatatgcctgtaatcccagctactgaggaggctgatgcgggaggatcactggagcccaggagtttgagaccagcctgggcaacatagcaagaccgcatttccaaaaaaaaa

SEQ ID NO: 602608 - DNA, 172 bp, Homo sapiens
ggcgcacagtgtctcttactgctgcgcttgggatcggtcctgcggggcactgggtcatcctcagggtcggggcgcttgtcgttccggtcagctcagccgggatgctcgttctgaccattcagctcacattacaggcaccgggtgaaggtgggactggtatccaacccacagt

SEQ ID NO: 602609 - DNA, 130 bp, Homo sapiens
aaccccggcccccctttttttccccccccaaaggggttttttggaagcccaaggtccgggtggggccccagggcccaggccctttcttcccttggtttttggggcctttcccgccctttttttttttcca

SEQ ID NO: 602610 - DNA, 207 bp, Homo sapiens
tagtgttcattattctcatacaaaatactcgtgataaatttgggatccagttgataacgcgtagtgatctccttctgaagtgcagtccgcaaacttttactatcataaggtttttctcttgcttggtgttttagttcaatgatgatccagtaggttctcacatatcagtatccgggaatatctggggtaccgcagctcgcaattcgt

SEQ ID NO: 602611 - DNA, 1384 bp, Homo sapiens
tataaaccaaaaaagataccttcatatactcatctgtaggcctttaaaaactgaaaaaccagttcaactaaatttggacatgatggtctggaagctagtagtatataattttcttttagcatagctaaaacagagtgtaataatggattacatatagtctacaagcagaagattatggggtgtaatatgagtagggtggcaaatatacaaagggtaaaatgagtatccaggacttgcagaaagataaatccagtgacattaaatgggccacccagtaagtagcaatacagtggtgtgaaaaagtgaggacttcagaaccacatcctatcgtgccaaacatacaaacagcaggcattgatatcctcaatacaccttacaaatatcaaacgtgactacaagacttccatcacaagtgtcaatcgaacaatcgtggacgatgcgcatggacagagatacaataaaggaaaaagcgtgacagacaatcaaagtaggccaaacacacaaatgtccccagaaacataatgagggtctcaacgggagagtaccacacgtggtatagggctaccaatcaatatcccaaaacaaaacaaggacggaagaacacggggtgtcccatggaacattatacagacacaaaatcccgtgataggacaggcagtggaccgaagcccaaaaacacgaaacccctaacagggaggatcccatcacatgaagcgaaaaaaacccgtcgaacaagaaaacagacttgtggcagcaatcaaacacagagaacaagaagacaaggtagggataatggagagaaactacagtatataccagaaaacaacaaaagctacgggcacaagaagaatctaaaccccacgatgagtgatccgtgggaccacaggcgggattaacaacgaacgaaacagtccgccaaagcagcagtaagtacaaacaggggcaagaaacccttcacagtgcacacaaacaatgctcaacaaacaaagtgaagacgacatcccaaagaaaagcgacaacgcgaaggataaaagcagatgtgaaaaaccgcaaaataaaagcaatgactacgctcctatgaaacacaactacacaaggaagagcaaaaaggttaacgaaaaagaaacgatcacacccagacacaaaaggtgtcaggggacaaagaaacaacacgggagcgggagaaccaccatgacaattagacaccagagtgcacgcaaacacaaggaggacaactgtaaagaggatggggcaccgtagacgagacgcgagcagcaacacagatcagaccccaagaccaacgaagacctacgcacaaccatacgaacgcggccaacatgagcagcaacgacaaccagaacaacgagaaataacgagacgaaac

SEQ ID NO: 602612 - DNA, 118 bp, Homo sapiens
  misc_feature (49)..(49): n is a, c, g, or t
tccccagctcagctaggcggggcagacaaggacaaaagactttgggccnctgtaatgtttgtggttagaattggacacacagtggagacccttttttgaaaggcttctggcggaggga

SEQ ID NO: 602613 - DNA, 348 bp, Homo sapiens
aaatttttcccccttcccttttttttcaaaggggcgccaaaaaaaaaggcgggttttttttttttaaaaaaaggggggccccaaaaaaaaaaatagggggcccattccttgctttaaggaaaaaaggccccatttttttctttcgggggttaatcccggggccctttttgggggccccagggggcccccccctttggaaaaaacgggggggcccttttttttaaacccccaaaacccttgtttaaaagggaacccccccctttaagggccttcccccaaattttttgggttaaaaatttggaaaaacccggtttttaaaaaaggtttggggtccaatttcccgcccct

SEQ ID NO: 602614 - DNA, 307 bp, Homo sapiens
  misc_feature (50)..(50): n is a, c, g, or t
ccctttaattgccttgtttcagctctttctgctgctcccccactgtgganggggcagctatgcaggagcacagatagccagagcatttgggtgcatttgaggctacaggcttggtactgtgtgtctcctgctggtacttctgacctagcctagccctctgggatcgctgacccttccttttctaccttccttccttccacgggattcttactgagaaaaccgtctggattttacccctcaagtaaaagagatttagttaggcactcgtttttcagaagagctgagagccacctaccagagcattcct

SEQ ID NO: 602615 - DNA, 126 bp, Homo sapiens
cgattggagttagaattattaaagtttggtgttgtcagaagaaaaattgatttactttcagttaaaaaatatatatatatatgggtaatattattatttttgggacacaaagtctcattttgtagg

SEQ ID NO: 602616 - DNA, 510 bp, Homo sapiens
agtcgtattgggatacacctggcggctgctgttcatgtcccctaatctgtcctttctagactggactatatcctaggacactttacacggccactgctccaaaagcatcaagtgttaagtcagaaaggaatgtaacctccattcgcacatccgtgataacaccagcaactctgccggcaggttctttccacgggagcagagagagatcacagacagagagaaacacttgctttctccactgatagatgacaaagcaactctatcacgtagttgagtaccaagatataagctggggtcaagctctagataacaagagcggccttctctgttctcctggtcaacttgttttttaaaagcctttaatatccagtagttctgcttagagtcttgtcatattcgaacttggcatctccaaagatttctgaaatgttactcgaacaattaggaaatacagatttagaaggcctcttgggagatgccaagattgactcatcgggggatcctcgagag

SEQ ID NO: 602617 - DNA, 398 bp, Homo sapiens
atcagcacgcgctaacaattaggtgcatgagtaggctgcctgcagtaaatgttccgctggttaggcgtcggccagggctattgtgttgaatgagtaggctgatggtttcgataataactagtatggggatccggggtgtcggtgtgccttctggtacgaagtgggctagggcatttttaatcttagagcgaaagcctatcatcactgcgcccgctcataaggggatggccatggctaggtttatagatggtcgggtggtcggtgtacatcagtgaggcacggagtccgaggaggctcagttgtggcaataatcaatgattaaggatactagtataagagatcaggtccgtcctttagtcgttgatatggtcatcactggtggccgaggttagttggat

SEQ ID NO: 602618 - DNA, 294 bp, Homo sapiens
aggaggtgcactgttgctgcgcgctgcctgaccctgggctcgctggggcacaaggtctacagcctgctgttcgcagatcagctgtctacgaggtggacgcaacggaggactttccaaactgtgagacacacgagaagatacactgtatggttgtgatgggatggagcatgtactcccctgcttagcagcacagttcgtaccccaggaccctcgagcatcaagctactggaggtcactacgggtccgaagcagacctgtcggcgcacgtgttcaatgaccggctgtgtgttggga

SEQ ID NO: 602619 - DNA, 619 bp, Homo sapiens
gagactctcggtgggtatagatggtgtgctgtgttcaaaaacggggaaccgctggttgtataaggagagagatttctggaaaacgagtacataggcctggtcctcttgcatggagaaaatggagaaacatatgcgatcgtatattttccagaagagggctagcaatctggattcaaaaacaattcctgggatgtgctaattttaggtgatctcgtccaggtacttggttttccttggctgttagcatttgaagtttgcgcgtaaaagtatttaatggggctacacatgctgtttgtgggaaagtctgtaataaacagcgctaaagtaataacactttttcgcctaccggccaatcccaattttcccaagtctaccgtattttggcccccccccctttcggccaaatttaaaaggcagggggggtataacttcaattcccggaaataagggggtcttttccccattaaattacggttagcattggggggcaaactatcccaattttagtcacaccgtaatagagcccccccttctcgtttaagcacttagagggtttttccttaacacaaaattttttcccgaagggagggaagaaagaaagaccctggtctggtttggc

SEQ ID NO: 602620 - DNA, 792 bp, Homo sapiens
tcataacccctttattacaaagtcaggccccttataaaagtttatggggcctcaggggaaaaaactcaagtgtttccaaaaataaaaaacacagaaaaaaagggagtatagtgcatcccaggggtccgcgccaaagaaggggggggcgcccaagtataaaagcatctctcaaaagagcagccggaggcgggggcaggcgggggtgcaaagagatccggggcaccacaggcacggggggggggccgccggcacaccttcgcggggccccggggggggggggcacgacaacaagcatcccaagggctctcgtggtgccaggtgggggaaccccagagggccgggccaaagacgccgaagtgccgggggagaatacaccctggtggggcggggccgtaaatggggccctacggggagaagcggcagggagagacacccccgaaaatggggggctacaggggggtggccacggggggttcaccctccatagaagccgcagaaagtcaatagaggcgggccattaacaaggggaaagatcctcgctccaagaatgccaccaacaaggggagatctcccgtcgggagatcccagaagagagcgcaggtgctacccagaggggcccagaggcgggggggtccaactttctccctctgggcacacccccttgtacaaatggaccaactcggggaatgaacacccgtagagacaccaaaggacaacgcaggggggcggaaaggcctctgagaagagaccctggtacgcaagacggcgggaacgggcaccaccacaacttga

SEQ ID NO: 602621 - DNA, 1076 bp, Homo sapiens
  misc_feature (181)..(181): n is a, c, g, or t
  misc_feature (627)..(627): n is a, c, g, or t
gcctcctactcctcattgtacccattctaattcgcaatggcattccttaatgcttaccgaacgacaaattcgtatggctatatacaactatctcaaaggccccaacgttgtaggcccctacgggtctactacaagcccttctgtctgacgtccataaaactacttcacctaaagacgcccnctaaaacccgtcaccatctacgcatcagcctcgtacatcactcgcccctggccttagtctctcactcatcgctcttctatctatgtaatcccccgctcccacatacccacacccccgtggtcagacctcgaagctagcgcctcgctagtttagttgctaggccacctactagcctaagccgtttactcaagtcgctctgatcagggtgagtcatcaaagctcgaaagctatcgccctgaatcggtcgcatctgcgagcagtatagccaagacaatctcatattgaagtcaccctagaccatcattgctactatcaacattcactaataagtggctcctataatcctctcaacccttatcacaatataagaatcacctctgattactcctgccaacatgacccttggccataattctgcatttatctgcatagtatctgagaccagnctgaagccccttcgaccttggtcgaaggggagtccgaagctagtctcaggctatcaacatctgaatacggcgagaatatccccgattgcgttaagaccaagtcatacacctcctattatacaatcttccttatcaactcatcctaggcattactgtctttgacactgtttcccatacccagtacaagctccagacattcccccttcaaagcttaagacaaaaattcctgtttgccctggtccgagaaactgtgtccccaccttacccgggtcccccaaaaggtgcttggcttcaccactttggtggagcagagctggacaacgtatgataatatatgacgaccaggttaaccaattgtgctctacaacaccgtttttctgacaaacagggatagacctctccggctcatctcatcagcggcgcataaattttagacacacgggatctca

SEQ ID NO: 602622 - DNA, 1416 bp, Homo sapiens
  misc_feature (383)..(383): n is a, c, g, or t
  misc_feature (452)..(452): n is a, c, g, or t
  misc_feature (1184)..(1184): n is a, c, g, or t
  misc_feature (1415)..(1415): n is a, c, g, or t
gcttcgtacattagttaatacccatcatactcggaggctttgatgtacctttctaggtaacgaccagcatctacaacgattctcgtcacagcccaatgctcttgtgtaataatccttcgtatcagtactagagtagcacatcagtaagtcggagtgccttagggccacccatgagctacattccccgtacagtaactcggtgccctcgcgcatatggcgtcgccgccagacatataacaacgtaagctttcgtgactcttacctcatcctatctgctctctgagtccttgctcgtcatctgtgcttatagttggtaggcctggacgccagcgacacgacggttgataccacgtctgacccttcccttgaactagcgcgaactnacaagaatagaaaacaccacaacaaaaagtaacaaagagaaataatatatcaaccaggaatacatcaantataacaacatataaaagaagagaatggctgctgtcgtggtatttgggcgtaagagcgataggagactccggaacttataccgttgggcctacttccaatacaggggtatcttctggcaacgcttttgggctgtttgattgaaaaggtgccgtgtgtaaaacgctcctggggtgagtacgccacacttattgccttgaggagcacgggaataaattactttaattctccctgggggcaccactcgactatatatagagggcgtgccgacttctggtcccacgagggcgtgaaattccttgcgcctgaaccatttggccctgtgcttcattaatgggaaaggcctagcataaaggggtccgaaagttccaagactcaggtcacagggggtattgcccaccaacgctttgatcgggatgtcagatctcccccacgtgttttataggaaggcaatgtccttgtaaggcaatctatacaaaggagggatagtaccccctctccgcgaggcagaaaccgtgttgctcattcactcacgatactaaataatctagcagttatcctaatataatgtgctagtacacagtcgacccaccactagtgatggactttacacccgggaatgtcatgtatcatctatatattaggtatgattgaatgatgtgcatgagcgaaaaaaacagaggcttacatgggcagtccaactacaaaatacgacagaacgacgagatagtacnagagacaagtcgtgatgtcatcacaaagtcatagtacgtcctcactttcgacgagataatatgtggggcgtaccctttttcttcttcctctcaattctttctctagtcttctttctgtctgttgtatcatctgttcatcttgctccaagaaataacataacataacgaacaacagactaaaaaccaagaagaagagagaactaaaaaggcaagcgagagaaaagcagaaana

SEQ ID NO: 602623 - DNA, 277 bp, Homo sapiens
aacaataacacagaagaatatgtcaacaaattattccagcaagctgagaacctgagaattcctgcacggaatacaagagagtcgcctctccagtttcagcaaccgctaggtatctattttatttcctggtttttacatgtacaggtaatatatatattgaaacaagaaatataaataccacatggggagaaccccaaccaaagaaatctgaaatatatagtaaatgcttcatttaccgttttcgtccatttgggtatgctgggccccagggtaccga

SEQ ID NO: 602624 - DNA, 125 bp, Homo sapiens
gggtcgacacggccgtgtattactgtgcggcaacctcatctacggttcctgtagtccgccaatcatacggtcctgcgggacgttttgatatctggggccaagggacaatggtcaccgtctcttca

SEQ ID NO: 602625 - DNA, 267 bp, Homo sapiens
  misc_feature (16)..(16): n is a, c, g, or t
  misc_feature (78)..(78): n is a, c, g, or t
aatgtaccgtaagtantgtctatatggagtgtacagcatgagatgacacatgtggtctacctaaggaataaacgatanatgtataaaggggcgaagagagatactagggtgggagtaaaagctcatcatgaagtgactatgagctactcttaggaatgatgtttgtgaccagagaaaggggcatttagatggaaggagctcaaggctgtgcaggagcatagtactgggtacgttgacctcagggtacgagctgaatacgaatctggt

SEQ ID NO: 602626 - DNA, 171 bp, Homo sapiens
tagtacgcccgcagtcgttgaagagctcggaaatgagctcgcttgtgctgcggcgcgtgtaggggttggggtaggcgacgatggcggtgatggcggtcacggcgatgacctccagcaccgggtacttgcccagcctggtggttttacgccgttcacttaatgccgctagcg

SEQ ID NO: 602627 - DNA, 892 bp, Homo sapiens
atatcatactaacattgaacatgtcactgctaggaatagtagtatatggcacacagctcatatccaccctacgatgcctccaaaaggaataatacgatcggctggttcatcgataggtactctcataatcccttcatggacccactgcccttcttagcctggtatcgtgcctatgagcatcacttgagtacttcgcacgactctgcagtaagccgccggtggggctagccctactagtctcaatctccaacacatatggcctagactacgtacataacctaaacctactccaatgctaaaactaatcgtcccaacaattatattataccactgacatgactttccaaaaaaacacataattgaatcaacacaaacacccacagcctaattattagcatcatccctctactatttgttaacacaaatcaacaacaactatttagcttggttccccaagcactttttccctccgacccgcctaacaaccccccctcctaaatactaacgaactgactcctaccctcacaacccatgggaagccaagccagtatccaagcgacccactatcgcggaacgacgcatccaccactctatacggaatcccccacagactccataactaagaacagtcgacagcccacggacaacgaaaagcagaactacagaggaaaccacagacaataccaaactgcgacacagaccgaggggcacaagcgaagcagaacgaggaccacactccaatgcacacccagaaggcacatgccgaacgacaggagggtgaagcgcacacaccaggccaaaacggaagcgccacggcagcaacgacccgcgcgcacaacgagaacaaaccatgaaaccaacggccagagccagcggaaccgaggacccgccc

SEQ ID NO: 602628 - DNA, 1782 bp, Homo sapiens
  misc_feature (824)..(824): n is a, c, g, or t
  misc_feature (1299)..(1299): n is a, c, g, or t
  misc_feature (1427)..(1427): n is a, c, g, or t
  misc_feature (1524)..(1524): n is a, c, g, or t
  misc_feature (1527)..(1527): n is a, c, g, or t
tggttatttaaagtaaagacggggcttcacctgttagccaggatggtcttcaattcttccgtgaccttcggtgattctgcccgccttcggccttcccaaagtgtgcgtgggatttacaggcgtgtgagccaccggcgcccagccccattttatttttatacttataaagtgccgtgccaaggagcagcctcaaagcccgagaagaacagaacgtggaggcttcagcggggaacacttctccctgtgtgcgtgcgagcgctgtggtgtgtgtacaccacttttatagagggcccccgaggtgtcttcccactgtggccaagcgaggcacttgggggccactatttgagccacccaaaccccaacgagcacaccccactcgagcccacaagcaaaccccaatgtgggctctccaacccgagccccaaagctctctgtggtcccctctcccacacatgagcgtctaaagagatattccacccaccgtgcagagtctctctctccagagtctccccccagaggaaacacccaaagagtctgttgggcgcggcgtgtgggctcctcctctctccctttcttttatcgaagccggcacaaggcccagagtcccccctatgtgcgcccgtcggcacacgcgccccagcgcccctttgtgcacggcggcactcccaaggggcacacacctcgggtggttatcactcgttgcatgttgtgtggcgcccaaaccccctattaaatttccccaacatatgtggggggcggtgacgtcccaccccgaggtgggagggccccccttggtggtaaaggcccccccccttttttcgccnaccccacaaaatttcccgcatcttctcttcgggccgaggggacacagcacgcccaggcgggccctcctgtggggggctctcccctgtggcgcccttccaacgcgggctgtgcggtctctccaagcccacatggcaccccctcctcccccggcggccgcggggggtctccccccacatcccttgtggcccatttcttcgtggcacagtgaaacagtagtcccccggccatattaacctagcagccgtggggcaccggggcaggaaaacaagctctaaataacttacacagcgcggcggggccccctcgaaaccctttccaaccgagaacatccgccccagcgcgttggtgcgcgccccgtggagatcatctcttcggccccccaaggactttcgccacaaccatactccccccccccacaccacggccacagtcgggtcggtgcttccccacaaacaagttctactccccattgancacagccccctggcgtcaactctacaagcgcggcaccagcttatcaagaaccttcgtgcgaacaactcccaacccaccgggagaccgaagacatgcacacgcgctctcccctccagacgcacaagagnggagtaacacgactcagcgcactgcgcaacatatcatccctgccgcgcaccacacgtcaaaggccgcccgagcacaccacgctcggcgttgctcacntcntccaaccagaaacaccgcccctctctgtggggacagcgtatgctatacagtaacaacacacacccacccatgcgtgccaagacaggccagcacatcacagactcgaacactcacagcacgtaacgacagtacagtctactagcgcagacaggccacccatcacccgcaaccgacctccgcacagcgtcataccgcagcgcgcacagtacagcatttgcagactcgcgtcgcaaacaacaccaactacactgcagg

SEQ ID NO: 602629 - DNA, 870 bp, Homo sapiens
  misc_feature (9)..(9): n is a, c, g, or t
  misc_feature (763)..(763): n is a, c, g, or t
  misc_feature (773)..(773): n is a, c, g, or t
  misc_feature (777)..(777): n is a, c, g, or t
  misc_feature (858)..(858): n is a, c, g, or t
gccgtcgtntgagtcgtcgctgcgctgccgctgccactgccactgccacctcgcggatcagtgagccagcgttgttcgcccgacgcctcgctgccggtgggaggaagcgagagggaagcctgcttgcgggtttgtctgccgctgctcgcccacctgcctggaagagcctgatgcccctggcccagtctggtctgcttgccacctgctcgtagcctgttaccctgctgggcctgccacagcctgcctggcctgggagaaggctgctgctgccaatggcttctggagccgattcaaaaggtgatgacctatcaacaagccattctcaaacagaagaacctgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgagggtataccttatgccgtacttcctggaagcgtatgaccatccggaaagggactttttcttgtcgtggtgggatgcgtgctgtggagttcaaantggtggaaanaaancctaacccttattgcattgttgctccagacacagtgatccactgcgaaggggagcctatcaaacgagaggatgagggagantccttgaatgaa

SEQ ID NO: 602630 - DNA, 130 bp, Homo sapiens
  misc_feature (43)..(43): n is a, c, g, or t
  misc_feature (117)..(117): n is a, c, g, or t
aattttatttttcaagtaagattttcgaataaacgtccccccnaagtatggctgtactttggggacagaggaaaccccctttctgcctgtgccctccacggagcagcagcacccttncagaggcagccca

SEQ ID NO: 602631 - DNA, 634 bp, Homo sapiens
gctagcccgggagagggtgtgccagggctgcctgggagggcaaaggacatgatcagactcttctcaaaagaagacagttggccgggcgcagtgtctcacacctgtaatcccagcactttgggaggccgaggcgggcagatcgcttgaggtcaggagtttgagacgagcctggccaacatggtgaaaccctgtctccactaaaagtacaaaaattagctgggcgtggtgggtgtgtgcctgtagtcccagctactcgaggaggctgaggcaggaagaatccagcctgggcgacagagcaaggctaacatcactgatcattagagaaatgcaaatcaaaaccacaatgagataccatctcatgccaatcagaatgatgattattaaaaagtcaagaaacaacagctgcgggtgaggctgtggagaaataggaacgcttttacattgctggtgggaatgtaaattagttcaaccacggtggaagacatgtggtgattcctcaaagacctagaaacagaaataccatgtgtcctgcaattccattactgggtatatacccaaaggaatagacctcattctgttataaggatatgtgcacacgtatgttcactgcagcactactcacaatagcaaagat

SEQ ID NO: 602632 - DNA, 284 bp, Homo sapiens
tcatgtcggtcgcatcatcgattattgagctgtacgcactctttaaatgaatggttgcttccaagccaagatcctagctgtctatgcatctgtgacctcgtttaagtcaactgagctgtcatttcgggaccttagcagatgtgtcctggattcttctccgtctcgtgacatggaccattagcacccattgccctctgatatggggttccccatggggatccctctagacgtctgaccttgcagggcactgcaatgctatggcacttggcctgtctgtttataca

SEQ ID NO: 602633 - DNA, 414 bp, Homo sapiens
  misc_feature (27)..(27): n is a, c, g, or t
  misc_feature (114)..(114): n is a, c, g, or t
  misc_feature (145)..(145): n is a, c, g, or t
  misc_feature (176)..(176): n is a, c, g, or t
  misc_feature (180)..(180): n is a, c, g, or t
  misc_feature (227)..(227): n is a, c, g, or t
  misc_feature (250)..(250): n is a, c, g, or t
  misc_feature (308)..(308): n is a, c, g, or t
  misc_feature (365)..(365): n is a, c, g, or t
  misc_feature (412)..(412): n is a, c, g, or t
ccctgctcagggggtctctggatcctnggctcatctccacaggggagaacacacaggcagcaggggccatggggcccctctcagcccctccctgccctcagcacatcacctggnaggggctcctgctcacagcatcacttttggncttctgggacctgcccaccactgcccaagtnatanttggggccaagccacccaaagtttccgaggggaaggatgttcttctncttgtccacaatttgccccagantcttactggctacatctggtacaaagggcaaatgacgggcctctaccattgcattgcntcatatgtggtacacggtcaaattatatttgggcctgcctacagtgggcgggagacngtatattccggtgcgtccctgctggtccaggatgtcacacagggggntg

SEQ ID NO: 602634 - DNA, 979 bp, Homo sapiens
gcgaagttgagagcctcatcagagcggcgggaggccttccagaagtcagcagctggcctgggcgggagcgattctgtgcgctggagaagcttactgcgctagaggagcgggagaaggagcgcacagagagaacgagggaggaggaggagcgggggaaacagccgccgtgctcccgagagcccacagccaagtgtgcctccaggggacctggtgggcggactacgacagcttctgacatcagcctgggactggagagccagcacgtgcaccactcatccaacacaagcggacccagctgttacactggagtctgcacagatggagagtcctcaagcccctgctgggacataaggcagagacttgagcacgagagcttccccgaaggtgccgggacctggccgtcaggggactgaagccaaggtgggccccgggggagagaggcagatccggactcggggacccgtgcccatcttgtcggaaatgtccccagagcaggtctaccgagtcagccatgctgcaccctgacgctcgaggcccagagccatctgcccaggagcagatggaggggatgctgtgccgaagcaggagattggaggcttcgggaagaaggggtgccaacaggtcctggcagaacgtgtactgtgtctgcggcgtgggaggcctcggcttttacaaggatgccaaggcagcaagtgcggagtgcataccacgggagaagtgctgtcagctggcagggcccgggcaggggcgcttgataacgaagagccgaacatggtttcaaggtggcttccgggatggaaagatattattccgggccagattgggggaaaatgagctcgggataagggggtaaaagaccctgcaagcgcgtctgggctggaggcaaaaacgtgggcgacacggggtaacggacgaaatacaggacaaggtggggagtggacaacaaggagcagagaaaacttaaaggggggggacataa

SEQ ID NO: 602635 - DNA, 163 bp, Homo sapiens
  misc_feature (32)..(32): n is a, c, g, or t
gtaccgagattagagacagagagacgcagaanaagaaagagagaggcagacagagaaagacggagacaggcagagagacagagaaacagagagaaagagagaaagacagagagagcgagagagggagagagagagggagagagaaagaagggcgtgtcgttgg

SEQ ID NO: 602636 - DNA, 516 bp, Homo sapiens
cgcagagagaacatgacacgagataaccaagcatagtataggggggactaacctctattcactttgcataatgaatcaactcaaagtacctatgcgcggggagccgtacctcttacccccgaggccaggcgagctacctaataacagctctgacagcacacccagctatgtagcacaatagttataagatttataggtcgaggcgacagatctaccgagcactgtgatagatgtgtgctcaagatagagattatctcaactgtaaattgcccacataacaccttaatacgcttgtacattaactgctattcaaagaggaacagatctgtgtacactaggaaaagaccttgatgaagagcacaaatgtacacctatagtcgcctacagttgcaccattcagaaaggctgagctcaacatcactcactggccccaacattgactgaactcttacaccaatgtcccatctctactctatagagactaagttagataagacaagatagcctcctcctcgt

SEQ ID NO: 602637 - DNA, 132 bp, Homo sapiens
cctgcccagtataagcacaggtcagaaagcagcgccttgctcaaaagctcagaagggtcaaaaagctccagcccagaaggcacctgcttccaaaggcatctggcaggaaagcataagttgcatcgataaaca

SEQ ID NO: 602638 - DNA, 153 bp, Homo sapiens
gacaccaataccaagtaagtgatggttcttaactataacatggaaattgtataaaaattaaaatagaatgtagaactagtaggataacattgaaaaactgactacttatagttggctttctttttttttgtttacatagaaggtccaggtatg

SEQ ID NO: 602639 - DNA, 1432 bp, Homo sapiens
tggctgaatgtgctgtgctgtgctgtgctgtgctgtgctgtgcatgcagcatgctgtgtggtgcttgctgtgtgctgtgtctgtgtggctcctgtgtgcctggtgtgctgtgctgtgctgccattctatgattgccctgtgtgtgcctgtgtgtgtgtgatgtgcctgtgtgtgatgtgtgtgtgccacctgtgtgtgtgtgctggcatgtggttgacctactgtgtgcaactgtgtcctgtgatgttcttgatgtgacactttgttgatgccttgatgtgatgtcttgcattgcattgtgatgtccctgactgcctgtgatgtccctgatgctcctgcaacgatgtgatggcctgcctcctgtggcccctgctgctctccccctgtgtgatgcttcctgtgtgctccttgtgtgtcctgttgttctgtggaatgccccctgtgcatggcccaagaggtgacgcgacggatgtgatgccctggtgacttgtgtcagagggtgttgaaccctgtgtgtgtgactgtgctgcgcatttgagtgacccctgtgaggcttgggacagcttattcaaaggcttcgagatcatgtggacgatgcgacgtgaacgacagcttgagcaagcgtaagaggacgctacaatgaacgagggtagcagagagcatgatgcaatagtgagtccaggctccgagggacaatgcttgggccgagtgattcatgtccaattgacggagagagataggacgtgcgttgaatgccacagttaacaatcatattgtatgagaaattgttggagagataatgggtagaaaacactagagagaaaagagcttttgagagacatcaactttttagtgagctagatggttcaggatcgaagccggtgtttacacatacgttgtgttgagaaaagttataggtgtggcgatcaccaagaagggggttataggcagtaatataaggagatttactacagaaggagacggatgtcaggtgagtgactattcctttgagtgcattagaatgaggtccttagtatagagggaaaggcaactaaggttgatcacagagaaggaacacacagagcaccaacggcgagttaaggacgaaacaagaaccggaggagtaacaaccggagccacggtaccggaagcacagagacagccataatagaaaatgagttcagggtctctgagatatgtaaggagagtttcacaaagtaagcccaggggtcatcaacagtaaaaaggggctcggtgataaacgacaaaatcttggattgaccaataataaacaattgttattacaagggaggaacgagagaaaataagatatatagaagagtaatcgtatacaacgaacacaccatgagtcataaagtacaacgaaagattacaagatataagaaaaggacagaatatgatgtaataggcg

SEQ ID NO: 602640 - DNA, 106 bp, Homo sapiens
ttcattttctacactaaagaataaattgaagtaaatattaaagaattatctgtataaatggcattgagaagaagtggctttaccaacatttttttaacgtatttca

SEQ ID NO: 602641 - DNA, 215 bp, Homo sapiens
ttgtgtgcgactttttcgtgcttttacccagtgaacgactttcctgacggcagcctggccacgggctggtgacagcgccccggcgctctcctcctgacctggcgcctttctacaatcacaattcgccccgcgtatgcgcggtgctgttaaggaagccgacatgcagctcaaagacgcccagttgttccgccaacaagccttcatcgatggagctt

SEQ ID NO: 602642 - DNA, 499 bp, Homo sapiens
  misc_feature (8)..(8): n is a, c, g, or t
aattatanatctctaagtgacagtcacattcctagctgtcaagctgtcgttggggcaaaattttctttaccccatgttaccaaaatgctgttttctccccagcactagagaggtactcactaaatcatgacctactgacaagaaacctattagttccataaagagaatgatgtactctccccatagcaccactgtctccattgggatccagctggagtcagactaatatttcagcattatttctataaacagaagggacacgtagagccagatgcttgcttttctttttaagaaggataaatgcttaacaccaaaatcacaagcaacaaaataaaaaagagatatgttgaatttcatcaaagttaaaaatgttgtgtttcaaaatacatcaagaacatgaaaagatatccacaaaactggaaaaaaaatttttgtggatcacatatctaataagagacttatacctggaatataaaaagatcactcagaaaacaatagt

SEQ ID NO: 602643 - DNA, 474 bp, Homo sapiens
aacgaggaagctcgttcgcttttcgagttcggcgtccaatccctcctgggtgtgaccggtcaaccaccggataatctcgtcgacctcgtctttggtgcgcccctttttcttggccttagccacatagtgcggatagacgctggcgacggctatcgaatagacacgatgctttttcacggtgcctccggacagaacagcattagacccgctggtcgcttggttgctcatagaccctcccatgaaccgttgcatttgctgtgctgactggatgctgctgctgaccattttggaagcaccagatcaacgcaatgccggaccgcatcctgacggctgacatagccggattggttcgcgatccaagcgtcgatgcgcgcaatcatctctgaggtcatacgtatcgtgatgcgttcatgcaaagcgggttggatccgtttcagtagctgatgccacccagtttacgtacctgcgacgcgg

SEQ ID NO: 602644 - DNA, 404 bp, Homo sapiens
  misc_feature (64)..(64): n is a, c, g, or t
  misc_feature (72)..(72): n is a, c, g, or t
  misc_feature (271)..(271): n is a, c, g, or t
  misc_feature (303)..(303): n is a, c, g, or t
  misc_feature (314)..(314): n is a, c, g, or t
  misc_feature (327)..(327): n is a, c, g, or t
cttcctcagccctcccaagtagctgggactaatagcgcctgccaccatgcccagctaaattttntgtatttntggtagagacgggggtttcaccatattagccctggatggtctcaatctccatgaccttgtggtctgcctgcctcagcctcccaaagtgctgggattacaggtgtgagccactgcgcctggccatctcccatttcatttctaattgagcttatttggatcttctctcttcttggttaatctcaccaatggtctatcaatnttgtttacctttcaaagaatcagctttttgtntcatttacttntgtactttttttntcatttatatttacttctgctctgatctttgttatgtcttttcttctgctgggtttggacttggtttgttctggttc

SEQ ID NO: 602645 - DNA, 242 bp, Homo sapiens
atctagaggatcctaagcatcctaacagtctcctgcctaattcctccctgaccgtcctcctgcctaactcctccctaatcagtcctcctgccctaactcctccctaatcagtcctcctgccctaactatctccctgatccgtcctcctgccctaactcctccctaaccagtcctcctgcccgtaactcctccctgacccgtcctccagcgctaactactccctaaccagtcctcctgcccta

SEQ ID NO: 602646 - DNA, 362 bp, Homo sapiens
  misc_feature (44)..(44): n is a, c, g, or t
  misc_feature (129)..(129): n is a, c, g, or t
  misc_feature (153)..(153): n is a, c, g, or t
ccccgcccccttcccgcgtctccgctccctccctgcgcaggaanacatggcggcgggaagggagtgagccgcccgggccccgccgcgccctcagatggagaaattagcatacaaagaaactgacttgtnagaagtcagagcaaggtatttgtngatccagggataaatcccaaacttcttaacccctagaccggtttttagtccattgactatgcagcctaatggtaagtatctttttaccctatcgttggaggtaagagggattaagagacctagcaaggacttgctttaaggattcctcacgattaattagactactcgttatccttttctttatagccatgatgtcattttttgtcatt

SEQ ID NO: 602647 - DNA, 544 bp, Homo sapiens
  misc_feature (16)..(16): n is a, c, g, or t
aatatcacacggggtntgtcgggatttgtaaaggccccacggctggtgcgggctacggattacttgcgcgcgaccttgtagcgcaggcaatcctggtaaaagctttgacgaatcgcctcgggcttgagccttgagcggctgtcataggtctgctcggtgatgcccatggccatcatgcgcatccacgatttgctgaacttgagggtctggatcttctgccgggccgcgtatagcgaaacgccggataactttagctcctgggccctggcggccgtgcctgcgccccaactgcacatgtacttgtcaccctcgcgcaattccctggcctgcgcgacagtcgcgccgccggccagggagcaggcaatcagcatcattcccacagagcgcatttgcatcctcacctaaccacctgaaaataaaagtgattttggcgaggattttgttacaaaggggccattaaattgccttactgcgcaaagcgactcgcggatgcttcctatcaaggcttgagttcgaacagcgccggcatcggtggccactgcga

SEQ ID NO: 602648 - DNA, 143 bp, Homo sapiens
caggcatgcaagcattgtggtgtattccatgcctgcgtatgatccatatcaaaccatagagaattacacctttgtgtcacgtgtatcatgagacaaacatggatttgaagaggctaagacatcttacaaatgcacgaagcttg

SEQ ID NO: 602649 - DNA, 385 bp, Homo sapiens
cagtggctcgcgcctgtaatcccaaggtgctgggactcaggcatgagccactgtgcctgaccttacagcagtattttttaaaaatcaaaattaatgcaaaaatccatgatgaggccaggcttggtggctcatgcctgtgattccagcactttgggaggatcccttgagcccaggtgtttgagaccagtttgggtaacatgggaagagcttgtctatacaaacaaaaatttaaaaacaatgagctgggcatgggactcacacttctagccccagctactcgggctgaggtgggaggatggcttgagcccaggagttcaaggatgcagtgtgctttgattgcactactgcgcttcaccctgagcaacagagtgagaccccatctctt

SEQ ID NO: 602650 - DNA, 184 bp, Homo sapiens
gtgtcatgtctggtggcccatgaatctatccttgcactacacacatccccattttatatgttaccatttctctatttataattaataatcttggctgggcatggttggctcacacctgtaatcccagaacttagaggctgcagtggtgggatcagtgtgttgatatcccctttatcattttttg

SEQ ID NO: 602651 - DNA, 415 bp, Homo sapiens
  misc_feature (5)..(5): n is a, c, g, or t
  misc_feature (325)..(325): n is a, c, g, or t
  misc_feature (356)..(356): n is a, c, g, or t
tcagntggtgtgctctcaggttcggtcaatcctcctgcctcagcctcccaagtagctggtactagggcacgcaccaccatgcctggctaatttttgtatattttttggtagagactgggtttcgccatgttgcccgggctgttctcaaacccctgggctcaagtgatccacccaccttggcctcccaaggtgctgggattacaggtgtgagccactgtgcccagcctctctgagcttttaatactgtgggttccagcgtcttctgggccccctgggtcccattcttcctctttgtttctcagcgtcttgatgggcatgccatctntgggtccactaaaactttctcagggattatnaatattattttcacttgtgggtctctggggtgagatcgcagggctttgggaatgggtga

SEQ ID NO: 602652 - DNA, 1238 bp, Homo sapiens
tgtttaacacccgtctctttgccgttaatagaggtgggaaaaacccccttgcatcggcagaaattttgctaatggaaccataggttttcataacaccaggaggtatcaaccagctagccaataactagtatcggtttcattctcgaaccaacaattaccagggagtgcgtcccgaaagaaagcatcgggttaccccattgaaacccacagtgggtgttggcgtcctcctccctgtgtcaaagagtacctggcgtgttgcttgcctggagggccttccaaagcttacaaaagttggtggagccatgtcaaccgttgcgagtctgcttactcgcttggaaattaataaggcataccaatatttccgtgctcggataacccttccagcaaggccgggcctggactcgccacctcctagccgatctccgctcagagcttgcgttaatctttctgatggtctcaccctggtaggttcatgcgtgccaagttgggtctgaagaccgctcggaaggtgggaaaattcgaagcggccttttccggccctttatggcggcccccatcaggtcttccctgttgaccaggcaagggaattaacagcacgtgcaagctggaccattcaaccgggtttcaattacccggccgcccgagcttgacctggccacccaattcagtggcatgaaaccggcctgttcctgcttctcagtggccacccctgcttggtgaagaggggcccacgcaatcatgccaaaaggctccccgccacccaggccgagccctctggacaaccatagcctattggcgttctagctgccacggagtaaagaaactgctgcgtagcggcagcctggtacattgacattccaggcaaggacctacggctggaagtggatccaacgaagcccaagggctaccatgccaacttcgtgcctcgggccacagcccctacaatttggagcctggacacgcgagtacagcaaggtcctggccctgtacaagccaagcagaacaccgggcgcctcaggcgggcgcctgatgcgtgcagtgcgcagcgaggcgactggaggccgctgcccatcgtgtacaacgtgggccagcaagcacaaggtggagcagctgtccaacatgatcggcgcttcctgcaagatgcagcatgaggtcccgcccgccacgcccagcccggcaggcccggcaccccaccccgccccgccccgctgccttgataatgcgggggtattaaggaa

SEQ ID NO: 602653 - DNA, 799 bp, Homo sapiens
  misc_feature (531)..(531): n is a, c, g, or t
  misc_feature (545)..(545): n is a, c, g, or t
  misc_feature (656)..(656): n is a, c, g, or t
gaggacttcattaactgcagttactgagaactcataagacgaagctaaaatccctcttcggatccacagtcaaccgccctgaacacatcctgcaaaaagcccagagaaaggagcgccatggattactacagaaaatatgcaggctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgttnagtgttgatggctntgtgagataaaactctccttttccttaccataccactttgacacgcttcaaggatatactgcagctttactgccttcctccttatcctacagtacaatcagcagtctagtncttttcatttggaatgaatacagcatttagcttgttccactgcaaatacaagccttttaaatcatcattcccccaacccccccccccccccaacccccaccccccacccccccccacacacttctgtcccccccccaaacccc

SEQ ID NO: 602654 - DNA, 260 bp, Homo sapiens
cgaaagactaaacagatatatattttatttcatctgctaaatgccagagagcaagttaaacacacattccacttttttcaaaggccctcgtagtctcgggggaaggacaaactccatttccacatcactggttaaagtttcttcctcttcttcttcctgtgcttcctcctcctcttcctcctaatcttcatcagagctgaaggtgccatcagggaggctgtaaacacggatgacctgcttgttggggcccttgaggatga

SEQ ID NO: 602655 - DNA, 715 bp, Homo sapiens
  misc_feature (430)..(430): n is a, c, g, or t
  misc_feature (455)..(455): n is a, c, g, or t
  misc_feature (466)..(466): n is a, c, g, or t
  misc_feature (490)..(490): n is a, c, g, or t
  misc_feature (528)..(529): n is a, c, g, or t
  misc_feature (568)..(569): n is a, c, g, or t
  misc_feature (622)..(622): n is a, c, g, or t
  misc_feature (673)..(674): n is a, c, g, or t
  misc_feature (704)..(704): n is a, c, g, or t
gcggtctatcaattttgttgatcttttcaaaacaccagctcctggattcattaattttttgaagggtttattgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctaaacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttctgagtgagattctgaatcctgagttctagttngattgcactgtggtatgagagatangtcgttataanttctatttctttacatttgctgangagagctttactttcaagtatgtggtcaatttttgtanngtgtgtgtggtacttgaatgtataatctggtgatttggnngtgagaagtcctgagatgctaatatggctggctggtgccagctgagttcaatncttggtattccttgttgacttcttgctcgttgatctggctatggttgccanntggtggttaaggcttccattatttatggtntggggctggct

SEQ ID NO: 602656 - DNA, 458 bp, Homo sapiens
  misc_feature (1)..(1): n is a, c, g, or t
  misc_feature (108)..(108): n is a, c, g, or t
  misc_feature (167)..(167): n is a, c, g, or t
  misc_feature (169)..(169): n is a, c, g, or t
  misc_feature (171)..(171): n is a, c, g, or t
  misc_feature (225)..(225): n is a, c, g, or t
  misc_feature (248)..(248): n is a, c, g, or t
  misc_feature (316)..(316): n is a, c, g, or t
  misc_feature (322)..(322): n is a, c, g, or t
  misc_feature (376)..(376): n is a, c, g, or t
  misc_feature (428)..(428): n is a, c, g, or t
ntgagcagcgtcgctggtgctgagcggggccgatgggaaccagactcgactctgcgtacaggaggtagaaacacttcctcctgggctgacggagccgcctgccaccgnccacccggacagaaactcctcatcatccgcagcgccccagccactgagctgctggacanananacacttggaggaggcaccgcacgctgcagctcctggccccaccgccgtcagccnagcctcgggcccgcgggtccccngggctccagcctcccagatggtgcaagtggtccccgcagagcctgggcctggtgttatgacccctcangcctgnctccatccagattgtccagactctacccgcagtccagctggtgcacacgttttnaggagaggcagtgattcccctcccgccccgcacagagaccccgactcactgncagccggggcgggagcaggggtgccgcatg

SEQ ID NO: 602657 - DNA, 102 bp, Homo sapiens
aaatcttgagtctcggtgcgttttttcgttgtagcgcaccggtcgccgcgtaatcggtgtcaaacggcttgccacagtacatagcgcaccaccacggcctgg

SEQ ID NO: 602658 - DNA, 196 bp, Homo sapiens
tgtatcaagaaagcaacacattacactatatttataacagaattactaaatagttaactaaaatgtcaatatatcccaataacattatcagatgactatacgaggtctccctatagaccataccacgcgagaatcaaagacttatggcttcaaacgttaaacgtttacaaataaaaccctaattaccttaaccttc

SEQ ID NO: 602659 - DNA, 354 bp, Homo sapiens
aggcactgtattgttttccacgggggctgcagcatctttcttacatccccaccagccaggcaccagggtttgaatttctccacatcatgggcaacacctgttactatctgatttttttcataatggcccccgtgataattcattgtggtttttattggcatttctctaatgactagttatgatgagcatccttcatgtgcttgttgggcatttgctgtcttctctggaaaaatgtccattcaagtcctttgcccatttttgaattgggttgttgattaacaaagttattaggatattaaaaatacccccatcccttccaagtaagattaatcccagcaattcaaggatggctca

SEQ ID NO: 602660 - DNA, 885 bp, Homo sapiens
ggcgcgagcggcggctggggagctgctgctgacggggcccgggctggaggagcgagtgccgggcgggctgggtgggcatgctgcctgccgcggcttttcaccctgccgctgctgcactacttggaagtgagccggctgcggggagcttgctgcgcgccgggggcctggcctggctgcagggcctgcctgcagctgcacagcctcgtgctgctggcgcaacgcgctggggccctggcctgatgccccgatggctctgggcctggctgcctgcccttcgggtgctcgacgctgtcgggcaacgctgctggagagctgctgcctgcggggccaatggcctgggccccccgcgagccggcgggcttcctgcagctgcagagcctcaacctcagcggcaacctggctgcgcgagctgccagccgactggctggccgctgtgccccggcctgcagagactcagactcacctggcaattgcctagactcctttcccgcacgagctctttcgccccggcgcgctgccctgctcagtgaactggcggtgctgacaactgcctccgagaactcagacccgaatcgccccactggctcgctcaagacgttggacctctcgaacaaccagtgagcgagatcctgcagagcttgtggaatgccccaagctcaagggagatccaatttccgtggggcaacaagctgagggacaagcgcctgagaaagatggtcagggctgcagaccagatcatcgtggagtactgcgcgttggaggacgtgtggcgggaggcaggggcgggcgagggtcggaaaggagagagcgggaaagaggggaacgaacagaggaaataaaatgcaacaaaaatgaaatcaaaatataaacaaaaaaaacataaaa

SEQ ID NO: 602661 - DNA, 314 bp, Homo sapiens
cccattgagcccactggatgctacttacagtgcaagaagactttaaaaaataatcactgcacaatcatgtaaagggtggggttatgctgtgatgttgtttttcctcaataatgtgtttcttgactgttcaagaacatattacagtttccacggcaaatttgttttcaaaatgccgatttgcgaaacgaattgctggctttcatcgtttctcatatacctcttcatatgtttctctgacgttgcaagtttgtaatgtttctcttgtcattgacactagtcgactgaataacagatacccatggttatcaattgtt

SEQ ID NO: 602662 - DNA, 801 bp, Homo sapiens
gggacgctatgggacaccgtgagtccaaggcgctgctcctgccttgaagccacgcgctccacgccgtggccctcccattttctgcgtcctcagcgggctgagctgcagagagccttccctggacctattcccgtcctgtgcattcacattggcatcctggttgggggggaagaaaaacaagcgtgccttagcagcagcccccgtttccagaatgtgctgcctgttcccccaaagcctgctttgtcccgcgggagggacggctgcctttgaacctgctttatttgtctcactgggttatctaatgaggacacaaaacacctaacctaaggtacacatcccatctgtgcggtgggttcactcctgagtcttgcaaaaatcccaaggaaaccttggtggtcttgcttgcccatcctttcctcagcacatgtggaaccccgggaaggccccgtttgcactgaccagaggctcaacacccctcttggggttttcccatggttcttttttcaaaccttcaactttcctcttccaaccccatttgtgtcctctggacctcattctttaaccctttggttcgtaaagaaccttttagcctccaagtgaaacttgagggcacgaaggccccctggttggctgggtctgtgttgacagggcaaccaaaccatcttccccagcttcaattggtctcttgcaccttgagccaccaagggtttgatgcggggacttccgaagccatggactgcccaggtccctccttttggctcccttcaaaagacgcaaaacatttccacacaaagactggcc

SEQ ID NO: 602663 - DNA, 998 bp, Homo sapiens
  misc_feature (6)..(6): n is a, c, g, or t
  misc_feature (96)..(98): n is a, c, g, or t
  misc_feature (118)..(118): n is a, c, g, or t
  misc_feature (141)..(141): n is a, c, g, or t
  misc_feature (153)..(153): n is a, c, g, or t
  misc_feature (163)..(163): n is a, c, g, or t
  misc_feature (175)..(177): n is a, c, g, or t
  misc_feature (206)..(206): n is a, c, g, or t
  misc_feature (208)..(208): n is a, c, g, or t
  misc_feature (219)..(219): n is a, c, g, or t
  misc_feature (232)..(232): n is a, c, g, or t
  misc_feature (246)..(246): n is a, c, g, or t
  misc_feature (316)..(316): n is a, c, g, or t
  misc_feature (318)..(318): n is a, c, g, or t
  misc_feature (321)..(321): n is a, c, g, or t
  misc_feature (341)..(341): n is a, c, g, or t
  misc_feature (361)..(361): n is a, c, g, or t
  misc_feature (370)..(371): n is a, c, g, or t
  misc_feature (380)..(380): n is a, c, g, or t
  misc_feature (384)..(384): n is a, c, g, or t
  misc_feature (386)..(387): n is a, c, g, or t
  misc_feature (426)..(426): n is a, c, g, or t
  misc_feature (441)..(441): n is a, c, g, or t
  misc_feature (641)..(641): n is a, c, g, or t
  misc_feature (643)..(643): n is a, c, g, or t
  misc_feature (650)..(650): n is a, c, g, or t
  misc_feature (690)..(690): n is a, c, g, or t
  misc_feature (908)..(908): n is a, c, g, or t
  misc_feature (911)..(911): n is a, c, g, or t
  misc_feature (931)..(931): n is a, c, g, or t
  misc_feature (997)..(997): n is a, c, g, or t
aaaccngggccaatctatgatctaagaggaagtcaggaaaggcttggaagagagatccaaaggccggcctggcaaggggaatcccacatgagaatnnntggaagaaagcaggccccangaagcaaggtcatcttgcctgcntctctgtaagtnaatccttcanaggttgcttttnnntctcttgactgcttgggcaagagggtaangnccctggttgcnggatttgccagtntagtcatccatgtnaatagaccagatcatggctcctcccaggtttaaattctttaagaactgaaccttggtctccatactcttntnttnttctttttttacccactggntccccttgactgcgtagggnacctgctgnncctggggcntcgngnncttggctcctttcagggactggcagatctcataataggncagggagcctgaagngtctgtgatgggtccagcagctccagggccagaggcaggggcccccacggtggtttctgcagaggccagtgtgaaggagtgcccatatgtggggatgcccatgaccaccttctctgatggcattcccttatgtatccagtaccccacagcatattccacattgtagtaggagcttggccctctgtcctgccaccccttgntnagagggntgttgtggccagtgataaggggcttttcccaagacccatngaagtcaaaggacaggaggttgatgaaatccagatcttttgccagtttctcaacttgatagctgttatcaatcatttgcctccctgcagatacgcccgcagtcaagagaagcctttccttggtggattttgtgaagtccttctgaaaggcttctgctaactcatgaatcagcacagtgaaatgagtgttttctttctgatctgggtagatcagcttanatncagtccatcaaagttatggntcctcagaaacaggattatggagttaatgaattccaagcgtgatgtagatgatccaccataggggng

SEQ ID NO: 602664 - DNA, 107 bp, Homo sapiens
acggccgtgtattactgtgcgaaaggcggggttccggatattgtagtagtaccagctgctatccgttttgactactggggccagggaaccctggtcaccgtctcctc

SEQ ID NO: 602665 - DNA, 547 bp, Homo sapiens
  misc_feature (97)..(97): n is a, c, g, or t
agctgtcctgctatcatctaaggatcctttgcctccttcagtgagactgattcattcatggacaggcctggggctctggggtggtggagcagatgcnagaacaaggacgcagctccaggctgcatccctgcaccagtagctggggattgggagcagggagtgcaggctccctcagtgagctccaggctggagtagggccaacccaaccccaaaggcgggggggtgactccgtgaaagtgtgagtcccatccattgcctaaggtaccactctacgatagccaagtcgtaggacacacgaagactttctataggagggttctctgcctccaattctaggccctgtcccagagaggaagcagcacacaattggtgacggggtatgtatcaggcagcatccacacaacaaccctgtgaggtaggttgcgttgtcccattatacacatggggactgcggcgccagcagaggtgaagtttcttgcccaggtcctgcagcaagaacacgagctgggattcaagcccaggtctgccgggctccaaagcccatgtg

SEQ ID NO: 602666 - DNA, 836 bp, Homo sapiens
ggaacaaatggcaatgtgagtaggttacatttctgtgttataatgcgtaaagatattgaaaatataatgaaataaaagcatcttaggttataccatctttatatgctatgcgtttcaatatttaagatttaaagtgatttttggtcacagtgttttgtgataaaatttttttagaatgaagttgaattctaagacttgaaacaacctgatcactgaagccaactttgtcccagcacattccttaagtcctaatgggaaaaaaaaaaaaaaaaatggaattggtggaaaactttgggggtgtaaccaattggttggtgacccctacaaattattcaatagggtagtcagagggagcttcacacagattccagtcttaatgtggcccttgctggggggccataatataaccatacatggtgtgtcctggataaccaaggtcattttctccaaagagactacggttagctggccatggtgtagagcagttctaaaatggtcagcctcgggtgtcgacatggtatatcaattcttggagcccgctgtttcaccacattcattatctcacctcatagacaatcaggtggggctgatttggaaatgcgcggtcctgagtgtccacctttctaggtggccatttttgggattcacgagcggaataacggtgcttccgtggagattaacgcctcagggggaatactggtaaaccttgggggataaggttcagtggaagtatcttgaaaacgtaattttggcaaattcaacttcagtagagaaacaatagagtgggcaaaattaaatccaaacgtgacaggggaccacatcaagcagcggatcga

SEQ ID NO: 602667 - DNA, 443 bp, Homo sapiens
atctgcgctggagaagggagttatggaagaataaggctggaggagcaggggagcccgatccttcccaggcctgaaagggagtttggagttgggctttgagggcagtggaaagtcatcagagcagtggtcctcaggggaaatggaggatggaggtagggggtgccctcaggggacattcagcatttaagtttggagacatttgaagttgccacaacttaggtgagtgtttttggtgcctagtgtgaatagaggccgggatgctgctaaaccctacaaggcacatgacagcctgcttctccccaaactgaatagtttagccccaaatgtgaatagcgccaagggtgagaaactctggatgttttgttttgttttgagacagagtcttactctgttgtccaccctaggggacagagtgagtaagactccatctcaaaaaaatgaaa

SEQ ID NO: 602668 - DNA, 205 bp, Homo sapiens
gtaagacggatgtttgagtggggagggagagggggatggtgccagtctgatatcctgagtaagaagggggctgggtatctgggaaagggcttcaaaggaacagtgggttttaattgctgactctcattttatgagaaggcttatgtcagtgccccagtgtgtggtgcctccaatctcttgtctcgtgggctctgccatagtgggt

SEQ ID NO: 602669 - DNA, 503 bp, Homo sapiens
tttttggtagagatagggtcttgcaaaagatttccatgttgaactccacctcctggccccacgcaagggttccttattactgaaaaacgggaggtgggcccttttttaaaccaaaggggcctttaaaaagatggccggggctacggctttggaagggctccccccattggcaggagccccaggtgaacacccacttgcccctgatttggccctttcgcggcactacccttggggactgggggggggccccactggggtcccctttcttagaagcctttcggcccgctaataatactaagaaaaaggtttttttaaaaggaaaaatttctcctttaaaacacaagggagaaaataagactaaggggtcacgacagaaaaaaaagttttttgcccaccccattaaaaattttttttttttgccaaaatccacctttagggggggccaattgggccgggtccgcaccccactcccgtatgttctggtgctcctggggcgcccggcc

SEQ ID NO: 602670 - DNA, 1813 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcattcccgtccagtccactcttgtctacgtactccatcaccaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602671 - DNA, 1161 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttattt

SEQ ID NO: 602672 - DNA, 234 bp, Homo sapiens
agaagctcacgctggtggcgctactactctgggctgataggtgccatgtggttcgtgaccgtgacctcgacggtggacaccaccctcaatgagcctgagccagcagatcgagaacatcggagcccagaggaggcggaaagaacccgcgccgacctggcgtgacctcaagatgtgccactctgactggaagagtggagagtactggattgagcccaaccaagggtgcaatctgtg

SEQ ID NO: 602673 - DNA, 1811 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaacttaattaaaccgtttgtcagcctcctttggaccttggggccaatgtccgccagaaggcccccaagaaatatcctccaaaattacttgtgtttcccccaaatatagtgttttcccccccaaa

SEQ ID NO: 602674 - DNA, 529 bp, Homo sapiens
  misc_feature (171)..(172): n is a, c, g, or t
  misc_feature (194)..(194): n is a, c, g, or t
cgccccgcgccgcggctggcagggtgtgcgtgagtttggtggcggccggctgtgcagagacgccatgtaccggctcatgtcagcagtgactgcccgggctgccgcccccgggggcttggcctcaagctgcggacgacgcggggtccatcagtcgcgcctggtgctgccgcnnctctcggcccacgtgcttgggngctccgggggggcgcccctcggtgctggtggctggggctggcgctcggggtgaacgctggcagcgtggcgctgagtgggcgctggcccctgggcgcctagtccccgcgctgtgccccccctgtaccccttgagcgccgtcagcctttcttgggcctgatgccctgccctacagggcaggcaggttcccccttccggcccccccgggttgggggatccattcccggccaagaacccccgtgctgccgcccttgcttccaggtgcttcgccagagccatcgagagcagccgcgacctgctgcacaggatcaaggatgaggtgggcgcaccgggcata

SEQ ID NO: 602675 - DNA, 723 bp, Homo sapiens
  misc_feature (270)..(270): n is a, c, g, or t
gttccggggaagaactgctaaaacatgagagcaaggcagcagaccttactgtatgagaagcaatgctcctcaaaccttctgcgtgctgacatagaccttcccagaagcaaaactgtaggcggcgacctgagcgctggaagccgaaggggaagaggaaggagacgctgaagccaggcggccggcgacaaaggcggcggactcgcggcggagcgctctgcctcgggccgggagcacaacccacggccctactccagctgaagtcccgtcgancggcttctaggaataaagtttacgttctcctgaggcctgcaccccccatgtcccatccaggaggtacatctcggtgtcctccatctgccaaattcctttcgagacccgagaactaatccagctttcaggccagcataatggaaggagtcgactgcgtaaacggcgtaggcaataaatcagcgtgccgcggtaagcgtgcgacgaaggaagctgggagtgtgttgagctgaaccctcccgagcgtggatgtcccgggagtcctcccgttttgagcgatctgcagattctccgctgttgtcttcgcccctggcctttgtgaccccttgggaatttagattcctctatcgaggcttcccttcaagcgcctgggtgcatttctaccactcaccttttactactctgctggtgtcacgttgcgggtagtatggggatatggaggactttttgccctca

SEQ ID NO: 602676 - DNA, 1441 bp, Homo sapiens
  misc_feature (17)..(17): n is a, c, g, or t
gacgtccactctagacnatcccctgtattggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602677 - DNA, 177 bp, Homo sapiens
  misc_feature (20)..(20): n is a, c, g, or t
  misc_feature (22)..(22): n is a, c, g, or t
  misc_feature (77)..(77): n is a, c, g, or t
  misc_feature (97)..(97): n is a, c, g, or t
cgcggccgcgcgactacggntncgagaagacgacagaagggtacggccgagaagacgacagaaggggtggctcacanttgtggtcagcacgggaggntgaggcgggtggactgcttgagcccaggaatttgagaccagcccaggcaatatagggagaccttgtctctactcctccat

SEQ ID NO: 602678 - DNA, 340 bp, Homo sapiens
agggaaattaggggaattacctgcgatcacacagctggtcagtgtggaaagtggggcaccccagatgctttgtgtccttaattgtggaaagtcatcctggtggggggaaatctccagcatttttttcctaaaaaggtaggttggactgtgaaggacagccataaaccagagaaaattcttaccctctcttcctttgaaaaatcttgaagtgggccaggtgcggtggtgcacacctgtaatcccagcaccttgggaaaggtgaggcgggcagatcacctgaggccagaaattcaagaccagcctggccaacagggagaaaccccatctctactaaaaatac

SEQ ID NO: 602679 - DNA, 1490 bp, Homo sapiens
tcttcagatgggatgttgtagtctgagaatgcggcatcctccagctgtttgccagcaaatatcagacgctgctggtctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602680 - DNA, 517 bp, Homo sapiens
  misc_feature (365)..(365): n is a, c, g, or t
gcgcccggggtggggttccatcgggcccattgtgggttgccccagggttgggtaccacaaaaaggtgggcgccggcccgggttttagtttggagaagttcagggtggccggtatttacaagaaggtggcccggaccatgggcatttttgtggatccaaggagggggaacaagtccacggagtccctgcagaccaaggtgcaggggttgaaggagtaccgctccaaatttatctttttccccaggaagccctcggcccccaaaaagggagacagttttgttgaagaattgaaattggccccccagttgaccggaccggtcatgcccgtccggaaggtttataagaaggagaaagctcgagtcatcnctgaggaagaaaagaatttcaaagccttcgttagtttccgtatggcccgggccaacgcccggtttttgggcataggggcaaaaaaagccaaggaagccgcagaacaggatgttgaaaaaaaaaaataaagccctcttgggggcttggaatta

SEQ ID NO: 602681 - DNA, 1670 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602682 - DNA, 99 bp, Homo sapiens
  misc_feature (6)..(6): n is a, c, g, or t
  misc_feature (28)..(28): n is a, c, g, or t
  misc_feature (69)..(69): n is a, c, g, or t
  misc_feature (73)..(73): n is a, c, g, or t
tcagcnttttcagaaagagcatttgggnaatattcaacgcataaggagactgtgcttggggccatccantctntccagcttctcaaagtgtttccgggc

SEQ ID NO: 602683 - DNA, 1753 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602684 - DNA, 496 bp, Homo sapiens
tccgtatgcagaatgagtgaatgcttacggagaggtgggggcttggatgtcgtccagttcgtctgcaaagatgataggcacccccttcttgatgaaggtggcctggtcctcaatgggtaagcttgcccttccgcttcttgcgctagagaatcatggcaatgatgccagcaatgagcaggatggctgcgaccaccacggccggaatgactgtgtgcaggtagacatcatcctcactgctcttctcagggtccctgtcaggcacttctgtgggcggcgcctctgagggcactctcctgggtggtaccacagggataaactgtaggtgccgacaagtgccagagcccgtcacagtgatgcttgtggccttaaagtcaggctctagggcgttggagaaggcaggccgaggttaaccatcatcctcagcgatccggcggctcagcccagcgatctgctccttggggcagagcccaaaggacagtgtgttgttgcccatcca

SEQ ID NO: 602685 - DNA, 866 bp, Homo sapiens
gggagctaccgagcggtgccaggcaggtgtgtgcgtccgtcggtctttccgtacccacagcctaattattagcatcatccctctactatttttttaaccaaatcaacaacaacctatttagctgttccccaaaccttttcctccgagcccactaagaagcccgcctcctaatactaactacctgactcctacccctcacaatcatggcaagccaaggcccacttatccagtgaaccacttatcacgaaaaaaatctacctctctatactaatctccctacaaatctccttaattataaccattcacaagcacagaactaatcatatttatatcttcttcgaaacacaatttatccccacctggggtatcatcacccgatgaggcaaccagccagaagcctgaacgctggcacagtacttcctattctacaccctagataggctcccttccccttaatcatcgcacataattttacactctacaacacccttaggctcactaatacattctactatcactctcactgccaagaatatcaaatcctgagcaacaattagtatgattagttacagaatagcttttataggtaagatacctctttaggattcaatttattacttccttaagcctatgttggaagccccattgttggtcatagtaagtggcgagacatttaaaattagggggtattggataatacagcttaaatatttttaatctgaaaacatagttaccttctgaaaatcctatgggattatataaaggtcattgttggaaagactaaagggatggtactaaagcatagctcggtaagatcatacatcggaggcggagtttaagccggaatcatattggaaacaggaggc

SEQ ID NO: 602686 - DNA, 1661 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcggtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602687 - DNA, 273 bp, Homo sapiens
gtaccgccatatactccctcagcctctccgagtcagccgagacacaggctactcgtcaccacgcctggtcatatatttgtattcctcgtagcgaccggttttcaccactgttaaccaggatgatctcgctctcctgacctcatgatccgcccgcctcggcctcccaaagtgctggacttacaggcgtaagccacagacgctcacgccagaaagtctactatcattacctgactggttctccaaggacccgtgaacaaatctccggagataccg

SEQ ID NO: 602688 - DNA, 1187 bp, Homo sapiens
  misc_feature (17)..(18): n is a, c, g, or t
tcgactcaccggatctnnggagtagtccaatggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602689 - DNA, 1650 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattgcaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602690 - DNA, 316 bp, Homo sapiens
tagcccaacacccttttggaaaggggtctcccattagaaatggggaaacccttgggggagggtggggcccctagggggattttttcctttcaggggcgagagggacagatggggaataatttgaatccgggtaaaatttctttaaacgggtttttagggcgcgggtttatggaaaaaccagggccagtttatgtttgtgggtttgggaaaaaatatttgggttgggggaaaatttgtgggggggggggtaagttggggggattttttaattttttttgggcatttgggacaggggcaaaaaatggggcccctttta

SEQ ID NO: 602691 - DNA, 864 bp, Homo sapiens
taaaatttcaatctggaatcacaaaagcgggggattctggcaaagggtccttgtgccctccccattcaatctccctgtggttctgtggctccccctgttgtgtgcgccaataagcgcctttatacctctgtgagagcacaccaaaccccaacacagagaactgtggagagacaccagagcaccccttcgcctgtgccgtggtgttcttctctcccgcaaaacccccgcttttcagcaagtaggcgcgagaggcgcacagagagcggagagacgagagagaggcggaggaggccacgagaggcccccacgtcctctacagagggcgccatccgcgcgcgagatgagagccccgtgccacccacagagtggcgacctaagaaccacccctataccacagacgacagcaggctacatttccaataactccccaccccagacacaaccacctacatatgcagctatctcaaaccaactcatcaaaatcacactgcagatcatatccatcacacacaaatcatacacaccagacgctctttacaacactatactctggtcaatcaggaacacgaaaacaagaaaaaaaacaccccaaagaccaaaaccaaacaccaaaaacacaacgacagaaaacacacaaaacaaccagagaagcacacagccacacaccgagcaacaacgcagagagacacacagatcaacgaacacacagaacaaccagcccgacgagcggccgggacggggggatagtggagcaacgagtcacaagaaagaagggcgagggcaggagaaacgaggatggagcgacgctgtcacatcgaaacacgagaacggaagaggcacgccgaggcgaacgagcgagaggag

SEQ ID NO: 602692 - DNA, 432 bp, Homo sapiens
  misc_feature (198)..(198): n is a, c, g, or t
  misc_feature (286)..(286): n is a, c, g, or t
  misc_feature (405)..(405): n is a, c, g, or t
  misc_feature (407)..(407): n is a, c, g, or t
ctgagacttgggaggagcacggggctcctgtgctaggtgagcacttgctatgtgcggatgctttgcgtaggtgcacgcatttgatcctcacagatgctgcaggaaggcaagcagcatcactgccattttgtcgtggccaagggacatgtgcgtgtccccatccagcccctgcctcgaggtttgcttggctgaccagtncccatccagctctctgctccgcaagccactgggaaacccatcagcccagccccacacagggccagcttctccggctgcccttcccaanggcgacgcctgtgactgtgtctgcctcccaacaggggtcaccacccacccacgtccacccgaaccccagcatgagggttccgcccccttcccccactgacagacacaacggggtgaacntnggagccattccttgtttccacccag

SEQ ID NO: 602693 - DNA, 105 bp, Homo sapiens
acttcagaagaagtctacatgttatatctctagccaagtaaaaagtcaaggtcacattctcgcactgccagatagcaagaacattgcttggtattgcactgggtc

SEQ ID NO: 602694 - DNA, 658 bp, Homo sapiens
  misc_feature (52)..(52): n is a, c, g, or t
  misc_feature (71)..(71): n is a, c, g, or t
  misc_feature (193)..(193): n is a, c, g, or t
  misc_feature (212)..(212): n is a, c, g, or t
  misc_feature (632)..(632): n is a, c, g, or t
gcgcttttgtgcaggaaaggccaaataggcattttatgctcttggtaatttnggctttcacaatttatctntaaatccttgagcaatctgtatactaattaagcagatttctgacatttattcttacactaaatggatcaactctaggatttaggcatgttaacttctgttgtgttttgaatctctccagagnttgcatgtagatagcattnatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttctttaatctttggaacatcagcaccagtatattggctggcagctattgtattaaaaaanttaaagtatattttcactatcataaa

SEQ ID NO: 602695 - DNA, 656 bp, Homo sapiens
  misc_feature (69)..(69): n is a, c, g, or t
  misc_feature (191)..(191): n is a, c, g, or t
  misc_feature (210)..(210): n is a, c, g, or t
  misc_feature (630)..(630): n is a, c, g, or t
gcaatctcttaattgtatacagattgctcaaggatttaaatccttgagcaatctgtatacatttatctntaaatccttgagcaatctgtatactaattaagcagatttctgacatttattcttacactaaatggatcaactctaggatttaggcatgttaacttctgttgtgttttgaatctctccagagnttgcatgtagatagcattnatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttctttaatctttggaacatcagcaccagtatattggctggcagctattgtattaaaaaanttaaagtatattttcactatcataaa

SEQ ID NO: 602696 - DNA, 1183 bp, Homo sapiens
ctatggtgcaagaatgtcccacggtgttccacgtccccggtgcctctcatggagtctcatgaaccgtgacagcagcttcaaccttgtccagcagtgatttcctgtagcctctgcggcagccatgaacctagccagagccaggacacctgccattccaacagcagtgaacctggctgacatctcgaacggccagctgcagcatgcggccaatgaacttgtgccagacccagaacagcggtggcaccttctggatgtgaacctggctgaacactcgcactcccactagccccagctgtgaacctagacagggtgccagaaccccagactgacttggcagactctgagtctcacaggctctggacacaacaccaactgctgcaaacatatccctccagctccagaacaccacaggctccagacctctggcaaacctggtgggtcctcaggtactgcaacattgaccaaagaatcctggtgaacttactagaccggtctcacaggaaccgaacgacaagcacttgggccacccgctgatgaccatacaccagatgtactaggacatggacatcacaggcaatatgatctgggctgcaaaagcatcaaccaagaacgccacggggatggcgccacatatgacatgacgctacggaagccgcttgatcaccgcaagcgcaagcaacaacatcaacacaaacacaggatccaattatgcaacacggaagaccacaatgaggaccacaagaaacgcgcaacccagcacgagacactggcaccaccagaaaggccacaaatactaagcgcagtgaaccaccattcagttgaaaacccaggtggagcatcaccccaattctacccgcaataatcgtcaccttatccattaaagaaacaaatagcagaagacacaaaagggacgatacctcgtaattacaacgacaacggagacgcgccagtatgttagaatcacaccgttactgccaaaagaacacacaacggggaaaattactacaaggaccagcgaaagagcgaacttaaatcacgacagggatttgcacagcgtatgtcacatagtgagcaatataatatagagaaagaacaaacaccacacgatagtagccgcacgtataataaaattaaggcgacttaagggcgcaccgaatgacaaatacacgaaagagcagcgcag

SEQ ID NO: 602697 - DNA, 136 bp, Homo sapiens
cacgaacatcatgaactagtcagacacttctctcatttgaaacgcaataaaggcgacaaagaaagaattcccaagtcaatgcagacaactttcctaaaactcagggtgagaaaaatagcagggctattatctcctc

SEQ ID NO: 602698 - DNA, 3947 bp, Homo sapiens
  misc_feature (452)..(452): n is a, c, g, or t
gttttgttcgcttggaaatctccctttctgcttgctcttctgtttgcggtatctacttgaaatcttaccgaagtgatgtatattcttgaaacttctgtgggtttctaagtgacacttgagcatgctccagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcanactatgggacgctgtaggactttctaaaacatttgctggggatttctgtgaagcatgatcttttaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataaaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcctgatgaataccagatttactatgtatatgtggtgtgtctgaagttcttaacaaacatgggcaatattctggaaatgaaacaagttataactgagcaccatttgggttgataccaagtgcataagattcaaactttgagtgacatttagtccatttatggttgatattaggtttaatacctagaattcaaattgattattgctagtggccaactaaacctgtacaaaatagctgacagttttataactaatttcaatataaaaattgttttaatggcatttgttgaaagaaaaaagcatggctaaaatgtatcaaatgccatatttttaaattttggactttaagcatcttaatgagggcatataacaaattaattttagtacaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgaggacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgtt

SEQ ID NO: 602699 - DNA, 4049 bp, Homo sapiens
  misc_feature (452)..(452): n is a, c, g, or t
  misc_feature (2481)..(2481): n is a, c, g, or t
gttttgttcgcttggaaatctccctttctgcttgctcttctgtttgcggtatctacttgaaatcttaccgaagtgatgtatattcttgaaacttctgtgggtttctaagtgacacttgagcatgctccagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcanactatgggacgctgtaggactttctaaaacatttgctggggatttctgtgaagcatgatcttttaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataagccccacctaccttttatacctttgacttgctgaaggaattgggttanttgtcccgtagaatgttgcctattctggatttacctcattgctaccttatcaggaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcctgatgaataccagatttactatgtatatgtggtgtgtctgaagttcttaacaaacatgggcaatattctggaaatgaaacaagttataactgagcaccatttgggttgataccaagtgcataagattcaaactttgagtgacatttagtccatttatggttgatattaggtttaatacctagaattcaaattgattattgctagtggccaactaaacctgtacaaaatagctgacagttttataactaatttcaatataaaaattgttttaatggcatttgttgaaagaaaaaagcatggctaaaatgtatcaaatgccatatttttaaattttggactttaagcatcttaatgagggcatataacaaattaattttagtacaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgaggacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgtt

SEQ ID NO: 602700 - DNA, 173 bp, Homo sapiens
acattagtgttgaaatatagaaaaatggttccatgcgctagtatttttgttgtacgctgactggaaaatgggcccaaattttttcgaggttattaaaccctgtttcgagcacatggttcgcaggttcttggtaaaacaaggcaatataacgcgaacgagtcgagtgtaagcca

SEQ ID NO: 602701 - DNA, 2977 bp, Homo sapiens
  misc_feature (452)..(452): n is a, c, g, or t
  misc_feature (2481)..(2481): n is a, c, g, or t
gttttgttcgcttggaaatctccctttctgcttgctcttctgtttgcggtatctacttgaaatcttaccgaagtgatgtatattcttgaaacttctgtgggtttctaagtgacacttgagcatgctccagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcanactatgggacgctgtaggactttctaaaacatttgctggggatttctgtgaagcatgatcttttaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataagccccacctaccttttatacctttgacttgctgaaggaattgggttanttgtcccgtagaatgttgcctattctggatttacctcattgctaccttatcaggaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaaagttaattcatcagcacgcagggcctctgccaaatcacccaacaacgatgaccagccgccgcccactgtcgccc

SEQ ID NO: 602702 - DNA, 629 bp, Homo sapiens
  misc_feature (115)..(116): n is a, c, g, or t
tcctttccgggagacttagtgtgttattccggaagttggatccaatgtgtttattttacgatgcatttgggcaggaatatgccttgggaggaattgaaactagatgttccttatnnttgtttgtctactttgtgactcagtgcctttactacaataatcatgacggagatcagcaagatctggttactatcttaatatgatacctacagagctctcggaatcccaaggctttatgaaacatcaaaatgtgaaaaggatgatgaaggcttcactaagtagtgaaaatatttatacattaccacaaagtcaattgacactcaaattaaaacaactatttgccgggcgtggtggctcacattgtaatcccagtacttgggaaggccaaagcgggtggatcacctgagatcaggagtttgagaccagcctggccaatatggcgaaaccccatctgtactaaaaacataaaaaattagccgagtgttgtggcatgcacttgtagtcccagctactcaggtggctgaggcatgagaattacttgaacccaggaggcggaggttgtggtgagctgaaattgcgccactgccctctagcatgggtgccagagtgagactctgtctcaaaaacaatta

SEQ ID NO: 602703 - DNA, 165 bp, Homo sapiens
tacgtgattatagaggatccctgtgatggttcgtgttgtaggtggatgtggacttgatgagttcttagtgaaaaatgatccttgcagtgccaaaggaaggagaaacatggaactgcgtgagaagttcattttagcatgatggtgccagccagggttatggctgct

SEQ ID NO: 602704 - DNA, 205 bp, Homo sapiens
atgtttgatttttttttattatttcataagaaaactccgttaattttcccttcctttccttgtaaataagcctgtcttcccatctggattttttgtgggcatacatattctcctgattaactacttttccagttttaatcctgtattatttcttctcctttgttttgtgtaaaaggggaaaaaaataaaaaaagctggattctta

SEQ ID NO: 602705 - DNA, 640 bp, Homo sapiens
gcggagtacatagcccccgaggtgatcttccgccaggctatgggaagccagtggactggtgggcgcatgggcgtcgtcctctatgagtttctaggtgggctgcgtgcctttctttggagatacccccgaggaactcttcggtcaggtggtcagcgatagatgatcatgtggccatgagggagatgagtgcccttccagcagacgcccatgacctcatcatcatggttgctccggcatagcccgctggaccgtctgggcactggtggtgcactcacgaggtgaagcagctacccctttttgctggcctggactgggctagggcttctccgacacaaagccgagttcgtgcgccaggtcgaagccgaggattgataccagctactttgacgcacgtacggaaggttaccgacatctggtgctccgagggtacgaggagaccaatgatcgaacgaatcgtccacatgatgatcccccagttctcctcctgctcccaccggttcaggcaaggtctacaggcatgttctgagttcctggcactgtccagcccattcctaccttcgctgaaaggagcttccagtgaaagaccgggaggaggggtgggaccggcgagcgaggtgggcctaatggcgtgggtagattg

SEQ ID NO: 602706 - DNA, 417 bp, Homo sapiens
  misc_feature (410)..(410): n is a, c, g, or t
  misc_feature (413)..(413): n is a, c, g, or t
gagatggagtctggctctgtcgcccagcctggagtgcggtggtgtgatcttggctcactgcaagctccacttcctgggttcacgccattctcctgcctcagcctcccaagtagctgggactataggcacctgccaccatgctcagctaattttttgtatttttgtagagaggaagtttcactgtgttagccgggatgatctcaatctcctgacctcatgatccacccgtctcagcctcccagagtgctgcgattataggcatgagccactctgcacagcctagacttcaagcttttagaatagcgtatctctctctctctctctctctctctctctttctctgcccccctcccctccctttttgtataatttaataaagaaatggtcgcgcttctgtttttaaaaaaatnttnatcc

SEQ ID NO: 602707 - DNA, 758 bp, Homo sapiens
  misc_feature (36)..(36): n is a, c, g, or t
  misc_feature (159)..(159): n is a, c, g, or t
  misc_feature (172)..(172): n is a, c, g, or t
  misc_feature (176)..(176): n is a, c, g, or t
  misc_feature (180)..(180): n is a, c, g, or t
  misc_feature (204)..(205): n is a, c, g, or t
  misc_feature (208)..(208): n is a, c, g, or t
  misc_feature (221)..(221): n is a, c, g, or t
  misc_feature (228)..(228): n is a, c, g, or t
  misc_feature (232)..(233): n is a, c, g, or t
  misc_feature (236)..(236): n is a, c, g, or t
  misc_feature (241)..(241): n is a, c, g, or t
  misc_feature (245)..(246): n is a, c, g, or t
  misc_feature (248)..(248): n is a, c, g, or t
  misc_feature (277)..(277): n is a, c, g, or t
  misc_feature (284)..(284): n is a, c, g, or t
  misc_feature (296)..(296): n is a, c, g, or t
  misc_feature (314)..(314): n is a, c, g, or t
  misc_feature (324)..(324): n is a, c, g, or t
  misc_feature (337)..(337): n is a, c, g, or t
  misc_feature (339)..(339): n is a, c, g, or t
  misc_feature (343)..(343): n is a, c, g, or t
  misc_feature (353)..(353): n is a, c, g, or t
  misc_feature (355)..(355): n is a, c, g, or t
  misc_feature (365)..(365): n is a, c, g, or t
  misc_feature (368)..(369): n is a, c, g, or t
  misc_feature (376)..(376): n is a, c, g, or t
  misc_feature (394)..(394): n is a, c, g, or t
  misc_feature (398)..(399): n is a, c, g, or t
  misc_feature (404)..(404): n is a, c, g, or t
  misc_feature (406)..(406): n is a, c, g, or t
  misc_feature (413)..(413): n is a, c, g, or t
  misc_feature (420)..(420): n is a, c, g, or t
  misc_feature (426)..(428): n is a, c, g, or t
  misc_feature (450)..(451): n is a, c, g, or t
  misc_feature (473)..(473): n is a, c, g, or t
  misc_feature (478)..(478): n is a, c, g, or t
  misc_feature (509)..(510): n is a, c, g, or t
  misc_feature (518)..(518): n is a, c, g, or t
  misc_feature (547)..(547): n is a, c, g, or t
  misc_feature (555)..(555): n is a, c, g, or t
  misc_feature (562)..(562): n is a, c, g, or t
agcgggaactgtgtaggggtagattttcgctgcagntgttccccgagcctgttagacgcagcgcgccgggagactgagagaggaaaggatagaggaagtgctgccctaggctgcatgagtcgaagcaagcgtgtttccttcccgccaggcaagtgcccnttagaaaccgggncccngacncacttcctggcctgcattcccatnnccntctcccggggcgnaggtgangacnntcnttggnttcnntntggttctgtcagtgagccccttccttggncatgaanctcgtgaggaanaacatcgagaaggacaantgcgggccangtgaccctggtcncncganggagcctgangnacatgtggcncannttacaanctcgtgcaggtgggcganagcnntgcgncncctccancatccgnaaggtnnnagacagagtcctccacgggcanncgtgggcagcaaccgggtccgnactancctcactctctgcgtggaggccatcgacttnngactctcnagcctgcagctgcgggttgaggggaccancatccaangacgaantgagtatggtcgaatgatgggggggctgtagcgacaccatcgtagcttggagcccattcgtcacgtttcaccgtgggtcaacgaaagcaggtgggatatttgttggtacttggaagccatcaggcagggctggtaccaacctggagggttaatttggggtggggcttgccggaggctgccattttggtgtcccccg

SEQ ID NO: 602708 - DNA, 319 bp, Homo sapiens
  misc_feature (54)..(54): n is a, c, g, or t
  misc_feature (63)..(63): n is a, c, g, or t
  misc_feature (96)..(96): n is a, c, g, or t
  misc_feature (134)..(134): n is a, c, g, or t
  misc_feature (156)..(156): n is a, c, g, or t
  misc_feature (177)..(177): n is a, c, g, or t
  misc_feature (217)..(217): n is a, c, g, or t
  misc_feature (312)..(312): n is a, c, g, or t
  misc_feature (315)..(315): n is a, c, g, or t
aggctggggttgggagcctctctgggcctggaggtgggggtgggggcagccaantccagccantcttcacctggctcccttgtctgggcctgcacnagagctgccaccctcttctttctccccagccttctcanttccgcctctccagaaactggncctccaccctcactctgccantgtccacctcctgacctgtccatctgagatctccagctgnccccaattggcctctctctctttctctgcccccctcccctccctttttgtataatttaataaagaaatggtcgcgcttctgtttttaaaaaaatnttnatcc

SEQ ID NO: 602709 - DNA, 382 bp, Homo sapiens
agagtatccccgccctgtctctgcttccccgatgagaacttcaaactgaagcacatacgggcctggctggtgttgagcatggccgacgcattgctaagacaccaacggctcccagtttcttcatcacgtacagtcaagacagcctggctatattgtcagcatgtggtgtttggcaaagttctagagggcatggaggtagtgcggaaggtggagagcaccccgacagacagtccgggataaaccccttaaggatgttactcttcgcagactgctgcaagatcgaggtggagaagccctacacgatacacagacatcatgcaggttcctttgcagaaacaaagtcagggttcttcaagtcacatagggaagcgcagaggagatg

SEQ ID NO: 602710 - DNA, 167 bp, Homo sapiens
cgatccctgttgtcgaaaaacaacggcatgatccttcctggtcatcccttctccaatagcagaacttcattcaccgtggataataagggcagcacatatgataggtggatagatctcgtttgtttgtgcattctgtctgtccactatgaatctcgcccctctgatat

SEQ ID NO: 602711 - DNA, 1399 bp, Homo sapiens
taaaaggtggcttcttttaaatggaaacaaacccaaaaaatgtccagccaggctccaagtgtgtgtgtgcagttccacaaagcctgtgggaggaaacacagacacagaacacgcacaagcgttctcgaggacacagtctcagaagtttacacccaagacacgaaggctgtggaacttgtgcccgccgaggggggaattttcttctcgtggggagagtggcaacgtgggcgccggggcgcccaccggggctgtggcgccacagaggcgcgcagaagagcgcacacggggcttcttctcttctccactctctgtgcgcccagagagcgtgtgcctgtgagcacagagatcttgtgtgtgtctcccaccaatttttcacgatgatgagaatatatctcacaccttctctctcacctttctcgagagatctctataagagagagatgtctctccgcggagagcacttgagcgcattctccgagagagaagagagtatctccctatctctctctgtcgcagagtctcaccagagagtgtgacactctccacagagagtcgtcttttctccccgctgtgtcacacacacacactatagaagacactgttgtggcgacaaccccctggtggcgtggtgacccgttgtgcgggcccccccccccagaagagaagagcacctccttgactgagaaattgttactctcctcatcagcaggggttgttggtagtcccacaccagaagagggaaaacctgatctctagcaggacgaagagggccaccaacatcataatgctcggcggaggtatcatcttttacatccttcacacacaggacgagggtgtcggggagctcctccaggtggcgctggagacgaagttctcccacatctcccgcaacaacagcagcctcctcatcacacggcggacgaacaaccacaactagctgcgggcggacaattccccccgcaacaccaacaacccgctggtggcggaacgacagacggcccccgccgacagagaaaacaaagaaggaagcttgcttcccgggggggagagaacgcgccgcctaataaataatcccacccgcctagttgggcggccagataggtcgaatcgacggaagggcagacggatcatctcgaagaaaagccaatccattccccccccccccttcttttgcttgaacaaacagccggcacgtatgaattgacgcgaagcaggaagaaaactcagaaggaagagaagagcgcaaaccaacaaagagtggtacggcacggcgcaccccccccccatgaacatgacggcacgatcaaccagcccaccaacgaaaagcagagccggacaacaacacacgcgacgggccctaacattgggctcgttcacacccctcccctccgagtggagt

SEQ ID NO: 602712 - DNA, 225 bp, Homo sapiens
ccggaaatagaatgatcagtactgggcgggtagacctaggattgtgggggcaatgaatgaagcgaacagagacaacatagtgacatagtgagatcccatttctacacaaaagaaaaaaaaaatcccattttacaattaaccttcattagtctttcttcatggttatgaaaagcagtggtcctaccttattttagcgttttttttattaccttcatagatgctaat

SEQ ID NO: 602713 - DNA, 1080 bp, Homo sapiens
tgtacagttacccagcacgtgtacctcctcctcctcctatgctcgggctgtagtgccctcgaaacgtcagcgtgtatcaggaaacacttcacgaaggggcaaaagtggcttcaattctaagagtggacagcggggatcttccaagtctggacagttgacaaggagatgaccttcaggccattaacgaaggagctgacccagataaaacaaaccagtggattctctcctggaaaacctggaaaaaattgaaaaggaacagagcaaacaagcagtagagatgacgaatgactaagtcacgaacgaggagcagagcagcagctccgtgcaagacacacgatgagcactaatgtgaacgactggagtctgacgggcgggtgcagatgactctgctgaggagggggacctacctggatgatgactgactacactgaaagatcggggggatgaccagctggagtttcgatcaaggcactgcactgaaacaagaggctgagcgaaggagagtattgacagagacagcgccaatggcccaggcactgactcttaaagcacaatagtggccgtctagcaaatcttatcccattattccctttacctagagcacttgttctacagatcaaatttctcaccagtatcctctccccatagtatcttcagcagaatgctcactgttctcacccatccttgttccttcccatgtccattaacctccttattggccccggcgccctcagttccccatttccactttcgcattttgacgctcctaagtaggtaacggatacagtctagaaccctgtaacctcttcggctcttcacagcctcggacacccccccttttactcgaacccttaacaccacttaccaaacgcgaatctactcaccgacctactatccccatcacaaggtcacacccacgcacacaaaccaccctgagtatacatacacaccacactaccatcgcccatatccctcactatccaatacacttcataccacaatccttcttccatcacccaacacctcacaataaagcaacatatctccgtaatacccaaaacctacctcttatacaatccc

SEQ ID NO: 602714 - DNA, 975 bp, Homo sapiens
tgccacggtaaaatacagggcttgaaggtcgctttgccggtgtcactcactgtatccggtgtactgaagtcacatcaggcgtaacagtaattacgcggagagatgtaaagtgaaatatttctttatgggcattcttttatggtcatcgttggagccggtactttgccctgatgatctaaaagcaaactgtgcacatgaaaaacaggagccatcaggctcctgtattgcatttctgacgaacggtgtttattccgcgtttacgtgacatatgtttgctgctggtgggtagtaaaaccgttcggcacagggaaatcgtttaatccctctgatggcctgacgaatacggtcgcggttatcaatcagtgcaaagagaacatgcgtatcaccatagtcgcaaagccaatccccggggagagtaaaaacctatcggaatcggacaacggagcttctggcacatatcccagagaatccacatggccgacatatggttccgggcagatatcgccaagaacaaacatcgaaggcctacggtatctcaaaacaatccagcccgcttcatgcaaggccctattaaaccaaaacatcacgaggagggcaagactgtccggcacatgtgcgcgcacgcacggagaatggcctccagacgcgaaatcgaagacaaccagcacagggaacagaggccgtatcgctactagctactaaatacgagccaggtgcctgacaagaacttggtgcaaaccaaaaagcgaatacgcacgaccgcaagtgagtaatgaaaggaaaaactcacggcaacggagcccggtctgcatagaaaggaaaaaaacgaaaaagaaaaacggagaacaaaaaacagaaaacaccaccacaccacagacaaaacgagagaaaaaacatacaaacacaaacaaaaggaaagacacaaccaacacgaacaagacaaacagcaaacacacacaacaacacaaacacaca

SEQ ID NO: 602715 - DNA, 1951 bp, Homo sapiens
  misc_feature (11)..(11): n is a, c, g, or t
  misc_feature (69)..(69): n is a, c, g, or t
  misc_feature (675)..(675): n is a, c, g, or t
  misc_feature (696)..(696): n is a, c, g, or t
  misc_feature (1804)..(1804): n is a, c, g, or t
  misc_feature (1950)..(1951): n is a, c, g, or t
cgcatctgacntccagggagattcagggaggcaaggtatgggaaaagattggggacacctattaccctntaatatgacttgatactcaaattactcgactggttcagtacataaggtagttgtatagcaccaatagcgaccgagacagactcaaaactggacatggtggtaacacactatgcgaaatgatcttctatacttaccatcttcgacttagagggtctggtggctatagcacattcatcgcgagcttacttcgttacatatctgagacactgagtgttacgcatctgaactccgagaagaacagagatagaacacaccgtgagtggagcccgagactgatgcgtcttacctcatagtatgtgtgcctcgctagatgattccacagacatggttactcctatgttttggcacatagagtgcgcaaaggggggtgaggcactcgcacaatatgttttgcattctcgaattcttatatacttgacttgattgccgggttgtcaccggggcaggtgttgtgtcttacacaagtgtcacagttgtccattgtgagggggaacatagattgcagtcaccctctggagaggtcaatacttgccggacgtataagagataaactgcttcatatgtcaccctgagtgcgcgagcgtgtgcacacttgacagtgggagncatgacctacattgcagcgcnaagactggcgaagtcttgtcaatatgggcggtgtcatccgagcttcacacttacttacaccaaactcgtttgtccatggaagtcgctacacctacctgcgagtggtttacatactcttaaagtcagcgcaatgtattagcctattcgcgttagtttgggagaaggaaccgaggctggggaacccaagacggagcagttgtaaaggcactgggaccgttatccatccccatatggttccctctgcgggagcagaacacaaatatgataatacaaaaaagaaaagaccccgccctttcttttaaatttcccccccaaacggggaatttaacaaaaaagggcacccgaaaagttaattacacgggggttaacctttttggcaactgcgggcccccttagtggggaaaattaaccaaccacagtgaaaccttggggcccaaggcacacaacgttttaacccaggaatttggcagccatttggttattttgccaactggaaagaccacggtaacgcggggaatacaaaagtaccgccgggaaaggaacaatttccccactttgtgaacgggaatattgttattctccacatatccagaagcagtccgcatagaatgagtagagaatatatatcgattataacgcttcatttttcaaaaaattggtcgccccccccagcacagttggttggtaagagggggcgcgcgggaaaatggaagcaccgccattgttatatgccagtgtgctagacaagcctctggaatagcacacgaggtgtgtgtgtgtaagcccaccacgaaacaagagcgcccacgtcattggtggtagtacctcaggtagcacacggcccctaacttatagagcgagaaagagcacgaaagtgtggggcaccaccaaatgacgtgtcagccggggaacacccagggtagaagaaacagacaaaaatatcgggaaaagggacgcacgccaggaggtacgcaaatgatagagcacgattgatcgaagagacgacaactcgagtagaaggtagcagaaagacacaagcgagtagaaacaccaagaatcctacatagaaaagaagcgacaacaatctatactatcagttggacataanagacagcagaagaagagtggaataatacgtaacgactccgcgtagtaactaactgaggacacacagaggtgagagtaggaagtataacagacagacgaaggatgagcgaaagagacaaaagtacaaaatagccgtatataattcann

SEQ ID NO: 602716 - DNA, 369 bp, Homo sapiens
cagagacgctccctcacttcgtagatgggatcgcggccgggaagaggcgctcctcacttcctaggtgggatggcggccgggcagagacgctcctcactttccagactgggcagccaggcagaggggctcctcacatcccagacgatgggcggtcaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagttaacgagactctgtctgcaatcccggcacctcgggaggctgaggctggtggatcac

SEQ ID NO: 602717 - DNA, 1227 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaagaatgaggaaacaaaccaccctcaccctatgcataaattttcgtcccc

SEQ ID NO: 602718 - DNA, 114 bp, Homo sapiens
tggtcagactcaagctctatcatgagtagctcctgcacattctccagcctcctttcctgctcttaccctgagttgtttttaggtccttgaacctgccacattctctcccatcgc

SEQ ID NO: 602719 - DNA, 495 bp, Homo sapiens
tcacttacgtctgaacacctcaaaatcatccatgagaatgggaattaacttcctccaaactcctgtaaatgttgttagtttgacctcctcccatgaatcaagaatgttcttcattggcatctaggatggtgcatcctttccagaaagttctcaatttactttgctcagatccaagagaggaataattatttctggcagctacagcctttagaagtgtatttcttaaagaataagacttgaaagttgaaattactccttgatccacgggctgcagaagggatgctgtgtttccagacatgaaagcaacattgatctcctcgtacatcttcatcagagctcttgggtaaacaggtgaattggtcaatgagcagtagtattttgaaaggaatgtttttctcagtagcaggcttcaacaatgggtttaaaatattcagcaaaccatgctactaacagatgtactatcaactacggggttcaaggtgatcttctgcacga

SEQ ID NO: 602720 - DNA, 1229 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgttttttttttaaggaatgaggaaacaaaaacaaataaacaaacgaaaaagaagtttactaa

SEQ ID NO: 602721 - DNA, 214 bp, Homo sapiens
gttcagaaaaaatggtaataaactcgggcaggtgtggtggcttacaccggtaatcctagcacttggggaggctgaggcaagtggatggcctgagctcaggagtggacgaccagccggggcaacatagtgaaaccctatctctacaaaaaatacaaaaattagccaggcatgatggcacgcgccggtaatcccagcacttaatagactcgggggc

SEQ ID NO: 602722 - DNA, 104 bp, Homo sapiens
tcccctacctacactgccctgaaatgctgtcacctgggttactgacggactgggtagcttagttgagtagataatcttttgttgtttcctccttgtaatataca

SEQ ID NO: 602723 - DNA, 2515 bp, Homo sapiens
ttagctgtcagtaacaagcttcctcgagtctcacagtcacaggattgtcttagttctttgcagttggctctatgtacacaagaacatgctgcccatagacacagcgctcccttcaggatctaattcactgcctctgctctcgctgcagagacagaaaaaaaagtgatgtctgctctttgtttgctgttatattcccaactagtatacataagtaatagccaaccattcaatgcatcaggcactatgctaaacccatatgactcaaatattaagcaataggcttaagatcacctactcaggaaataacaggcttcaaaccttgagtcgctctgtgcaaaagctcctacttttaacctgtattccacacttgctgtttggttggattttctgcaattccttcctaataaggagtcataaaaatgcctaagcagtaagtatggagaatcactagcaatctttgaacagcagctcatgaaaagcctttcgttgtgaaagaaaaccaggaagcacttgtttcctggggatatgatttaggagaaaaaaatgcatttgtttgtagcagtgaaagttcttgtttctatatcctcctaaaatatatatattattgaattaatgaaagtccagctttgatcctatctttgagagggttattttatgtcttatatttttcaaaccatttactcctctggtgccagatctgttaactttcttttaaaaataagacaaaaacctaatgaaaactgaaagcccattgctaccatgaaaaactttgctgaaaataaaaggaaactttctgtaattttgggggaaggttaaaatgaaaatctagttttccttatcaggcaagtatagcaagattaataatttctttggcaaatttccaagaaaataagggaatgggaaaccttcaatatggagcttctttcaagcagtacggttggggaagggcagagaagtatcctctagggattgctgtcatgcagcttacctttagccttgaatttcatacaaggcagagttcaaagtaagtgattacttgtactaaatgtactcacttagtacgttttggggacaggcataaagagccagtgaccaaaatggctgaagtgatttggcagggaatgatactctcctctgatttggggtagtaaatacaccaggtttcccagctgagtcactgtagggatggcttcttcccagatactacagggaagatctgttacctttgtttataagacaaaagacactttcaaagggcaggccttttcatgtagaagagtcaggtccataactcggtagcatttaatttgaaaggttacccacattgagctcataccagtgtgaaacttccatggcattatcttttaaatccctaagattaaaaccccacacaaatgcactcaaagcaacccaacatcagtatcctgcagtttctatgggccctttctgcagcctttactcatggaagacaagggatctgggtttgtttaggaaacattttgtgagcattgtccaagccctaagtatggttggcctaagctttgctgaagctaagatcagtctgtttatgtttgcttaaaataggaacttaaaggactaaaatgtcatcgttatttatcctgattatagcctaatggtattttattttctctacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602724 - DNA, 249 bp, Homo sapiens
ttagaggatccccagtctctcctagcctgaacgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcct

SEQ ID NO: 602725 - DNA, 1448 bp, Homo sapiens
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602726 - DNA, 158 bp, Homo sapiens
  misc_feature (135)..(135): n is a, c, g, or t
cgatgcatgatacgcctcgcgctcgagtccctccggaccgtagcgcagccttaccacaccgccggcgcgtgctgaacgcctggaccacgactactggcgctaacacgcgcctgacgcggcagacttgcgacgacnactcacccggggactcctctacg

SEQ ID NO: 602727 - DNA, 245 bp, Homo sapiens
cccacttgttgaaaaggtcaagccctttttgggtaatccatctgcatttgtgactgctgcccctgtggttggtgccaccacagatggtcctgctggtgatgcaaccccaggtaaggttgaatccaaggaagaatcggaggagtcggacgaggatatgggatttggtttctttgattattcaccaaaaagcaaccaacttagccagttttatttgcaaaacaaggaaataaaggcttagttcttta

SEQ ID NO: 602728 - DNA, 205 bp, Homo sapiens
atcactgctttgaaccccatctggcacataagcagaataggcacgtacatctacatggagggaaaaaaaacccacctggtttaccaagacagttgtgggtcctgcaactggcgggggtaggaaagaaaataaaaaggcttttctatttccacttaatgagatttaaataaaacaacaatttccggttgcttttttaatttgtttt

SEQ ID NO: 602729 - DNA, 1150 bp, Homo sapiens
  misc_feature (1003)..(1004): n is a, c, g, or t
  misc_feature (1013)..(1013): n is a, c, g, or t
  misc_feature (1019)..(1019): n is a, c, g, or t
  misc_feature (1021)..(1021): n is a, c, g, or t
  misc_feature (1027)..(1027): n is a, c, g, or t
  misc_feature (1030)..(1030): n is a, c, g, or t
  misc_feature (1042)..(1042): n is a, c, g, or t
  misc_feature (1048)..(1048): n is a, c, g, or t
  misc_feature (1050)..(1050): n is a, c, g, or t
  misc_feature (1060)..(1060): n is a, c, g, or t
  misc_feature (1063)..(1063): n is a, c, g, or t
  misc_feature (1075)..(1077): n is a, c, g, or t
  misc_feature (1080)..(1081): n is a, c, g, or t
  misc_feature (1092)..(1092): n is a, c, g, or t
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaaagaattgagtgttaaagaacaaccaggagagcaaattctctattcatggatttttttnnctggtcttngaatgntngggaanccnggctttaagcgnaaggtncngggggggaanaanctggggtggggnnnggnnaaaccgggtangggggcttgaatagggaaacaattgttagtttaggaccgggtatcgggagatagatcg

SEQ ID NO: 602730 - DNA, 929 bp, Homo sapiens
cgaccagccaaatgtcaagattctttatctctcctgacatgaagttcatactcgactgggcacagtggctcaagccctgtaatcccagcactttgggaggccgaggcaggtggattacctgaggtcagaagttcgagaccagccaggccaacatggtgaaaccctgtctctactaaaaatacaaaaattagccaggcgtggtggcgcaggcctgtgatactggctactagggaggctgaagcaggagaatcgcttgaacccaggaggcagaggttgcagtgagccgagattgtgccattgcactcctgcctgggcaacaagagccaaactctgtctcaaaaaaccaaaaaaagcctgggctcggtggctcacacctgtaatcccagcactttgggaggccgagggggatggatcacctgaggtcaggagttcaagctggtcaagagactagactggccaaaatggtgaaactccatctctattaaaaaaaaaaaaaaaaaaaaaaaaaaaaaacaacaaaaaaatacacaaacataaaaaacacaaaaaaaaagggggggggggcccaaaaatatccccccggggggccccccctttttgcccccccccctttttttttgaaagggggccccatataggggggctgtaatatataaagcgaccacgcgccgggccgcggtctttttaacaaccggtggcgtggtgggagaacaaccggcttccgttgtgctgtcttgtgagaggaccccccctattctgcgggcgggggggcacaatttggtcgggacagcacccccctagcaggagtatttgcggctccggggcgacacaattatcaccctcgcggggtcttggggggtggaaccccaccgcgtttatctcgcgtgcgcggaagaatttgcctcccggagtttttgtgacaatccccg

SEQ ID NO: 602731 - DNA, 163 bp, Homo sapiens
  misc_feature (13)..(13): n is a, c, g, or t
gggggggtttttntgtttttttcccaaaaaaaaggaaaagagggggggggggggtttttccccccccccctcccgggcccccccaaaaaccaggggggtttttttaccccggggggggggcctccccccttgtttttttttttttttttaaaatcccctttga

SEQ ID NO: 602732 - DNA, 711 bp, Homo sapiens
agttagccggattaaccaattttcaccaccaggaaaccaagcttatgacccatgatttaccgaatttcgagcttcggttaccccaaccgttaatttaagccgccttttgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602733 - DNA, 83 bp, Homo sapiens
  misc_feature (30)..(30): n is a, c, g, or t
  misc_feature (54)..(54): n is a, c, g, or t
cagtctggtctctgatgtagtgcgtcccanaacacaggggactgatctcaaganctcatcacatcctgaaatgcttcatggga

SEQ ID NO: 602734 - DNA, 361 bp, Homo sapiens
  misc_feature (13)..(13): n is a, c, g, or t
  misc_feature (19)..(19): n is a, c, g, or t
cggtctagaggancccggngtgttcatgaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 602735 - DNA, 869 bp, Homo sapiens
  misc_feature (9)..(9): n is a, c, g, or t
  misc_feature (70)..(70): n is a, c, g, or t
  misc_feature (84)..(84): n is a, c, g, or t
  misc_feature (105)..(105): n is a, c, g, or t
  misc_feature (110)..(110): n is a, c, g, or t
  misc_feature (113)..(113): n is a, c, g, or t
  misc_feature (134)..(134): n is a, c, g, or t
  misc_feature (140)..(141): n is a, c, g, or t
  misc_feature (157)..(157): n is a, c, g, or t
  misc_feature (162)..(162): n is a, c, g, or t
  misc_feature (168)..(168): n is a, c, g, or t
  misc_feature (172)..(172): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (196)..(196): n is a, c, g, or t
  misc_feature (198)..(198): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (235)..(235): n is a, c, g, or t
  misc_feature (258)..(258): n is a, c, g, or t
  misc_feature (276)..(276): n is a, c, g, or t
  misc_feature (290)..(290): n is a, c, g, or t
  misc_feature (302)..(302): n is a, c, g, or t
  misc_feature (357)..(357): n is a, c, g, or t
  misc_feature (364)..(364): n is a, c, g, or t
  misc_feature (372)..(372): n is a, c, g, or t
  misc_feature (383)..(384): n is a, c, g, or t
  misc_feature (389)..(389): n is a, c, g, or t
  misc_feature (396)..(396): n is a, c, g, or t
ccgggaagnccgagatgggaggaccgttttcctatgtgtacttcttctgcacggtacctgagatcctggngcacaacatagttntgcttcatggcgaacttcagnagagnttntacatacatttggcctcatanccccannggctcctttgaagcancattntctatngtgngttggtgnggnaanttccaccagntngtttaacaacttgttatttggttntncnacacaagancttgtatgaagatgagaacagcnatatgttcccaaaggccntgagttctggaccntaccccccacgntggtgtaagcagaggaggaatttggttcactttactcccaggcaaacaccccccntgccacntagggggnaacaccccccnnttggnccacttnctgttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggcttttttttttttagaaagttagaattgtttttaccaagagtctatgtggggcttgattcacccttcatccattggctgaactatggactgcccatgtgaactacactcaaaccataccttttgacaaaaa

SEQ ID NO: 602736 - DNA, 1096 bp, Homo sapiens
  misc_feature (949)..(950): n is a, c, g, or t
  misc_feature (959)..(959): n is a, c, g, or t
  misc_feature (965)..(965): n is a, c, g, or t
  misc_feature (967)..(967): n is a, c, g, or t
  misc_feature (973)..(973): n is a, c, g, or t
  misc_feature (976)..(976): n is a, c, g, or t
  misc_feature (988)..(988): n is a, c, g, or t
  misc_feature (994)..(994): n is a, c, g, or t
  misc_feature (996)..(996): n is a, c, g, or t
  misc_feature (1006)..(1006): n is a, c, g, or t
  misc_feature (1009)..(1009): n is a, c, g, or t
  misc_feature (1021)..(1023): n is a, c, g, or t
  misc_feature (1026)..(1027): n is a, c, g, or t
  misc_feature (1038)..(1038): n is a, c, g, or t
gatcttgtggaggagtgcacagtcaatgcctgttcaagattaatcattttccctgtgcctatgactgaggctgtttctcacatcctgcccctggtttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaaagaattgagtgttaaagaacaaccaggagagcaaattctctattcatggatttttttnnctggtcttngaatgntngggaanccnggctttaagcgnaaggtncngggggggaanaanctggggtggggnnnggnnaaaccgggtangggggcttgaatagggaaacaattgttagtttaggaccgggtatcgggagatagatcg

SEQ ID NO: 602737 - DNA, 86 bp, Homo sapiens
ttcaagcttctaacgatgtacggggacatgtgggcaaagccttcaatcagggcaagattttcaagtgaacatctcttgccatcacc

SEQ ID NO: 602738 - DNA, 477 bp, Homo sapiens
aagaacattttaaacggccccttggaagtagaagaagaagaagaaggctggaaggcagaagggacacccaactgcccactggagaaaaatttaaccctgattatttgatgggaaagaataaagcccagggtaggtctcacttggttcatcctgtgcacaggtgggatgggcttgaaatctaatttctggtagtgagccctaccttcagcctttccaaatgctgtttcagaagaagggggtacaaacttctcctaacaatttttgggaaagccaaggagagagtttatattactcatcaacaatagcacctcgtaaagattgtggttaaatacttctatttctttctttattttattttatttatttatttctgagacggagtctctctctgtcacccaggctggagtgtggtggcacaatcttggcttactgcaacctccgcctctcgagttcaagtgatcctccttgcctcagcct

SEQ ID NO: 602739 - DNA, 113 bp, Homo sapiens
aatgttgacctgacagaattccagaccaacctgggggcctacccccgcataccacttccagtcttggccaaataatgcccctgtcaatcttttgctgggaaagcctaccatga

SEQ ID NO: 602740 - DNA, 2439 bp, Homo sapiens
  misc_feature (19)..(19): n is a, c, g, or t
  misc_feature (69)..(69): n is a, c, g, or t
  misc_feature (86)..(86): n is a, c, g, or t
cttgctcacgtggcagatngcgtgacactttcaaggccttcagtaagaagatggacgacagcgtcctgnagctcagcactgtggcntcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcactctccccaaggagccatgccatgcccttgcccttgaaaagccca

SEQ ID NO: 602741 - DNA, 960 bp, Homo sapiens
gtcgcagctctgatgcgctgcatgcatgctgtatatctcggtcactcgcctgaggttcctgctgtcatggtgccagtctgaatgagaagaggactctcccgtaagacatatgactgaccatactcctcgcataatgttctacttcaaaggcgcactgggtcctgtactccgcggagaaaaaagcgttccacgacgagagtaggctaacatgacagtgatccgtgctactcaattggcgactgtatgccatgaagatattgtgcgttggatcgaggagctggcatccttctagaataatcttggaaccctatccatgtagtctgtaaggtgggaaacagcatcttgctagatgaatcggatgacggagaatgccaaccacacttgtctctatcctatctcgtactgtggtatcgccaagaacatgctgggcagaatatatgagacacatagtgcacctctcgcgaacaagggttgaccaaggcaactccgattgggtctccagtcctagttggtccccctattcttgggaactctaattgaatactcgggggtagttggatcatagtttgacttgctaattcattaggatgggacctttctgtcgtgaactgagttgataatactaaggaggggctggggcgcatgtggatccgagaaagattctgaaaagacttttggaccgatggttttgcacagcgtagagtgatgcaagtgttgaagagacgattgcatcttcttgtggtaagctgggattgggccatggcatgcattctcatgtgaattgctatgggaaggacagtaagtgctgctgcatctggttcgagggaagatgggtaggcgcaagtggccaatgagacgggaaaggtagtgtattgtcttacataaggcaaatagaaggattggagggaattggtggatggtgcatgagacaacttgcaaattccatagaaggaataattc

SEQ ID NO: 602742 - DNA, 2025 bp, Homo sapiens
  misc_feature (19)..(19): n is a, c, g, or t
  misc_feature (69)..(69): n is a, c, g, or t
  misc_feature (86)..(86): n is a, c, g, or t
cttgctcacgtggcagatngcgtgacactttcaaggccttcagtaagaagatggacgacagcgtcctgnagctcagcactgtggcntcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaatta

SEQ ID NO: 602743 - DNA, 579 bp, Homo sapiens
gttattggatgcacatagacaaacggctgctcgctaaccgaaattacggatttgtgcacagggtgtgggcattacacctaccacaagggttgactgctgatgcccatgcctgttatacagttcatgggtatcattcttatgacaacctgaaatggtctgaaacgctatgatgtaaccctgtggcagtttgacgagcggccaccagttactacacctgttcgtgaaagcatttcactgtattgttcacctagcttaacttatgtcctaaggcttgcaactgagacatagcggtcatctacggcttttgtagcgattcgtgcgagtgtgtaacaagctgggctggagaaattggcaaggtgaatggtttgtagatgttacaacgcgcggatatctttttatatgaggtaactgtgcaatgttgacaccactagggaactgttgtattaatgcatgccatagcgtagacgcttgggcggctgttcatcatggatcttgagcagcatcttgtgagtctgaacatgatggcgtcatggtaaggacacacctatgggggcaagacacggcttgaggccttcagcc

SEQ ID NO: 602744 - DNA, 303 bp, Homo sapiens
  misc_feature (48)..(48): n is a, c, g, or t
  misc_feature (97)..(98): n is a, c, g, or t
taaattatgatttcctgctataaactccatttttaataaaatggcaanggacattggaaaatgaatgtgaacctatatgcaatttttcttcattttnnttaaaaggccacccgaaagcttttggcaatgggggttgcataatttgaaaatcttttaggtctattataaacaaaaggccattagcatcacagcaagttaacaggcctgagttcaaacaaatagtgacatatcaatggaaaaacatagacagtatttgtgatattataaaatatttatttttggctgtgtccatggtttcctagc

SEQ ID NO: 602745 - DNA, 224 bp, Homo sapiens
accgtgaaacccaggatgatttcaatctcccgacctcgtgatctgcccgtcttggccgcccaaagtgaaaacaagtacaaaaaaaatccctaactctgagctctatctctgattcctcttcctccttcccctcttcctcctcttcctctcctcctgtttggctacattctcctaagtggggcaccgacctcaaattcgaaaacatggacatagcgtgttccctg

SEQ ID NO: 602746 - DNA, 250 bp, Homo sapiens
aacactgcacgcttattttttattaaaaaataaaaataaaataaaggccaggcgcgatggctcacacctataatcccagcactttggggggccaaggcggggggatcacaaggccaggagttcaagcaattccccccacctaagcctcccaaagtgctgggactaaaggcatgagccaccatgcctgagccaaagtggtatatatatataatagaatacttcttagcaataaagaactactgatatgtgc

SEQ ID NO: 602747 - DNA, 1462 bp, Homo sapiens
ggcactgagggcggcctggtcgtcgtctgcggctggctggtggcaggatgaggagcccgggttgagtgcgccagtacccgggtccgggtccgcatttcgccttccggcattcggtttccctcgggcccagtattgcccaggacaccgcccccaagaccctcctgaatcccttcgcaagacccgggactccgggccagccccggcattctgcaggcacggcaatgatgactgactggcgctagaagcaaagaccatttcagggcagaaacgccctagtagaagtaccaagactggacggatagaccgggcgagatacactaccattgactcgggcttccgagacgtatggcacacaacataacactcccagcaattgtaaccccgaagcgatccatccttgctacccaaggcaccattacgcaccattccacttctgggacgcgcggaacatacgcccaatgggtggagcaccaacaacgcaccgcccacggcacccaaccttaccgcgtccgccatttcagggtccaacacgtggaaccacaacaggacagacacaccgagaacaacaataggccacacccaatgaggtacaaccccccggaccaacacaaccgaccaccgaaaaagatgggcacacaaagaacaccctggaactgctggagcaccggacatagaaccaacagtaaccaaagggccctggaagctaccaagaccgagacaacacagcacgcccccccagcaacactaaaccctacaaggcgaacaaaccagcaacgcggacccaaaggacaagcgaaaaccaggcccacaggcggcagcacaacccccacacccacatgtcccacaaaaaaaggagttccccaacacaagagtataacgaaagagcccgggaggaccctaagtagcaatcccaaccaaacacccacaacacacaacaagagcacccccgcacaaatgggacaccggagcaaacaaaagcacaaagagaaacaccaattccacacacatagcagcacatagagaaagaacacaacatgaaccccaaagtacggggagccaaacgagcacaaaacgacaatccaaagacacgacaaaagcagaatcccccaacacctgtgtcgtacaaatgcaacatccgaacgccgacacaactcctgccaaccacgcacattaacatcggcacaaccctcactgataaacactataacaaccccatgaaaatagcatacaacaaacaaccccggaaagacatgtgaatgtagacccccgtacgctatgtagaacccaacagaaccgcacaaaaacaacaagaaatcactcaaccacagtacaatcactgagcgaatccaccacacacagcgcaataaaagaacaacaattgtacacacattacgagaacagtacgacatgcacaagatacaccgaacgatcagcaacatcggaacaaagaccacaccacagt

SEQ ID NO: 602748 - DNA, 982 bp, Homo sapiens
  misc_feature (2)..(2): n is a, c, g, or t
  misc_feature (98)..(98): n is a, c, g, or t
  misc_feature (139)..(139): n is a, c, g, or t
  misc_feature (182)..(182): n is a, c, g, or t
  misc_feature (184)..(184): n is a, c, g, or t
  misc_feature (297)..(297): n is a, c, g, or t
  misc_feature (336)..(336): n is a, c, g, or t
  misc_feature (340)..(340): n is a, c, g, or t
  misc_feature (344)..(344): n is a, c, g, or t
  misc_feature (365)..(365): n is a, c, g, or t
  misc_feature (392)..(392): n is a, c, g, or t
  misc_feature (396)..(396): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (425)..(425): n is a, c, g, or t
  misc_feature (427)..(427): n is a, c, g, or t
  misc_feature (429)..(430): n is a, c, g, or t
  misc_feature (438)..(438): n is a, c, g, or t
  misc_feature (525)..(525): n is a, c, g, or t
  misc_feature (548)..(548): n is a, c, g, or t
  misc_feature (550)..(550): n is a, c, g, or t
  misc_feature (555)..(556): n is a, c, g, or t
  misc_feature (573)..(573): n is a, c, g, or t
  misc_feature (596)..(596): n is a, c, g, or t
  misc_feature (611)..(612): n is a, c, g, or t
  misc_feature (615)..(615): n is a, c, g, or t
  misc_feature (629)..(629): n is a, c, g, or t
  misc_feature (752)..(752): n is a, c, g, or t
  misc_feature (804)..(804): n is a, c, g, or t
  misc_feature (814)..(814): n is a, c, g, or t
  misc_feature (825)..(825): n is a, c, g, or t
  misc_feature (827)..(827): n is a, c, g, or t
  misc_feature (839)..(839): n is a, c, g, or t
  misc_feature (843)..(843): n is a, c, g, or t
  misc_feature (865)..(865): n is a, c, g, or t
  misc_feature (892)..(892): n is a, c, g, or t
  misc_feature (908)..(908): n is a, c, g, or t
  misc_feature (950)..(950): n is a, c, g, or t
  misc_feature (963)..(963): n is a, c, g, or t
tntaaagtacacaaaaactattgtgcaaattgtaagtcacaaggattttttttaattaaaacttttgttttccaagggtccaagttttgatgtcaganatctacacccaatatacaaaaacaatgttaaatgggaaganatagtgacatttttcactatatattttccgcaatgtacttttntnttgccactgtgtatatcatccactatataacagaataaaagagaaatactgttaacaaaagtgaatgttctaataatttttctacccaactacctccacatccccaaaaaacncctataaattaacaggacaacatttgtccacctgtgaanaatngtcnctaattttctaattcaataangcccacattatatcctcataacataanggtnctttactgatgacntangcngtctttttntngnngttatctnagattcttaatatcccttctttacaatatatatttcatcttcagttttttttctaaacaaagtgcagtgtatcttagagtctacagngaacacattggtatacaattttnanatctnnacaagagactgcaggcnaactaaagttcaaagcataatgnaatgcctagatacanncanttgttaaactttcnaaacaaaaatgcaaaaacaaattgtagctatgcttcaaagcaattaaattaaggaggattccaattctttgggccctcttagcaatatacagtcgttcaattccaaatattcacaatagtgtnaaaatgatagttctagatatatttaatcactacatccacgatgttgactggnaagactaggnataataaaggngnttactctagaanaagntgacaatatttgtaataatacnaactcattttacatctccatgtctgtnccgaatgtttatttcnttccgcctccatattcttgaaaccagtgcttagaagaatcanattgaaagttggntcagtataacaacaaaagt

SEQ ID NO: 602749 - DNA, 949 bp, Homo sapiens
attaatcccctggaccaacccgtcatctactctaccatctttgctagtgcacactcatcacagcgctaagctcgcactgattatgtgttagctgagctaggcgcctatgaaactaaatcatggctagcttttattcgcagtatctaacctaacaataagataaagccctcgtaccacagaagctgccatcaagtatttcctcacgcaaggctatcgtgtccataatccttctaagtagtctataccgtcttcaacaatatactctaccgagacaatgtaaccataatcgcaatactaccaaatcacatatctcaatcattattaatcataatggctataggcaataataactaggacataggcacccccttgtcacgttcgtgcagctcccgagatggttacacgcacaggtcgaaccccgtctgcacatccggacctgcactgcttcctcatcattggagcaaagaactaggcgctcgctcatctgcagatcatatgaccaaaatctctccgctcactaaacagtaaggccgttcttcctcgactcatcgtctaatcttatcgcatcgataggcaatggccagttgagggttggatttagagaccgaaatccgcaagtataactgctaacatatcgttgagctataacttcctctaattgaacccgacaattaggacttgatcataattaatgacagtttcactacgcgttatcaaaaccgcttaaacattaaacccaatccttagatcttcaacgtaatttcattactttatcccttaaacgtacttacacggggatttcctaactcacttcaaacttttagatcttcccaagcaaccaacgaacccttacttaacttaatcatcagcaacacttgaaaatcaaagctacaacatggaacctaaacaaccctataatattcccaatcacacaccttccacctccata

SEQ ID NO: 602750 - DNA, 641 bp, Homo sapiens
cgcggtggctcacgcctgtaatcccagctctcagggaggctaagaggcgggaggatagcttgagcccaggagttcgagacctgcctggggcaatatagcgagaccccgctctccaggaaaaaggaaaaaaaagaaaaccaaaggacaaaaaaaaaaaaaaaaaaaaaaaaaaaaatgtgtgtgggggcgcccgggcctgggaaaaggtttttaaaacacccctggtgtggggcgccggggggccccatgtggggtcaggtggaacaccggggcccaaaaggggggttccccaagaggaaaccccgggcgccgagaacaagagggggcggggtttcccacccaaataaaaaaacgcgccggcggggcgacagcacgagcgggtgtttgcgacacacaccccaaaggtgggggtctaggagagcactacgagggggtctccaacacacaggcgggggcgaccaaaggaggaggatcgaatgaataaaaaattaacgcgccgcgccggggggaggaaaccctgagaccacagcagcacacgagccacacagacacggaaaccatgaagaagcaagtacagaacacgcacacagacattcagcaacaaccgaaacgacgcaagcagacagcagacaacacacgac

SEQ ID NO: 602751 - DNA, 913 bp, Homo sapiens
gatatgagatggagtctatgcactggtaggtgtagggtcgtgtctgctgacgctggcgcgactcatccggcgagtccttgcagtctctggcggtagtgcggtcaagccgtgagctattcccgtgcgagaggtggggatcgagcgcgctccaggggcaggactgtgaggagggtgctatcgaggaaatcagcttgaaccacagtcgctgtacctctgcacccctggaaagtcgtcgcatgtagggggtccggcatgggcgtcctggcacttgacgcttacctcgtccgtagtctggtgggcctctgtagtgctcacgtgcctttggactgctggggagtcccagagtctcgcaagtcccctctaccagttgcctgttcctagtgtgggggggtaccgatcgaaatcggtggggcagtgggcgtgactcgagcagacttccgaacgagaggccgcgtgcgggactccccgatgttttggaggcgtaccagaagcgccaccaggtgattgcctgacggaggcgagtagcccaagccgcgccgaataggccttcgcaactgagtgcattggcgctggtttctagaatgtaacgccaatttcgtagcccgggctgtagtttcggccctgtaaacagtagcacccttcacgcgcagacgggtcgactgcagactagagtggggctttgagacgcgctccggattggcaacacgctccccgttcattgtttcttgttgctagtccctttattcgaagagttttccatcggctctccaggaggatcctcgctcgaaggcgtccgactcgggcgacgtgtgagccttgccaagtacagggccagggtggcgatttgggcttccgcgggtacctgaaaccccatttcttgactgccccaacgaggatgtcggggctgacaacg

SEQ ID NO: 602752 - DNA, 1343 bp, Homo sapiens
cgctgggtgagtcgttgtattcctagtcgcttgcgggttgtgtctgtttcagtcacattgttgtttgtgctgctcattttggtggtgttggactggtgtgttggtttgtacgacgcgccccttctttgttttcctgctctctgcgtcctctctcgtggtggtatgtgtgcttcgtgttttgtagcgttcgttttttgttttggtgtgtggtgtgaattttgtcgttctcctgtttgtgcctctcgcagatgtgtgtggtggttgctttgctggttcgctggtcgtggagggttgtttctgcggaaataatagtgggggggagagaacgggggcgttttttttgtgtgcgcgcccgccgcgccgggtgtgttgggttgggtatgtgtgtgcttgtttttggtgggaggttgttctctgttgggttggtgtcgccccctcttccgtcggtgtggtggtttgctcccctcgcgcgagggtgtggtgggttggtcccgatcgccgtgtgttttctcttttgacgtgaggatagaggtgtggtgtcccctcccttcgtgtgaggggtctgcgcacactgtgtggtgtatatatgttggtgagtgtgttcggtttggtgcgggtgatggggcgcgctctccttttttttttgacgcgtgctctcgttgggcttggtatgtgtgtgtgtctcgcctctcgcgtctgtgtgatacgagacagtggttttgctcacccaggggtcttcccactcccgcctactggttgtctctctccgcacgcacactcactctctctccagcatagaagtatgtctctctctctggtgagaagatagaaaaagagaaaaaacaggaggggcgtgtggaaaaaaaacacctctttagcacccccccgcgcgttctgtggtgtgttctctcgctgttccccacacacaatatataatagtggtgtggtgtccctctgtgtctcgtgtgtgtcgccaccgctcctcccctactttttattttctttgtttgttgttttgtggagaaagaaaaacctctcttttctctatcctcccggatttctggggcgccacagagaccccctgttctcccccctttcttttctttctccctctaatatctcctctgcgcgcgcgctcttcttttctttcttgtttttttgttatatactaccagcggtttttttgcggcccccccccccaccgagagagagaagaaaccaccccctttttgtggagagagaggagagagaaaaaatgtgtccccacacaaagagagagagaaaaatcccacaccattggtgcgccacccccctgtgtttttaaaaaatttttttaaaaatta

SEQ ID NO: 602753 - DNA, 646 bp, Homo sapiens
  misc_feature (125)..(125): n is a, c, g, or t
  misc_feature (127)..(127): n is a, c, g, or t
  misc_feature (131)..(131): n is a, c, g, or t
  misc_feature (167)..(167): n is a, c, g, or t
  misc_feature (189)..(189): n is a, c, g, or t
  misc_feature (213)..(213): n is a, c, g, or t
  misc_feature (246)..(246): n is a, c, g, or t
  misc_feature (249)..(249): n is a, c, g, or t
  misc_feature (294)..(294): n is a, c, g, or t
  misc_feature (296)..(296): n is a, c, g, or t
ggagccttatcagctggggttgagggaagactggatctagagtgctgctcctgaacttggtctctgagccatggttcccatagacactcaggtccctccagctacaaggtgggcaccatggcggngnagtntgactgccactactgcagggatcccttgcaggggangaagtatgtgcaaaaggatggncaccactgctgcctgaaatgcttngacaagttctgtgccaacacctgtgtggaatgncgnaagcccatcggtgcggactccaaggaggtgcactataagaaccgntnctggcatgacacctgcttccggcgtgttgccaaaggtggcccttcaccccctgtgcccaatgagaccttgtgtggccaagggacaaacaaggatccgtgtgcaacaaagtgtgcaaccaactcggggagggactccccccaatgtggcacagggggggttgcttttccacagggcccattttgtgtgggccagggagaatcaaaaacgtggacgtcccaagggcggaccggtctggcacaacagacgtgcttcacctgtagtaacgtgcaaggcagtcatcgggacgtgaagctttcttccctaaaggggaggacttctacgtgcgtgactgtgcattgagaccaagtgt

SEQ ID NO: 602754 - DNA, 1164 bp, Homo sapiens
ccggccggagcctcgccgacttcccgcgacccctgaagcgccccgtagagcagtcgagatgggtgagtcaagtgaagacatagaccaagatgttcagcacatatatgctagtggagagatggatcttcatgacatcagagtttaggatgttgacactctccctccgtcctgaccgctaatccacccagagcgtgaatttaactacagtgtggggtttaaacgatttaaatgagtccttaaatgcactggtaagaccgaagatttagatgctctcatggcagatctaggtagcagacgataagtgaggctgagcagaggacaatccaggcacagaaagagtccttgcagaatcaacatcatatcgagcagtctctacaagcatcaattttcagtggtgcagcctctcttgtgttatggaacaaatgttgctgccactggtatcaggcaatatgaggatgacttaccagctccagcagccgatcctgtgattagaccttccactgccatcgacagcatccgtgaaccgtctctcatcaggaagaggaagaagcccaagccaaggctgatacagattaaggctggcgctggaaaaacttgaaaggaggccaagggttaaagaagctcggtcagtcaagggtggcaacatgaatgataccaaggactaaacgtcactgattggtggatgagcgagaggtggccgagattgttctggagaacattattagagagaacgtcattgtgactggcaatgtagactggtggtctatgaaaatctaaccgggaaagtaacgaatgagacggttcttaaagaccataacacaggtagttaagagagtagtaacgtggacatgaacgacgcaactcaaatctttccctggaagagaagggaaaatgcggaaaaaaacaggaaaaacagggaagccaccagcacaacaaaccaagcaacaaacgagaacgagccagaaccaggaccaccagaaaaagcagcgggcacacgcagtagctccaagcaacaccatagagaaaaagcaaaacaaaaaagaagaaagagcatcgaagacgaacaccaaaagcaacagaggagagcagaagcacaggaagagaagaacagaacaagcgaagcagccccgtagccaatccccctcgccaagaccacaaagagct

SEQ ID NO: 602755 - DNA, 131 bp, Homo sapiens
aggcaaggtagaggaggaacccgcaaagacttgctctcactggacgttcaagggcatggccgccatgggtctttatagaagggggtggtgcagtgtagccccggacaggcttttttttttattttttttat

SEQ ID NO: 602756 - DNA, 146 bp, Homo sapiens
ggtcatctcatagcacggatccccccagttcctgcttcttgaaatcgtatagtccatctcttctacttcgagatggtccagactctcttagactttgtcgattacgtcatctcccgctaacatggatccttctctggcactcttca

SEQ ID NO: 602757 - DNA, 214 bp, Homo sapiens
gcataacacatagctctgactcttacctcctctctcctactcctgctcgcatctgctatagtggaggccggagcaggacaaggttgacaagtcttaccctccttagcagggaacctactccaccctcgagcctccgtagacctaccatcttctctacacctagcaggtgtctcctcatcttaggggcatcaattcatcacacatatcatataaa

SEQ ID NO: 602758 - DNA, 195 bp, Homo sapiens
ggcccggggaagggccctttaaaaaaaccccccaagggtttttttttggggttggggccaaaaaaaactttttttttcccccctttgggggggggggggaattttttttggggggccccggggggacccggggtttttttaaatccaaggtgttccctttcccggtttaaaaaaaaggccgggttttttccccca

SEQ ID NO: 602759 - DNA, 370 bp, Homo sapiens
cagtggattggataaagaaagtatggtacatacattataccatggaatagtatgcagccataaaaccaaaacaaaatcatgccctttacagcagcacagcagtggtcagcaacctttctgacaccagggactggtttcagtttcctggaatataacttttccatggttgaggtgggatgcggggatggttttgggatgaaactgttccacctcagataatcaggcattagaatctcttaaggagcatgcaatctagatcccttgcatgcacagttcacaatatggtttgcgttcctatgagaatctaatgccactactgatttgacaggaggtggagctcagcagtaatgctcacttacctgctcctcac

SEQ ID NO: 602760 - DNA, 706 bp, Homo sapiens
  misc_feature (395)..(395): n is a, c, g, or t
gatgactgggcaatcgagctcatcaaggtgatgtcactccatcgggaacgagctagccaacagcgtctgggaggagagcagtcaggggtcggacgaaaccgatcggtagactccacgaagggaagagaaggaacggtggatccgtgccaagtacgagcagaagctcttcctgtgccccgtctgcacctgctagcggacgctgtccctgggtccagctacctgttgggggccagcgccgacgaaggacctgcggacggtcatcctgctgatggtgactacggcatccacgggtagcgaggtgtaacgatcactctgacgtggtgaggtgagcacggcctgcactggagctgctttctggtctgaccgcaacggggcaatgtggtcctggtcgcagnctcctgagtctggatacggaggtggatcgtcacggcgccgagtatgcccacgggaacacagcgctggcctacgcccggctgggcctccatgcgcaggagtgcatcgacgtgctgcctgcagtacgggctgacccgacgagctgcttcgatgctcatggcgaccccaagctgtccaggagaaacaataaccggaacaacagcagtgggagggtgcccacgcatcatctgaggaacagccgtgcccgctgctcgcgcactgggacgcggtagctcgccgtattctcgctcaggaagtcagcagcacgtgagtc

SEQ ID NO: 602761 - DNA, 202 bp, Homo sapiens
cggcaacttgaactgacgggtccgcttgaattgacgtgtccgggtctgtgcttttgctaaagccttgttagaaaactaattcacttgttcgtttgacggtggaacgttgtcgctactgtatccgacgatcgaaccgtcctcatttctggacccgtctaattctaagcttgccgcttaacatgctgtcatacctcactctcag

SEQ ID NO: 602762 - DNA, 232 bp, Homo sapiens
  misc_feature (54)..(55): n is a, c, g, or t
  misc_feature (67)..(70): n is a, c, g, or t
  misc_feature (75)..(75): n is a, c, g, or t
  misc_feature (86)..(86): n is a, c, g, or t
  misc_feature (93)..(94): n is a, c, g, or t
  misc_feature (107)..(107): n is a, c, g, or t
  misc_feature (109)..(109): n is a, c, g, or t
  misc_feature (112)..(113): n is a, c, g, or t
  misc_feature (115)..(115): n is a, c, g, or t
  misc_feature (122)..(122): n is a, c, g, or t
  misc_feature (130)..(130): n is a, c, g, or t
  misc_feature (134)..(134): n is a, c, g, or t
  misc_feature (163)..(163): n is a, c, g, or t
atgagctcccgttaattgcagcagcggtgagacgagctctgtatgagcagctcnnaggaattcccannnnttggngctcaggtggntcccaannacctcccttgtgncncannangataatnatcaaaangaanagaaccctctccagcctgctgacccaaanccaaccacacaatggtttgtctcaatctgacccagcggctgaaccctctcgtgtggtcggccatgggta

SEQ ID NO: 602763 - DNA, 424 bp, Homo sapiens
  misc_feature (48)..(48): n is a, c, g, or t
  misc_feature (157)..(157): n is a, c, g, or t
  misc_feature (305)..(305): n is a, c, g, or t
  misc_feature (311)..(311): n is a, c, g, or t
  misc_feature (316)..(316): n is a, c, g, or t
  misc_feature (330)..(330): n is a, c, g, or t
  misc_feature (349)..(349): n is a, c, g, or t
  misc_feature (378)..(378): n is a, c, g, or t
  misc_feature (419)..(421): n is a, c, g, or t
ggtcccaagaacaatttaaagatcactctttgatttgaaagaccaccnattatcattttactaaattcttatatatacttgtgccttttccaactttaagttctcttaagaaaaacatccactgtagctttataaaataccttagtatcagctaggnccaagtctccaggcaggactatcaaaatggactccttcttcctatcagctctagaaccccagaggacttcccagtaggccagctgagcacttaccaggagcatctccctgccttccacagtctcgcctgtctgtctctgccttggtgncctggntcccncctaggagcttttncctcagcttgaatacagtncctggtcatcaaagctgtaagttctcagntgctgcctgcactcatcacctcttcctacaaataaacattnnnaaa

SEQ ID NO: 602764 - DNA, 197 bp, Homo sapiens
ttttcccccccctgggggggggggggggcccggccccctgaagttttttctccccgggccaattttttttcccccccccccccccccaaagggggggggggaagtcccctttttaaagaaatttccccccccttttccttgtttttttttaattttaggggccctaaaaaattggggggttttttttggcttcccca

SEQ ID NO: 602765 - DNA, 492 bp, Homo sapiens
  misc_feature (295)..(295): n is a, c, g, or t
  misc_feature (309)..(309): n is a, c, g, or t
  misc_feature (314)..(314): n is a, c, g, or t
  misc_feature (334)..(334): n is a, c, g, or t
  misc_feature (342)..(342): n is a, c, g, or t
  misc_feature (348)..(348): n is a, c, g, or t
  misc_feature (354)..(354): n is a, c, g, or t
  misc_feature (404)..(404): n is a, c, g, or t
  misc_feature (462)..(462): n is a, c, g, or t
  misc_feature (478)..(478): n is a, c, g, or t
caagcagagctgacaagcaacgtcttaaaaacaggcgtggtgcgctgctgcgtgggacagtgcaacaatgccatccctgttgacaccgtccttaccatgaagaagctgccatcacctatagcaacaggaaggaaaacaaggggggctacctctgcactcctgtgcggagcagcgcatcgggcccctggcgttcctgacagcctcccggagcaggtgcgcgccatggagcgcactgtggagaacatcgtactgcccggcatgaggccctgctcttcctcgcttctgaggacaaggngcacgttcttcgantgcanagcagcttggcgaggacccngcgtgaanaaagcnagcgangggggcttctggtcctgagactctggttcaccacaggactttctgagganacaccagcccttgacctgcattcttcactcctacagacagcagctcacttgctccctntgatgattggcaggantggggtgtctttgt

SEQ ID NO: 602766 - DNA, 222 bp, Homo sapiens
gtgatgctctatcacagctatctggagttggtcaaagaatgacatatccacaagtttaatgtcacaaatttttccagaaaatggatcaccacaaacatcaggtcttttagaggccaggcgtgatggctcacttctgtaatcctagcactttgggattacaggcgtgagccactgtgcccggcctaattaatttatcttttttttttttttttttttggagtt

SEQ ID NO: 602767 - DNA, 560 bp, Homo sapiens
catcccgaccagccctgcactaaatacctttaaagctagtgggaaatccactacctgctgctttaatgttttgataccggcgtaaaattcctctggcgtaatttgtccagccaccaagctacgcgattagggtttttacgtggtcaaccgttcgtaaattaaaaccagaaatacacgccttaaccaatttcgtttgtaccccattgtttgctgaaacgattacagcggttaacgtcacgtaacaagtcaatggcaggccgagtgattgcccaatatgttcaactgtttcttcaatccgaaagattctgccccaccaaggagtaacaagcggccggcatcggtccggacatcgataatatcggcttcgctatagcttggattcgtcatatttgttgccatcaaattcgttcaccatcacttgaacagcgccaagtactgtccttcattcatttaattatacaaaatgcggttattgacgacgacaatattcgtgttacgtcaatagccttttatcagtatacattaaagcacccaatttattggggctttgacttaatgct

SEQ ID NO: 602768 - DNA, 757 bp, Homo sapiens
tggagacgaagtctctctcttgtcacccaggcttggagtgtgcaatgggcattgactcccggcttcactgtgaaactttccgcctcccaggtttcaagcgattctccgtgcctcagcctccgtgagttagcgtgggatttacgggcacctgtgccaccacgcccagctaattttgggtttttttagttagagcacggggttttccaccagtgcgtggccgaggcgtggctcctcgagcctccgtggacctcgagggtgatccccccttccttcggcctcccaagaggtgcgtggggattcacgggcgttgaggccactgtgggccggggcgcttattaagaacatttttaattccaccccaagagatttgtgcccccttgtgcacgccaggttcccttcctcttcaccccccaggcccctgggcaaaggcttgtgttggcttgggccactatcaatcaatttggggccttatccggggtatttcatatgcaagtggaatcatatgggcatagaatttcatgtgactaacaccactatttaaggcataatattttggaaggttcttccatgttggtggggtatatctatagttaatttctttttctcactgacttggttacccacgctgttttgatgtttcgcaattgggttaattccattctccccggttgctgggacattttggcactgctcatggcagggggctacctcatgattaaactggtatgggactgttcttgcacacaaacacaaacag

SEQ ID NO: 602769 - DNA, 895 bp, Homo sapiens
  misc_feature (727)..(727): n is a, c, g, or t
cgaactcctatttgagcaataacgcatatgataacatgtgtcgaaaccaaacatcacagtttgggcaggcgacgtcctgccactggtgtccagcacgggtgaggcgcgatcccgggctacaggagcgttccacttagagcctacgcggtctcaatacaggaattattagatatagcgttcgttggactcccccaaagacattggaaagccacgcagacttcataggcgagctgatcctgcgggaatagagaaattacatcttactccgtgagcttgcgagtagatgttaatgctttgtcctcacttgggccgccttcacaacgagatcacgagtacgcccttcgatggcacagcgtggaggaatggcatccactctgagcggtgagtggatcctaccacgcagagtgagtggattaccccgagagttacatcttacacgccgaagcacagcagaccgaggccagaaatgatacccaagtgatcttcagaagctgtcacgactctccctcagtctgctttgaccctgagtgaagtcgttccaaactctagcggccatgtccattgtggctcattgcacgccgaacgggatcgcctgggcgtggcgcgcgaaatctgcggtgtgagcgcactcctcgggtctcccaggcccggccgcccgtcgttgctctccggatcgctggctggccggactcatgcggatatgagtgccctgtgatgccatggaatntctgcccgagggttgcacacgacggtcgtgccctggtatggcgccgcggtgcaccggggccacgtgttgggggcctcttcgtgactgggctgcgcgcgctgtcagtcagcgtggcgccccatcgggtaggcgctgggcattccgttctttgcgcggccttagtgcact

SEQ ID NO: 602770 - DNA, 141 bp, Homo sapiens
tcctcccaaacctgtgccaacaagaccctggcttctaacctccctggttcttattaattcgaacagcatacccccgattccgctgcaaaccaggggatccctcctagaagtctgacccttgcaggcacttcaaagcttgtg

SEQ ID NO: 602771 - DNA, 396 bp, Homo sapiens
acgtcaactattccctctgcatctgaataggcatgcttcaaggcaacgcttgctttccttagactgtgcatgtccgcttatttgaagtctttgtccctggatgtagacattccatactcatatgttgacagtatgcagggaagcttctcgtgttagttgcacacaatgcagtgccgttctttgggcactgatacggtagtttacaagcacaggtgccctcaatgcatttatgccatggctggcagaatccattaatcgcaggtcatgtcagtatatttatctggtaagcactttttctccaccagatcttcctgagatgtataagtgaccttgccaaaccttaagtgcaagcacagacatatcagaacagcatgcactagcttcatgttgctcgtg

SEQ ID NO: 602772 - DNA, 807 bp, Homo sapiens
  misc_feature (173)..(173): n is a, c, g, or t
  misc_feature (460)..(460): n is a, c, g, or t
  misc_feature (466)..(466): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctggagtgcagtggaatgatcatggctcactgcagccttgaccacccaggctcaagcagttccacctcagcctcttgagtagctggaaccatgggtgcacaccaccatgcttggctgattttttttatttgtagagatgaggccttgcaatgttgcctgggctggtctcaaactcctgggctcaagcaatcccccccaccttgcctcccaaagtgttgggattacaacatgagccattgcata

SEQ ID NO: 602773 - DNA, 948 bp, Homo sapiens
  misc_feature (570)..(570): n is a, c, g, or t
agctcagggtgttgaagtgccatcaaaagactcttgccaagagaataggccaatttaactgaagataaaagagaggacaaaaataccacagcgagctagaaagtaaaagaagtgtctgaatcaatggaattatgtgctgcgtgtcagaagtgatggaacaaggagttaccagaaataggaagagacaccacctcctgttgaaccagaagaagaacgaagatactgaggatgctggattggatgattgggaagctatggccagtgatgaggagacagaaaaaagtagaaggaaacacacgttcatatagaagtaagagaaaaccctgacgaggaggaggaggaggaaacgaaggagggagaagacgatgaagaaagtgaaagaacgaggaggaaggaggagggacgaaagtgaaggcacgtgaaggtgatgaggaacgatgcccaggtgtcagatgagaaggattcagggatgacattagataaaaagccaagtaaagaaatgagctcagattctgaatatgactctgatgatgatcggactaaagaagaaagggcttatgacaaagcaanacggaggattgagaacggcgacttgaacatagtaaaaatgtaaagcactggatataggctaagagccctattatctgcgtaacttgaggccatgtggacacagggaagacgaagacattctaagaataaggctccggtaaacaccatgttcatgaaggggaaccagggggaatcacacgaagacattggggtgaccaatgttactctggtaagcttgtaatggacagaccaaccattagtcaagacattggtttaaaacaagattcgggtgcaagaacagccacatatagagacacccgggcgatttccatagtgatattaaaaatccattttacgccgcataaagtagaatatattaggtgggccaacatggtgtta

SEQ ID NO: 602774 - DNA, 759 bp, Homo sapiens
tgtgtgccacagtggtgactgcacagatcaacccatcacttaggtattaagcccagtatgcattagctattttttctaatgttctccctcccccgacctcaccccccaacaggccccagtgtgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccagtgttgtaacatgtatcagtactttattcctttttgtggccaaataatattccattgtatgattataccacattttgtctatccattcatccattgatagacactttggattgtttccactctttgtggctatcatgaataatgctgctgtgcgatgtttgtatacacactctctcgtgaacatgttttcacgttctcttggatatatacctaggagtggaatattgggtcatatggtaatcgctgtgttgggacaagagccagccgaacgtggtatgtccgcaagagttgcctgcaactccttgttagcagttccccagtagccaggttcactggagggtcacaagtttactccacgatccttgccagcatttcgatgtctacgtgtccttcgagcaatcgccagcctacagttgtgaaatggtatctccactatctg

SEQ ID NO: 602775 - DNA, 1095 bp, Homo sapiens
  misc_feature (173)..(173): n is a, c, g, or t
  misc_feature (748)..(748): n is a, c, g, or t
  misc_feature (754)..(754): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcaggtacagagcagaccccgcctggggccccgcccgcaaagtctgggagctgccactgggaagaagatgcccagagtctgtctccaagagggagttggaaataatttgtcctagtttctctgtggattcagtcaacaaattgctgtcctcggggaacacactagctaggaacccaacatatagctcttcttttggagggcagcatagaggggctttgggccctgggacccagtacgctgtggtttggtcatagagagctgagtccagctaactcccctgcttcttctccagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctggagtgcagtggaatgatcatggctcactgcagccttgaccacccaggctcaagcagttccacctcagcctcttgagtagctggaaccatgggtgcacaccaccatgcttggctgattttttttatttgtagagatgaggccttgcaatgttgcctgggctggtctcaaactcctgggctcaagcaatcccccccaccttgcctcccaaagtgttgggattacaacatgagccattgcata

SEQ ID NO: 602776 - DNA, 115 bp, Homo sapiens
ctctagagtgatcccctggcctcacccgtagctgtacctcacccgtagctgttcctcacccgtagctgttcctcacccgtagctgtacctcacccgtagctgtacctcacccgta

SEQ ID NO: 602777 - DNA, 499 bp, Homo sapiens
gacgctgtagagttagtcaaggtcatcacaccaaagattttaccaggcagctccgaatcctgccatgccacggtaactgccatgatagccagaaagttgttgtatgggggcaccgtcgctcacagccgagaccatttaaaagaataacatctcttcaggccacgtaccctatggacctctcacgagaccctctgagcaactggactatctttccaaagtccaggtattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacgggtac

SEQ ID NO: 602778 - DNA, 752 bp, Homo sapiens
  misc_feature (173)..(173): n is a, c, g, or t
  misc_feature (460)..(460): n is a, c, g, or t
  misc_feature (466)..(466): n is a, c, g, or t
  misc_feature (492)..(492): n is a, c, g, or t
  misc_feature (510)..(510): n is a, c, g, or t
  misc_feature (676)..(677): n is a, c, g, or t
  misc_feature (684)..(686): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtcatgctntgttgccaggctggagtncagtggcaggatctcggctcactgcagtcctcccggttcaagctattctcctgccttaacctcccaagtagctcggactacaggcgcgcgccaccacgcccggctaatttttgtactgttagtagagacgaggtttcaccatgttggccaggtgtctcgatctccnnacctcgnnntccaccctcctcggccttccaaagtgctaaggattacaggtgtgagccattgcactccgtaaggat

SEQ ID NO: 602779 - DNA, 123 bp, Homo sapiens
tgtagatagtggttgttgtgatagcataacctgttattggtttcttccaaaacaggtgaatacacagaaaaggcaacagaggacagataaaagacccatcagtatcaggagcctggtcccatg

SEQ ID NO: 602780 - DNA, 837 bp, Homo sapiens
  misc_feature (173)..(173): n is a, c, g, or t
  misc_feature (460)..(460): n is a, c, g, or t
  misc_feature (466)..(466): n is a, c, g, or t
  misc_feature (577)..(577): n is a, c, g, or t
  misc_feature (595)..(595): n is a, c, g, or t
  misc_feature (761)..(762): n is a, c, g, or t
  misc_feature (769)..(771): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctgggtcatgctntgttgccaggctggagtncagtggcaggatctcggctcactgcagtcctcccggttcaagctattctcctgccttaacctcccaagtagctcggactacaggcgcgcgccaccacgcccggctaatttttgtactgttagtagagacgaggtttcaccatgttggccaggtgtctcgatctccnnacctcgnnntccaccctcctcggccttccaaagtgctaaggattacaggtgtgagccattgcactccgtaaggat

SEQ ID NO: 602781 - DNA, 230 bp, Homo sapiens
cgaccttacttagggaggaagagtgtgctatagtatatgaaagctccaccctgtttgtatctgtcttaactctataaattatggactctgagacttagtctaattacaattgaaacgattctggaagcattgtaattgcaggttgaacgtattcaaaagtaactattgaacatttggcattttaacattatttttcttaaaaaattgtcaaacattggaccatacattct

SEQ ID NO: 602782 - DNA, 626 bp, Homo sapiens
  misc_feature (173)..(173): n is a, c, g, or t
  misc_feature (460)..(460): n is a, c, g, or t
  misc_feature (466)..(466): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctggccggagtgcaatggctgggcttggactgggcctagagagctttgttatttttattttt

SEQ ID NO: 602783 - DNA, 157 bp, Homo sapiens
tgctggggatacagggagtgagccactggcacccggccccttctactcacttgggattcaatttggctaggtttcatggctttagcttcccttggcacaccccaaccccagcttttaaaggtaattcttttttttttttcccaatttttcaacataa

SEQ ID NO: 602784 - DNA, 649 bp, Homo sapiens
  misc_feature (173)..(173): n is a, c, g, or t
  misc_feature (460)..(460): n is a, c, g, or t
  misc_feature (466)..(466): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctggccggtattagtccattctcacactgctaataaagaactacctgatggtcgggagcagtggttcatgcctgtaatcccagca

SEQ ID NO: 602785 - DNA, 663 bp, Homo sapiens
  misc_feature (173)..(173): n is a, c, g, or t
  misc_feature (460)..(460): n is a, c, g, or t
  misc_feature (466)..(466): n is a, c, g, or t
tccgggatgactatgagaagtccaaggctcgggtgcagccactgagacggcgaatcccgccgccgctcttcctctgacacagctgcctacccagcaggcaccactgcggtgggcactcctggcaacggcaccccctgctcccaggacacaagcttctccagcagccgacaagntaccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccattgcactccggctgccgggagtgcaatggctgcccggattgcaatggctgnccggantgcaatggctggccggagtgcaatggctggccggagtgcaatggctggccggagtgcaatggctggccggagtgcaatggctggccggagtgcaatggctggccggagcgcaatggctggccggagtgcaatggctggccggagtgcaatggctggccggagtgcaatggctggccggagtgcaatggctcgatctt

SEQ ID NO: 602786 - DNA, 452 bp, Homo sapiens
ggaccccaagggagggctcttggatctggcgcgagaaagaattcagggcgagtccatggtgcacagtgaaagcaagtttattaagaaagtaaaggaataaaagaacggctactccatagacagagcagccctaggggctgctggttgcccatttctttcttttcttttcttttctttcctcttctcttttctttcttttttttgatggtgtctcgttctgtcactcaggctggtgtgcagtggcgagatcttggctgactgcaacctccgcctcccaggttcaagctattcccctgcctcagcctcccggctgcttacggctgaggtgggaggattgcttgggctcgggaggttgaggttgcggtgagctgtgattgcaccactgcactgtagcctgggcaacagaacaagagcctgcctcaaaaaacaaaacaaaacaaaacaacaaaaac

SEQ ID NO: 602787 - DNA, 602 bp, Homo sapiens
gtacagatggggtttcacagagttggccaggttggtcttgaactgatccttgtgatccgcccgcctcagcctcccaaagtgctgagattatagatgtgagccactgcgcctggctcccttccccaccgactcttaggcccatgttagcagccagcagtgggtaatctacagtctctctaattctgagctcctttgtggtcacatacaggaagggaggccaagtggcagtgagaccacactagggtaacaccagacttaccagccaccctcaggagagaaccgaagcaggcaagcccccagctctcgggagaaccaccttctcctttggcttcaggcaggtgaggaggctgtactcctgtcacagctcgagaattataaaggatgcttacaaaagaactgtttttccctaccgtcagttataaaagcctggacaacagagcaagactccgtctcaaaaaaaagaattggctgggtgtggtggctcagacatgtaatcctagcactttgggaggccgaggtgggtggatcccttgagtgtaggagttcaggaccagcctggggaacatggcaaaaccccatctctacaaagaaaagatagatag

SEQ ID NO: 602788 - DNA, 655 bp, Homo sapiens
  misc_feature (638)..(638): n is a, c, g, or t
gctgtggccacagtgataaccaaagcgtatagtaccatcgatctgcgataaagcactggtagcttcaggtcccggtttcctttgtaggctaacaggatctaggcctcatagtagctccgagtagatggtataggaattttaatcgtgcaagctgtggccgtattaacgaagatcttacagcagcgtccattggaacatcatgtgccatattagaacgaactaactcgaaactcctacacatgaacacatgcacagttatttgatgaaggtgactattcacttgacacagtgctcgtcaacttcatacgatcagcctaaacgctataactctgctacttgctataactttagtgctatgtctgacactatgatgctataagtgatatgatgttgcaagacggcaaagacatcgcatacctttgccgattgccatgactatatactgatgtgacgtaccttgctctttatgacagttaagtgcagtgatggatgcatagagaacctatatagagctaggccatgcttacctatatgccgcgtactacttagactattgatagtgggattacgagcaattaactgatggttgcaagcttatagtgctacgttcacgtggcagaccacggagacgtcagctntacagttgcttatgccc

SEQ ID NO: 602789 - DNA, 377 bp, Homo sapiens
attgcttggaaccttggaggtcaggctgtcagctgagccatgtattgtgccactgtactcttagcctgggcgatagagacgagacccctatctcacaaaaaaatagataaaagatacaactattagatagtattatttttccacctctcgtggagatccctttagaaatgtcattgcattcatcatatcattgacaagtgccgttttctgatgatgtgattgttcgccgcctcctggggatacaaaaattagtcaggtgtggtggcacgtatgtgtaatcacacctgactaatttttgtatttttagtagagacggggttttaccatgttggccaggctggtcttgaactcctgatctcaagtgattgttccccgct

SEQ ID NO: 602790 - DNA, 316 bp, Homo sapiens
  misc_feature (91)..(91): n is a, c, g, or t
  misc_feature (311)..(311): n is a, c, g, or t
aggtgaccctatgaaattgacttaaaaaagttgggctggatatagtggctggcgcctgtaatcccagcactttgagaggctcaggccgtanggtcgcttgagcccaggagtttgataccctgtctgagagagaattagctgggcatgttagtgtgcgcctgtggtcccagctactcaggaggcggggcgagagggatccttccagggctgagatgtgagggttctttgagcccagggaggtccatacttgcagtgagccattgattgggccactgcatttcttagccttcagttgacaagagttgagactntttta

SEQ ID NO: 602791 - DNA, 114 bp, Homo sapiens
ttttttttttttaaaggcacagaaaaaattatgggaaatccctggaatacttttggaagtgtagctcggtattcccaaacaaagtaggtgggagaggtgggagaaggaccggtg

SEQ ID NO: 602792 - DNA, 151 bp, Homo sapiens
tcagcacatttagttatccctgtgtatcccacatatatcttacttgggagcactttttttttagtcccgatttacatccggggaactggtgtgaccatgctttaaaaaaaacggtggtaaattaaagataagatttaccatcttaaccatt

SEQ ID NO: 602793 - DNA, 331 bp, Homo sapiens
  misc_feature (112)..(112): n is a, c, g, or t
  misc_feature (198)..(198): n is a, c, g, or t
  misc_feature (233)..(233): n is a, c, g, or t
  misc_feature (288)..(288): n is a, c, g, or t
  misc_feature (327)..(327): n is a, c, g, or t
ccaggggtggaatgatatggtttggctgtgtccccccacccaaatctcatgttgaattgtgatcctgagtcttggaggtagagcctggtgggaggtgattggatcatggggncagatttcccccttgctgttctcatgacagtgagttctcatgagatctggttaagtgtgtagcacttccccctttgcttgctctcnccctctgccatgtgaagaaggtgcttgctttcccntcgcccttctgccatgactgtaagtttcttgaggcctcgcagccatgcttcctgnacagcctgcagaactgtgagttaattaaacctcttttcntcat

SEQ ID NO: 602794 - DNA, 885 bp, Homo sapiens
tttgggaggctgaggcgggcggatcacgaggtcaggagattgagaccatcctggctaacatggtgaaaccctgtctccactaaaaatacaaaaaaattagccgggcgtggtggcaggagcctgtggtcccagctactcaggaagctgaggcaggagaatggtgtgaacctggaaggtggagcttacagtgagctgagatcacgccactgcactccagcctgggcaagtgagactccatctcaaaaaaaaaaaaaaaaaaaaaattcttcttttgacagataagggatccggggttcgaaaaacgagggtgacctgcccaaagtgtccaaagccacacttacaaggcaacaaataaggggtttaaagctagcactggttagacttcaaagcctcttaaccattctactggccctgctgtagggcatggggaaatggggggataacgccagggttggccatcacaagatgttaatataacaattaacttggcaaatgggatgggcagcccctggttaattgggccccacgttggtgggcccagggtacacgcggctaagcactataataaccctggttaagtcactccaaaccagaaatgctcccctacacgcaggttctaataggggtcgacgtgtgggcacttaagcagggaacctgagtaagtaagccagcacagggccggtggacgtgactccaggctggtaatcccagcacttggcgaaggctgagcgctacgggtggcacacaccttgaggcaggagtttacaagaacaaccccggccaattagggccaaaccccgtgttttacctaacactttcacacaactgggtaggcgggttgttcactgcacgccgtaaatccaggaccacaggaacctacgcagg

SEQ ID NO: 602795 - DNA, 1286 bp, Homo sapiens
ttcaaaagagcaggctgagagcttcaaggtgcaagatcctgttcatcttcatcgacagcgaccacaccgagtaaccattctgcatcctcgtagttctttggcctgaagaatggaagagtgcccggccgtgcgctcttatcaccctgcgaggaggagatgactcaagtacaagcccgaatcggaggagcttgacggctagagaggatcatctagagtttctgcgcacctgctgtcctggaggtgctagaactccagaccctaactgatgagcctggagctggctgtaggattgggtacaaggagtgcatgtctaaggctgcgttgtccgggatatgaaccttttgtagagtacgtggccttttgtgactgatgcaaatacacataggggtcgtagggtaggagttactattgtgcccagtggttgttggtcacgtgcgaaatggttttgagcgtcacgcatttttgcggactaaaagctgcgggaaggaagatcggttatgagaagggcatcgcagtggaacgaaacgattccgttgggagttcgtcgcgaatgaattgcgaacgtctggactgtggcccaatcagacgggttgggacggggcggatcgaaaagggttgtaaccagagctgtccccccatgaaggtcaaaatgggttcgtttgacggcattgatcccagtgtggcccccgaacgacgggcaccggattcgactctgcaagtctaacgcaaatcggggggggcaaaacggcagaccgccattgggaactggggtcgtgtataacacggcaacaagtttgccttggggtagcaacgccaggggctgggggcaccaattgcgggcacttggtgtggggcccacgggggggagaatttgtagcttggactgggaactccacttccgagaagtgagatacccccgttgggaaaaacgcgataatggaccacggggagggggtatagccacaggggaagccaatttggcgccaggggaccctgtaacaggacgctgcaacttacaaacgcacacagcacagacctttgcctgcaaccaacgtgtattttggaacagcggtggcctaacaaattgtacacggccgcatcgccggctccttagtgtaaacaccccccggttgttgtcatggcccattgttccccgggaaaggaaactccgcccattttggtggcgcgggcttggcccgttggtgacgcgccaaccgcgcaaatgcccaagggacacagtggcggaccaacaggtctgtttgcccggcaaacgcacgcactttccg

SEQ ID NO: 602796 - DNA, 894 bp, Homo sapiens
  misc_feature (37)..(37): n is a, c, g, or t
  misc_feature (67)..(67): n is a, c, g, or t
  misc_feature (121)..(121): n is a, c, g, or t
  misc_feature (547)..(547): n is a, c, g, or t
  misc_feature (583)..(583): n is a, c, g, or t
  misc_feature (606)..(607): n is a, c, g, or t
agcggaggatggcggcggctggggctggccgtctgangcgggtggcatcggctctgctgctgcggancccccgcctgcccgcccgggagctgtcggccccggcccgactctatcacaaganggttgttgatcattatgaaaatcctagaaacgtggggtcccttgacaagacatctaaaaatgttggaactggactgttgggggctccatgcatgtggtgacgtaatgaagattacagacttcaatgtgtgactgaaaacggggaacgattgtggatgctacggttgtaaaacagtttggctgtgtgttccacaattgcctccatgctcattagccactgacatgggctgaagacggaaacgacggtggaggaagccttgtactatcaaataaccacagatatctgctcaaggagctcgtgccttctcgtcccgttgaaaactgtacatgtccatgcttgggctgaatgattgcaatcaagggtcgccctggcttgattatcaaattgatatcagggaatcccaaaaaaggagaggcagagaagaantgagccctccctcggcgacctccagcaggccacacnagctgtttcccacctgctgtgcnntcaccttagatgttcagaagccgcttcctctccactgaagagctatgagatacgcacaatacttgctgttcacgttatgactctcatgcaagcaagatacacagtttcattgttctgaatccctgtggtttctttcagcccacttttatccgccttaacctaagttaatgtatattttgaattggtgtgtatgacctcagaactgaaattggataatgaagtttgcaagttttgatagcccgtgaagtgcataagtatccaattttacctgaaatttgatttggggg

SEQ ID NO: 602797 - DNA, 877 bp, Homo sapiens
  misc_feature (588)..(588): n is a, c, g, or t
ttgatatatgttttttttggccccgcgggaggttttttaccacccacctgtgtcggcggtttagatatatacgtaagccgccttatgtttattgaacggagcgtaaaaggcctttctttgaggaatttaagtttcgtttctcccccccctgtggggcacaccactgcgacaactgttcaatcccccctgtgtttgagatcctcctgttggagtctttttggcgcccccaaagcaccacggtttttctggggtgaaaaaatttggttagaacacaaccgcccccgcactcttcccctccttctctctttaaggggacaccacccaattttgttactctagtcttgaaaaaattatttatttttgtgttgggcccaccaaaaacagcacgaactctcgggcaaggaaggctcacccccacgcaccactattgtcttgttgagaaaagagcgcacgatctttctctctctgagagacccaaatcgggcctagtccacaccaccaaatatagtgggctgcagaccaccccccatcgtgttggttaaatcgatccctatgctaaaaataattttctgagacaagtttatgtgntcgaacccactattatatatcctgctatccacccacgccacattctttttattttgcccccaaataaagatcgaacccacccctcttatcccccacccccgctgtatgagagaaaataataataatatgttgttttagaaacaataaagcttataacccccctacaaaaagaagcattcccccttgttttttttttttttttttctccccaaaaccaatttggaaatttttttccaaattaaaccacccttttgttcccccccaaaaaaaattggggggccccatccca

SEQ ID NO: 602798 - DNA, 816 bp, Homo sapiens
gacagagcagcctggcgggtgtcctaccaacaagcctccgtttctccttcctgtacgctagggctcctgaaactcacctgatgaagtctccgtctgtcacccaggctggagtgtaatggagcaatctcggctcactgcaacctctgccttccaggttcaagcgattctcttgcctcagcctcccgagtagctggaattacaggcgcatgccaccacgctcggctaatttttcgtattttcagtacaagacggagtttcaccatgtaggtcaggatggtctccgtctcttgaccctcgagatcagacccgactcggcctcccaaacgtgctgggattacaggcgtgagccactgtgcccggcactagcgatttctaacatactaatctacgaacgtactctgtgagagcaaatgcgtctaccttcgcaggcgcatggcggccaggacatcatctacaggactcaccacttggcacacaacatcgtgaccggcacgaaagcatgaacgcacacatactttaccacaaagcatggggcctgctacggactcgaaacccccagtacagcaccgaaacgaattggccccttggacccatccaggaccttcagttccctcggacgaacaaccgcgttccagaagcgaacattccccaagcggttggcctacaaccccagattcgctggtgaccaaactcaccatctggccccactgggccccccgcgcacaacgccaccggcaccgcacgaagccacctcgcaacaaaaacccatctcacgccccctcacgggcgccccacgcgcagggggtgccagtcacc

SEQ ID NO: 602799 - DNA, 188 bp, Homo sapiens
atcgtcgtctctgacagcactgccgccacgagcgtggccaggccatcgttttggctcagtggtgtcagcacctcgttcagtccatcgacttcacccagacccgatagcaataccaggcacgaggatggatcgcggaacccacacagggcatcgaaatcagtaagggcgacgatcatctcgggcttggg

SEQ ID NO: 602800 - DNA, 123 bp, Homo sapiens
ccgcgttatgtcttacgctggtcccagtattccctaagcactgggggtcttttttagaatgtgccaccagagtcaatgtaagaacacttttgagagaattacacctatactacactgttgtgt

SEQ ID NO: 602801 - DNA, 162 bp, Homo sapiens
tgtgatttgctatagtcactaagcgaatatatggcagaaccagctgggcactgcagcgcgggctatgatcgctccatgcactccagcctgggggacaagagcgaaactccttttcaaaaaaaaaaatttacatataagtaatggcttaatgttaaattctgg

SEQ ID NO: 602802 - DNA, 202 bp, Homo sapiens
ttctgctaccagtcgagcaggtcctgagcgggcacggcctggctggaggagcggacgcacacacagccaggagctaggtccctgcggccctcgggacgggggaagagcgtcaacaaatttatggagagtccagccgctgggtcggattgagacaaaccattgtgtgatagggttatgggtcagcaggctggagagggtactg

SEQ ID NO: 602803 - DNA, 430 bp, Homo sapiens
gatacgggctgtagccacggctcccatctgggtacccagggaacctacatgtagctcgtgtgcagagagcccacattggccacccaaaagcaattgaggatggagcaggcttggggctggagctcattatttggaataacaaccacatctgcacagagaggacctgataagatgttgtccttccatctatatctgggaatcctgtgtagggtctctctgtaatgacaggggcagggttggctccttggcctctagttagcctcacgagtagtctagtaaagattttgcaaacttgtcaccatctgtggacattctggtcagctcttgttttcaccctactgacttcttcaggcactaggctgttgctttagaccattaatggtttttcttcctcttcaaatcagtaatcaataaatcctcttcaaatcag

SEQ ID NO: 602804 - DNA, 231 bp, Homo sapiens
ggtcggcctcatctcgttggattgcacatgcagtcaggctgcatgtgtttcgcatccatcaactcagtcatggggcatccaggggtgtcaggtgtgcacttgtaggtcaagcacagatgggctcagggccatttttcacatcttcagcagcgcacacagcctcatacatccacatgcagcccagcctccatcacaggggcataggccacatggcatcagagtattcatcag

SEQ ID NO: 602805 - DNA, 238 bp, Homo sapiens
acaccacctgagtcacacatgagtctattgatgtttgtgaattcttcgataatggcccatttgggcaaaaagccggttagcgggggcaggcctcctacggagaggagggtgaatggaattaatggtgttagtcatgttagcttgtttgacatacaagatccaaatactgtcgctgtgctagattctaatttgtgcaataataatgcggtagtcgttaggataatataaatagtttaat

SEQ ID NO: 602806 - DNA, 430 bp, Homo sapiens
agcactgtgagcctccccaggttctggaacagcttttatgtcctgtacccagtgttaccctcgataattttagtaagccttccagattcctgatcacccaagggaggcataggaggctcacaagtgcagcactgtgagtcctcctatgagcactagtggccatcctgctgtgtaatcccacgaactctgggcagttggagagaagcaggcatgactcgcttgagcatcaggcagttctgagaccagcctgaggcatacaaagcgaaggtatctatgaaaaattaggaaaaaacaaaaatttagcagagagtagcagtcatccgcctgtggatccagctaatcaggagactgaggcaggaagatcacttgaaccactaacagccggagttggaaactgaagtgagcaaataccacgccactccattccagc

SEQ ID NO: 602807 - DNA, 136 bp, Homo sapiens
  misc_feature (88)..(88): n is a, c, g, or t
cactctagtccaacaactgagtcgtaaatcttcacaaccaaatccataaaccccaagtgacatgtgctcgtaccactgctactagccngtctgtcgtgtgtacaacggtctcttatccatataaagcatcttcaag

SEQ ID NO: 602808 - DNA, 236 bp, Homo sapiens
  misc_feature (188)..(188): n is a, c, g, or t
gaagagctgggtggtgcacttgggttggaggttctctggccttgacgatcaagtgtaacctggatgggaaggacctcgggctggggaggggctcccgttctcaggatggcctcacggtatcccacctctcatgacctggctacctcatgccgagtccctaaggacgtgttaaaatccagtcctgcctnacccaaacctctgacttagtctttgggctgggcctccacaacctttca

SEQ ID NO: 602809 - DNA, 442 bp, Homo sapiens
actgtgaattcagttgggtgtgtagctcaggcctcaggcataaatacccagcacttagggaggtcaaggtgggaggatcacgaggccaggagtacgagaccagactaaacaaaatagcaagacctcatctctaagaaaataaataaataaaaaacaaaaacttgtgtgaataagcatactatattacaatataaccaaatgatctcggccttcacaccatcttctaggacacctctgcaccatgagagcctagtgaagagaagcgaatgcgcaggctgaaagcgcacaagaggaaagatgaggcagaggtccaagtaacgcacaagcttatgcacccatggaggctacaggagcaaaaacatggaatccagaggctggggatgctggtacagttattgaggctgctgctattgtctagagcttgttccagtgcatctagaac

SEQ ID NO: 602810 - DNA, 150 bp, Homo sapiens
  misc_feature (147)..(147): n is a, c, g, or t
gatctagcaggatcctggctcagtgatctcctgcacagatctatatagctgggataaggcgctgcacacagcagctaattttgtattttagtagagacggagtttcactatgttggcaggtcgaactcctgacctcaagtaatccanctg

SEQ ID NO: 602811 - DNA, 935 bp, Homo sapiens
gctgcatgggcccctccccgcgtgtctcaggagactgctggcttttccaggtggtggtagagaggtcccgaagccgtgtgcacagagtcctttgtcccggcggcgttacatgtccttcacgatgttccgtggaggcggaggacaatgcccgcaacgagaacctgagtaacagatacttgacagcccacccaggtctctgagcaggaacatccacacggtcaggagctggcagagctaacaggtgtgactgttagagttgccagaggagccacagcgtctgctggaaccaggcagaacgctgaagggtgtcacgcagcgaggaaggctgctggttccagtgaatgacgctgactccgctgactgtcagcaccttgctggatgcctcggcaaagcactggcaagaaggtcatgcagaaggaaacaattcaggaccaactggtgtggctcctgaaaagctcttttgatgaagaagatgagcgcaggctctgctacgtcctgcctgtgaaacgaatctcttcaggaaaccagaggcttccctcatttaccttttctcctacaaagggaagcagctgaaagaaacagtccagtacttgacccatgccccacaaaagtctactatccaatatggggcagcttaccaatggttcctaccaactttgtgaaccgcactagcgaagtaactcgctatgacaactactgcgctgtgcttaggccaacgggagaaaatttatgtccgattctgcgtgcataagtctaccgacatggccactaacgggccggatagcccattgccgggccaatgctgtcatcccggcctttgaatagctgcgcccgcgggctgtctgaccctgggtatcgcacacccccacacacgaactccctccattaagaaacgggttcgcactcacaggggacagcaaggaagcactccgcag

SEQ ID NO: 602812 - DNA, 607 bp, Homo sapiens
atgacagttagagcgaatacgtgattagatggtatagcgataataacgagatgagttagggttgtctgtggcaagtgttcaatatctaggctgcagtattgatattattatattggtaagcaagtgaaacaaaaggaaatgaagttaacatttctataaaagtctttttcttgtgaaagaccaaaggctgtgtctaatctattaatgttctatgaagagcagtgatgacatacaatctgcgaaaggcacaaacacaaatagtatggctggagctggtttacagcttatattctatcaatacatctcagccagcatgctctggaagtgctgtagctgttctctgctttcacttttcagcaacttcagaactgagtccatgcccagctcatatgtagtcacactaaattgtgtttgcagtagttgaaaaggaaaaaacataagaaaaaaaagcctaaaggtgtaactttggaagtacagatatcataaaggttactcttttctatgagcattttaatgggaggtcttgccatttgacacatgaatattataaaacttataatattctggctgtggctgcctgtgagaaatgtgtttgtagcttgagcaa

SEQ ID NO: 602813 - DNA, 109 bp, Homo sapiens
atcctcccagagagcacttctctgaagtagagtcatccagtcacttcagtcccataacttttacctgttccaaagccaatactgaagacctcccaaaaattggttggtt

SEQ ID NO: 602814 - DNA, 189 bp, Homo sapiens
  misc_feature (83)..(83): n is a, c, g, or t
  misc_feature (103)..(103): n is a, c, g, or t
  misc_feature (132)..(132): n is a, c, g, or t
tggctattctcccgttcggcagcctgcaacgaagctactggagctcatcggccgctgcactgacctcgctgtcgattgcgccntggccggtaagactggcgtnatcggccaggacgaggagaacggcgacangttgacgaacatcgccttcgatcggatcaagggcggcaagcctttcgacaccactca

SEQ ID NO: 602815 - DNA, 315 bp, Homo sapiens
ccggtgataactggcaggtaccatagttttgtgtgtgcgtgtgtgtgtgtgtgtttcttaatcagcgtctcagtttcaattctgacctggcctaatcatactcgaactcaaaggttaattttggtctaacttaaaaatctgatgctctcaagagacagccttgttggaccattcaacgatccagttgtttctcgccacccccccttgttttatacctcgtcactacagatgccacacttcaacgtagctcctttttatctacttcttagcattatgttctctgattcttttgctaatgttcactgcccacaaaca

SEQ ID NO: 602816 - DNA, 383 bp, Homo sapiens
tcagagtctgtgggaactgaatacgcgacaactggagtacgattgaccgcaggcgcgacaggggtgctctatgctatatttccggaattaccaatttggtgccaagttaaaggaagggttttgggaaacctgttaaaacggccccggggcgggccaaaaaatttttggaaaaattttgaaaaggcctttcagggcggaaccccttgggaaaataagaacgtccccaaagggtttccaaaaatttataaaaggggggggggggccttggggatttttggggacccccccccccgaacaaattcgtggggggacccttttggggcccatttgagggttttggcccgaggggccccccgggggttttgggggccttcccccggggt

SEQ ID NO: 602817 - DNA, 356 bp, Homo sapiens
  misc_feature (178)..(178): n is a, c, g, or t
  misc_feature (198)..(198): n is a, c, g, or t
  misc_feature (248)..(248): n is a, c, g, or t
  misc_feature (258)..(258): n is a, c, g, or t
cacaccattccaggtttgtaccaaatggggctagggcatagtaaatcaccattactatttaggaaatggtacaagtgtcaagttcccagactccaaacaagtgctactcttgcaggcagacctttctaaagatagcagtctcacacttgctatgttaaatattttctgcatatagttnattagcatatttcaagtttntattaaacatgaaagtaaacattttaaatattttttaaaaagttaatttnttcttaatanatcgtttaaaaaatgttgctcttgtgattattgcttatttgcctatttattaaacaaatacttactgagttcttactcaataactgtattagatgcca

SEQ ID NO: 602818 - DNA, 352 bp, Homo sapiens
  misc_feature (28)..(28): n is a, c, g, or t
  misc_feature (38)..(38): n is a, c, g, or t
  misc_feature (133)..(133): n is a, c, g, or t
  misc_feature (155)..(155): n is a, c, g, or t
  misc_feature (186)..(186): n is a, c, g, or t
  misc_feature (278)..(278): n is a, c, g, or t
  misc_feature (284)..(284): n is a, c, g, or t
  misc_feature (315)..(315): n is a, c, g, or t
accagattaaaaatacagtaggaataanttctgtttgnccacaggaaactggtgccttctggtacaccctccctatattaaaagtctctattacatggcccaggcacagtggctcatgcctgaaatcccaacnctgggacgccagggtgggcagntcacttgaggccaacttgagttcgagactancctggccaacatagtgaaaccccgtctctgctaaaaatacaaaaattcgcgcgcctgtggtcccagctctggggctgaggaatgggaactcncttgancctgggagatggaggttgccgtgagcggagntcacaccactgcactccagcctgggcaacagggtgag

SEQ ID NO: 602819 - DNA, 988 bp, Homo sapiens
tagacactatctatcggtacacactattttcccctccatatggacccaggtcggtttacataaaaccgtgtcattacagtagtattgtaacatttgtagattggatagcattttcactgatattgatgagtttcttgtaaggttaccgtcttctaagagattgctgctctactggccactgagcagcaattcagaataaccttgaaacgatggagtctaaacaatcattacgctgttacacacatggaacatgttcacttactacacgtgactcaccttcgcacttgagccaacatggctcttaacttattatatccttaacacaatcagcttacagacatatactacaaatacctaactattaggaccaaacgcttacagtattactatatatacatatgatacgtatctataactgcaaacagaatacacctataaacgtagcaaactctatatttttcccttttatacgtcctgtatttacctcgatatgtagtttactatcaccactatctctgcgaacgtcaatacgagcacactgacgttaaaactagcacacacatatatataccttccatgcacatgcatccacgcacacgcaagggccgtccaactaagttaaattacaatgtaacacgtatccgttcagaatgggatcactccgacgcccataactttatataactcaaccatcagtaatcaccaaagtgatatcccaactggattacaccccaacgatccatacttaggccatgctacgtgggcacctgaccccttcgtcaagcgttccaaatcaatttaatacagttattcagttaccctactcgcggacattaaacaccatgacggtttacgtccacgggggcctcaccaaacaattgtcccgcctgtcaccacacattcgttacagaagcgcccaatacggtctcaccaacaacaattattccctacacacactggtgtaggattgggttaaccctttttcaag

SEQ ID NO: 602820 - DNA, 876 bp, Homo sapiens
ggccttccttacccaggtcgaccacctcagtactccactagacgacaggactgaccagttagctcttccttccaagaagcttcgcagatctagcggtctggggtctggttgaaagatggcggccctcactaccctgatataggtacataggatgaaacatcaggatcgcgtacagttagagcaacgacctcggcaacaactgggctggcgtactccacgcacggtgatgtgctggcgtgtgccagggagcaatgacgcaggacgacacagtcgaggacggacgtgagtggcaacgcttgcctggcatgcagtactgctctcacgcacgccgctggggtggtcctcgtgtctcgtacacctggcgtgggagtagtacgcggacaagaccaacagaggcatactccctgcaagtgtgctgcggtagactccgcgacactgcacctacactagtatacatggctacgcgagcaggggacgtggatgctttcctagaacccctaacaggacactgagatgaatcccaggtggtggagatttattaccaggtggccacgcgtagcggacttggtagcaagggtcaattgaaatggaccccattgtgaacgggcaccagtggcctatggggaaccactgtcgaatgacctcatattaagcccccctggcgaggcggaaggcagcatgacagcgggggcacacgccctggataactggcgcgcacacaaggcggataacggtacgcctgggcacttggcacttcaacgggggggctcccccgagcagaggcacaggggaccgtcgggcaaatcatacaacggcacacgttggcagaacgccggactacttcaacgaaaagcacgaccccagggggcaccaatg

SEQ ID NO: 602821 - DNA, 222 bp, Homo sapiens
cacaccactccagaccatctgaacccccatcagtggacccccctggggctgttaatatactctacaagccatactaaaaatgctctgagggaactggctcacgaatagtgggcctggtgattgtctatcacgcaaggatttgtattagtcactgttccagaacatctgtccacctattctgcctgccccttgtttccctgcacatgcaacatgcttctaggg

SEQ ID NO: 602822 - DNA, 373 bp, Homo sapiens
cacgaggctgagctgttgggtatgaagtgttccagaacagactttaccacctgaaactgctgcttcatgttcagatcaggcagggaacacacctcgcaacatgtaacacaaccaaagaagagtacacttaagttgacgacacaacacgtgatctgaaacaagaagtttgtggctactcaacagctttgagagagcacttcccaacgctgctagtagtctttgatttcttcaatgctgtaccgtgagattgcccggtacagcaccagttgtattctttaatatcttgggagatcattttctctcgctcttttttttaatactagcagctttcatcctttggaacgtgtgctgaagccaaagaatcaacatgtac

SEQ ID NO: 602823 - DNA, 105 bp, Homo sapiens
tcacgctcagccacctaaaaacatttaccagaccatgtactacgtgccagctctagttctcagccttgggaggtattattctagacttcctctgatttatggcat

SEQ ID NO: 602824 - DNA, 717 bp, Homo sapiens
  misc_feature (633)..(633): n is a, c, g, or t
  misc_feature (678)..(678): n is a, c, g, or t
  misc_feature (701)..(701): n is a, c, g, or t
ttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttttgggtagtactgctggaacactaagcaggcagatcgccagaacacaatacaggttgagcatacctaatctaaaaatctgaaaatctgaaatgctccaaaatctgaaactttttgagcaccaacatgncactcaaaggtattttggactgaggcgggcagatcacctgagggncaggagttcgtgaccagcctggncaaagtggcaaaaccc

SEQ ID NO: 602825 - DNA, 271 bp, Homo sapiens
tgcataaggacagaagcataacagatagatgtaagatccctgtctcaaaaaaagaaaacaagccaggtgcagtggcttgtgcctgtaatcccagcactttgggaggcccaggagggtgaatcacttgaggtcaggagttcaagaccagcctcgccaatatggtgaaaccccatctctactaaaaatacaaaaattagccaggcatggtggtgcgtgcctgtaatcccagctactcaggaggctgaggtgggagaatcgcttcaacttggga

SEQ ID NO: 602826 - DNA, 346 bp, Homo sapiens
ttttttcccccctaaaaaaacccggggggctcccccccccccggttttttccttgggccggggggggggatcattttttccccgggggacccttttcccccttggccccttttgggggcccccttaaaccagtttttttcaaaaaacgggggggggccgcggccggattctccggggtttttttcccccccccgcccccggaaattttaaatttggggcccatttttggggggggcccccccccccttttttggggttttggcccccccccgggggggggggttttccccccgtttttttccccccccggggttcggggcttttttttaaggttggggggttttta

SEQ ID NO: 602827 - DNA, 490 bp, Homo sapiens
agcagcttccatgagcaaagctatgcagtttggtcagctcctgacacacttggataccaccccagcagatgatggccagttcccttaaggataatactgctctcctgacccaggtgcagacaacgatgcgtgaaaacttggccacagttgaggggaactttgccagcattgatgctcggatgaagaggctgggaaagtgagcatcactgggagctggggagcggggatgacccttgcccctgaactttgtcagacccttccacagggtcactcacagccccagcccacctgacaagggcaagggttcttgcatgtggggtacacaccctcccgacaaacagagtgggagctgggggctcttattggatgaggttgtgggcccagccacatgcagttcccgtccagtaagtgctttgcctgctgtgggagagggactggatcccgtcctctaacgtctgtctctggccgagtctaacactgtacaactgtc

SEQ ID NO: 602828 - DNA, 908 bp, Homo sapiens
atactttctgctgtcactagcataacagaaaacgacgaactggcttttgtcttctaaactgacgggcacattttacaacaacgctcactcttctccatttactttcttctttcagcaaaacaagaatttgggcttttgacgctcttctctacaaacaaaccaagacaacacacctttcctttgactcttgacgaacactaactttaagtcaaagaatctgctctatgctaaccaagagatagagcacagcaaagactctgccaggccccaggcctctacctagtggcctggcaaattcaagtattcttattggtggaggccatttgtttctgattagaagctgtctaaacctcctactcctcaactcaaaggaaaacacaggaatcttccaaagatgggatgaccagggtctataacatcattagtgacaaactgtctgtaaggacaatgtcatgttacacgtgacttccctttccacgaagatcatcctaatttcatgaaccatgacaaattccgggactatctacaagcaattcgctgagcactttgacctcctgaactacattcacgatcaacagaccactgtcgctgcacgcataacgaagcgtcccagacttctcccgaaactggatcacgcgggatgcagaccaagacgaccgaaggcaagccacataccaccgaactacgacgctgctaatggacgaacaggaacattcccagaatacccaatatcctatggaaacactatacctggaacttccataacttaacacggttcacgattcctacagtacccaaccagattaacagtatcccaaaacagcttcaagggataaccacactctagggacatcgaccttgcacaacactcgacgaacaacttgttgagcacactctcatcaacgaca

SEQ ID NO: 602829 - DNA, 264 bp, Homo sapiens
  misc_feature (51)..(51): n is a, c, g, or t
taaggaaaccttgggccgcggagagcagaagggttgtcgcggatccaccancgcgggcgccgggccgcggagccgggagcgcgcccaggcttgcacccgcagcaaagccaaggccaccgccccaaagccctttttttcttgttcgccccgttttgccgacttttccccggctttagtcaacaacagcaaatttttattttggagggttaggtaatttttgactttgaaaattttaaagcaaaattaaaattcagacccctttta

SEQ ID NO: 602830 - DNA, 3494 bp, Homo sapiens
acttagatatgcagctgaaggggttcctgggtttatttctcctgagaactggcatgggctccgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaaccaaggggtgattatgtttaccgtgtgtctggcactcggggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccagcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaagctctcctgcccccacccccaggcaccagcacagcctttgccttcactctctcccctcccctgtccctgggggattgaataagggaagctggggttggccgtccttctagcttgattggcagcaccagcgctgtgacggaaggatgtgttgtgccagcagcctcttggccgcaggacaaatgcacatttaaagagataacctttttgtgtcctggctgggaaagaggtcagtgcagatgtttttgggtccaggtgttggctgtgagttttcctttcctctatgaactgaactcagcagcctagtggacagtcacctccttacaggtgtaaaatccaagccagtcaaccatagcaggtggcagacttagctgccttccctgtggtgtggtgcagaccatgacccttgaggcaaatgggtgagctggccccacctcgcctgcagcctcctctgaggctcccctgctgcctccccactagccgccctgaatcacctacttcccagcacccccagcccgtggttctcatcccgtcttccatctgtgatctggcactcattcttccagagccaaagaggaatcccctcttctcatgcagaagacagtcatgcctgcccttgtgtgtcaaaagcattgcatttatgccctgttagaacccctgtcacaagcatggtgcctgaacacaggtgcctctgtggtctcttctcatcctcacccaatgggtactatgctagccccattttacagatgaggcaaacgtggcacggagagctccactaacttgcctggatgattcatgcatccatccattcacttagcaaatacttatttaacttctgctttgtgctagctagtggggatgtggcagtgggaatgtggcagtggggatgtggcagtggggatgtggcagtgaggaagacgacagacaggctccttgggaagcagagtaagcaagtgaggagacaggcgggcgtggtgaggctgcgcaggcgctgagatcgagttgctgggggaggcctctctgaggtggtagggcttgagttgattctgaaggacaagaagagccagccctgggggtctgggggaatggtattccaagtggagggaacagcaggtgctgggggcagggaggtgacagatgtgtcccaggtacagagaacagagtgaacaggagagaggagggggccagggcattccaggtggggaaaggcagcaggtggcccggtggtaccacctcttttggcgagggctttggaccttacccggtgtgatgggaagtcctggaagtgtgttaagcaggggagtctttttgatcagattttctagaaaacgacagtgggctgctgtggacctcagagaggcatgtgtgatagtgtgtttcgggctcttcccacgaaactcggctctgcacagtgagacctcatttcctggttctgtttgatgagtgagcgaatgcacatggcaggcggtcatgtcccttgggcctgtgaggtgaggaagggtccctgagccctgtggggatagagactcttccaccattctgacatgatccgagttagcaggcagcactgtccagatggaaatggggatgggagacagaccatctctctcagcgggtccagccatgagccagcagactgtttcccattggcccccatctttcagagtgggatgatctttctaacaaagaaacccacacaggaatttggtgtgtgtgtgcgtgtgtgtattacctttcaggatggaagccggtggggtgtggagcgaggggctggcatggttggcctcgcccagctcctgtaccctgtgtgtgcctagagcatgcacctgctccctctgctgggctgagactcagaggacactgggcaggtggtggggggtaggagggtcgtggctgtgttgggtggggccacatcaggtgtgtggcacagagggggagggggaggtggagtggcagtgtgttccacccagcagtccctgtgtttgacctcttcgtacactctcagttgtattagctctcagaatgaaaacgagatacttttccccaatctatgtacgttgttcttaagaatgtacacttggccaggtgcagtggctcacgcctgtaatcccagcactttgggaggccaatgtgggtggatcacctgaggtcaggagttcaagaccagcctggccaacatggcgaaaccccatctctactaaaaatacaaaaatcacctgggtgtggtggtgggcacctgtaatcccagctactagggagactgaggcaggagaattgcttgaacccaggaggtggaggttgcagtgagccgagaccgcgccactgcactccaacctgggcaacaagaacgaaactctgtctcccaaag

SEQ ID NO: 602831 - DNA, 181 bp, Homo sapiens
gtctctgtgggcgcggttgcactacggtaacttgaaacgccgaggcagaaggctggcttgggctgagcactgcttcctgttattgctctatgggctggcgcccccgaactctgttccttacccatatctatcttctctcaagcttagtacctaccctcaaacttccagtccccatctggtc

SEQ ID NO: 602832 - DNA, 166 bp, Homo sapiens
gtagagaggagttacacgaatgctggtagctgaatgcttccaatgcaagtatctcgacggctcccaggcagtctacataagtttattttctttactcccttgaaagcagattgatcaccagattcacgacgcgtctctcggatagactcaggagaagtcgacagta

SEQ ID NO: 602833 - DNA, 494 bp, Homo sapiens
  misc_feature (5)..(5): n is a, c, g, or t
  misc_feature (28)..(28): n is a, c, g, or t
  misc_feature (53)..(53): n is a, c, g, or t
  misc_feature (99)..(99): n is a, c, g, or t
  misc_feature (128)..(128): n is a, c, g, or t
aaaanggtctcccctgtgtttgccccangctggcctcgaaatccctggacctnaaaaaaaccttcctgccttggcctccccaaagcactgggaattaanaggtgtgagccattgccgccctggtccanaaaatcttgtttttttgtttgtttgtttattagagatggaatctctctctcttgacccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaaaatctgttttctattcaaagtaaaaatgacatgtgtttgagtcaaaaaaaa

SEQ ID NO: 602834 - DNA, 144 bp, Homo sapiens
cctgacggggcagctgggggctgtctggcgtccacgctcacgttctgggccggcggaccccgtaccggccaggccgtggcggccacgggggcccggaagtcctccttcagctggttttgcacggaactgtgtcccgacgcggtt

SEQ ID NO: 602835 - DNA, 419 bp, Homo sapiens
  misc_feature (394)..(394): n is a, c, g, or t
gcctttcaatatacttcctgaaaaatcttgtgttctacaaaatagtgccctaaaaatagtgcagtttatgagagaactaagagcaaacaactcaaaatctgtccagctttttaaccagaagccaggaaaacccaaattggttcctggaatataatttgacaccccaagtaagaaactcagaactctggagtctgtctcagggaatattaaaaacatacaacatcaaaaaagtggcacactggcttgcaggtgccagggcagggcggtgaggcagagctctgagccagcggggtagccattacaggtgtacaggaggaagcacaaccaactgcagtcctggagcttcagcgacctcccctgggggcagccccaggcatgtgctcatgtctcattnttttgccttacacatcttgctcctg

SEQ ID NO: 602836 - DNA, 157 bp, Homo sapiens
tggggcaatactgaggcatgttatataagtgaatgctgacggataaatggcccatttggggcaaaaagccggttagcggtggagcaggccatcctaagggagaaggagggtggcatggaataacagggtgtctagtcatgtaacgcttgttccaagg

SEQ ID NO: 602837 - DNA, 210 bp, Homo sapiens
gactggtttttgtgttttttagtagagacagggtttcactatgttggccaggctggtctcgaactcctgacctcaggtgatccgcccaccttggcctcccaaagtgctgggattgcaggagtgagccaccacgcccagcctccgttgtcctcatttagactttgtctgggttatcaggcacttttgacttcctggggtccttcttcagtt

SEQ ID NO: 602838 - DNA, 467 bp, Homo sapiens
  misc_feature (231)..(231): n is a, c, g, or t
tgggtccccccacccccacagccctcacagcattccccattgctcctggctcttccccacccctaggtgggacagtgaaggggagcagtttaaccagaagattgctgctgccccttagggttctcagctcccttccctcatggaatcccttcttaggataggaccctctcaggacacccccttctcgtgcagccctgtggttccttctagaggtagcatagctctgtaggnccccaggtgtggggtacaaatgcagggtatgggccctccagtagatgccatgcctcgctgctggtctttctcgagtcgagagggttgggcggtctggcacaagccaagtcttgcctctgctcctaggccgactctttacgtctcctcccctctgcggtgtctacgacttctaggtcccatgaatatattccccttgttgcttaaaataaatagacatcgaggtacaaaaaaaaaaa

SEQ ID NO: 602839 - DNA, 1554 bp, Homo sapiens
  misc_feature (514)..(514): n is a, c, g, or t
  misc_feature (823)..(823): n is a, c, g, or t
  misc_feature (1554)..(1554): n is a, c, g, or t
gccgcgtcgccccgagagcacagagcctctcctttgccgatccgacgtccgtccacacccggcgccagctcaccatggatgatgatatcgccgcgctcggtcgatcgacaactggctccggcgatgtgcatatgccggcgttcgtcgggctcactgagtgcccccccgggtccgtctcttcgccctccgatcgtggggcgctcacctatggctgccaagcggcgatgcatggtcgggcatggagtcagcagggcattcctatgtgggcagacgtaggccctaggacgcaacgatgacgggcatttccatccatctcctgaaaagtatcccccaatcgcatgcagcggccaatcagttccacccaatagcgtgcgggaccgcagcattgggtaggaatagacattcgtcggcctagcccaaccaatcgcgtttcgtacccatagttgcacggctgggcgggttgctcgggtcgtcacccggattggcacgacaacccacctgattggcgttgacntcgaatcgcaaggaggggacgccgcaccccctttttgatagcaccccgcaaaaccgggtcggcatacccccgggcagaatggacatggaattgaacccccctaggaatccgatttgttatcttgcagggaccaccttttgcaaaagcgagcgccccccatatgtcccacttggggtaaccaagatttggctggtatgtaccccaacggcgtctcttagagtgacacataattcccccaccttgggttaagcagcgccccttctatgagggctgcggatataccacgatacgttgtgtggctattcaggntgtgagttgaggtgaccatccccgagtttgagaacagtagcgcttgtccaatctcgccaacgatcgttagttcgagcccccaatttctttcactgtgagcggggggcttaataggacgccgcttccctgcccaaattggcccaattccctgtgaccgggttcattgtggcaacccgtgggactctgtggcccgggggaacacccccttgcatctttgtagcgttaacccctgtgccagtggtaagaagcacttcccgtccaagcgcaggaacgtcgggcggggccgttagcaatggccctttacatgcctaaacgcaagagagggccaggaaggccgggggaacaccattccgattgccggttccatcgaatcttagaagggacagaaacggcgcttgctttgtcatagcagttttggctcccttgagcacctttttccagagggcccacacgaaggactcgggtccaccggggggttagcgtttccccaaaggcgtactcttcccctcttggggcacgaatatgaaggcgtatatcgaaaggctttggccttgagaactgggtcccagcgggtccaattccaccctagtgtcgggccacacttgaagccgagagttcacaggattggcccctttggagtgggcacctttcctttcgcagagccgtttccttttccctagggggcatctgcgacggttcccttgtgtggcgcattccgagcggaaaaacan

SEQ ID NO: 602840 - DNA, 148 bp, Homo sapiens
  misc_feature (104)..(104): n is a, c, g, or t
  misc_feature (107)..(107): n is a, c, g, or t
gggccccctgatcaattctttggatgcttttcaaatttcccaggatcccgatgtcgtcatacactccgaacatgacccttttttcttccaacgatcaaccactncgngggacgggagagtgagccttataccgatcaatctgcacacc

SEQ ID NO: 602841 - DNA, 160 bp, Homo sapiens
ggtcatctactctaccatctttgcaggcacgcttatcacagcgctaagctcgcactgatttttatctgagtagggcctatgagaatataacactgctaggctttttatttccacgtgtctatacccacaaaaaaataaaacccctccgggttccaccaga

SEQ ID NO: 602842 - DNA, 317 bp, Homo sapiens
gctgttcttgaggatcccatgcgcgagcttccatcaagaaagtgaaatgatgcctataatcccaggcgggtttggaaggccaaggcaggatcacttgagcccaggagttccagcccagactgggcaacaaagcgagaccctgtctctacaaaaaaatttttaaaaaattatccgggtgtggtggcatgcccctgtggtcccagctactcaggagactgaggcaggagaatcacttgaacccaggaggtggaggttgcagtgagctgaaattgtgccactgcactccagcctaggcaacaagagcaaaactctgtctc

SEQ ID NO: 602843 - DNA, 162 bp, Homo sapiens
gggggcgctggatgtcagagatggacgggtatctacacatacattctaggtgtatagaggatcaaagaattatgcatcaaaactaacatagaaggtgtccacgtaacagtaaagaagggtccaatcagtatgtacaaaaaaaggggcggccgcggggtaccg

SEQ ID NO: 602844 - DNA, 358 bp, Homo sapiens
gtcaaatcattctgctttatgaaagtcatggtatctagaggtcaatacccatcagctaggagcagcaccatgaaatccacatctagcatgcagactcgggggcacttaatagatattctatatggtaagactagggggacagcttcctttggagaacatgtgagttgtctgtgaatatcagcttgctctccctaggtttccatcacatggatcagcgagagttcatgctgactccccctccctcgggggcttatttgcaatctcccgatttgctcaaaaacttccaggtccagagggaccctaaagaccctgtcatgtccccctgtgaattaccagcatcccaggccattgctgggtt

SEQ ID NO: 602845 - DNA, 147 bp, Homo sapiens
gcccctgatggggaatgagtttattttgccatttaccatgtcagacggcagctacatgctaacgaattgcagttaactgcgactgggcacagggaacccgcaggcctattcacagctatgcacagattccacattaggcaaatgaca

SEQ ID NO: 602846 - DNA, 209 bp, Homo sapiens
atagagtgagaacaacagtaatgaaccaggcatgccagattgatcattgaaatatgtttctatttatgcttcgtttgcccgccgtagagcattaagtccagaagagtgtactttctggcacataaagaaatcttgaggacttagtttaaaccttccataaaaaaacaattatcggtttctcgggttctctctctctgtctctcgctcag

SEQ ID NO: 602847 - DNA, 343 bp, Homo sapiens
atttggagctttttaaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttgggcatcttcatcatggaagtctttgcccattaggtatgttctgaatgggtattgcctagg

SEQ ID NO: 602848 - DNA, 280 bp, Homo sapiens
ccatagtgaagggggcaaccttccagcctccactccctcttcttctcccttagcctgtgttcttcaaaacctaaaaccccctttgactaacacctgacctaaaacctaaatgccttattttcttctgcaataccgcttggcctcaatacaaactggacaatggttccaaatagccagaaaatgacacttttgatttctcgatcttataagacctggatgatttttgttgaaaaatgggcaaatggtctgaggtgcctgacatccaggcattcttttattc

SEQ ID NO: 602849 - DNA, 150 bp, Homo sapiens
ccatttagaaagctgacactggactctcttccattacacctatatgcaaaaattaattcaagatgaattatagacttacagtgtacgacctacaacccactacaacaccccctggaagacaacacctaggactagtacaggtaccgagac

SEQ ID NO: 602850 - DNA, 165 bp, Homo sapiens
cccccctttttttttcccccggccccccaaaaaggggggtggttctaaaaaaattttccgggggaggggggaggttccccttttttgggccaaagggcaaaagtttttttccccctcccccttttcccaaaaagggggggggaaaaaaaaaaaggggccccggga

SEQ ID NO: 602851 - DNA, 306 bp, Homo sapiens
cgctgtgattagaggatcggtattgagtggcatgtgatatgatgagagtgcgtgtgtgtgtgtgtgtgtgtgtgtgtgtgtgtgtgtacgtatatatgatgacttcatatcaggttgaatctgtaggactccttaggacacgattgtgtaaatgctttgctccagatttatgcttatctctaccaaatgccagagagttccaccaatgtggacacaaattatctacattttacacatggtagctccccatgccctggcaccggtcgcgctatacttatactgcatgcccatccaacattaagctta

SEQ ID NO: 602852 - DNA, 951 bp, Homo sapiens
gctcggccttagatggtgtcggggtcatagatggacagagaagactcttggccaggcagatggcttctcgtgtggcagaacatggggaccatccgtgacgccggagatctctccaggcaccaggagcagactggaggacagcaaggagctgcagcctgtggtcagccatcaggagaccatctgtaggggccctgtgtggtccctgtgcagacagttccaaaggaggctgaccctgagagccgtcaacctcaacctccggcgcagggacctcctggaaacgcctggaaaaccccagagccaggtcagcaagaggactccaggcatgcagactcgactcagcataagagtgctttgggtgccgtgtgccagagaatccaggagtcctggcaaagatggcaccaagtggcgtggtggagaccaggtgaaggccaggaaggcggaacgagcaggagcacaagacagggccaggagagatacaccgaagtcaagaggacaagaagacagagaagaagacaaaccaggacatgatcaaggaagacaggacacacgagcccgaagacgagagcgaacgacaccacatggagaggaaaggaagacaatgaaacagacaacgcaaaagaacacgggaaggggggcacaacaagggacagcaaacacaagagtaacggaagaaaggaaaggaacagagaacagggacaggaaccaagcgaggagaaggcacgcaaaaaaacgcatacaaaccaggaggacacgcacaagacacaaacccaaagagagaaggacgagaagagagagaaacaaaggaggaacaagagaagagggggggagaacgaaagagggaataagacaaaaaagaagagggacacaaagaaagagaagaaaggaaggcaaaaaaaggaaagggaagaagaagaggggagaccgaaaagaaaaaaaagaaagagacaggac

SEQ ID NO: 602853 - DNA, 196 bp, Homo sapiens
aagtagtcgggacgcagtagggacggatatgtaatcccagcagttggaagaccaaggcaggagaatctctcaaggccaggagttcgagaccagcctgggaaacacagcaagaccatatttctacaaaaaatttaaaaattagttgggtgtgtaggtgtatgcatgtagtcccagctattcaagcgggcgaggcagg

SEQ ID NO: 602854 - DNA, 204 bp, Homo sapiens
ggttcgatagttctttgaaaaggcatccagcaggatgtggatcgaggcgtgccgtccagttttgttgtcccatttcatcagcattgcatacaaggcatcccctgggcctgctgtaccagctctgaccacatcgatctcatttttcgtgaggtccagctgcctcatgagctggtcccaggagtcaaagggcacgatgtttgcaaa

SEQ ID NO: 602855 - DNA, 912 bp, Homo sapiens
  misc_feature (121)..(121): n is a, c, g, or t
  misc_feature (125)..(125): n is a, c, g, or t
  misc_feature (738)..(738): n is a, c, g, or t
gtttcttctgtgctggaggtgtctcatgtgtttgctgcccgaaccgggttcgaggagctttgagttggaataccgggcccggaggactcctggctttcggcacatcctgctccgttgtgcnctanaccctcagaaaaaagtggttattaccaatctgaatggccacaccgctcgagtcaactgcctgcagtggatacgtacagaggatggctccccttccaatgagctggtgtctggaggatctgacaatcgggtgattcattgggaactagagaataatcaggttttaaaatcagtccgtctccaaggccatgaaggacctgtttgtgctgtgcacgctatttaccagagtgggccatccgaaggggagcagcatgcgctgatagcttctgcagcttcagattctactgtgcgaatctggtctaaaaaggggtctgaagtcaaataccttcagaaccttgagcttcagggatggattcgttctttctgtctgcctggctattttgcctggtactaatgtgccagtattagcatgtggtgatgatgactgcagaattcacttatatattcaacaggatgaccagtttcagaaagctctttctctctgcggacacgaggactgataagaggcgtggaatgggcaaccttggtagagacttttcctaagcaagctgctcaccggactgcctaattagaatattggcgactgtttttgagacccgatctttcgaaacccangattggtgtttaaggtgaaggaacccgttccctcataaagggtggggcgtgcaaccaccggtggcggttacctgacaacgctggcgcccaaacggggtaaccgtatttgggtcctcttaacaattgtgtttgtcccgaaatgtctcctggaaacagcttctgcccaaaccggga

SEQ ID NO: 602856 - DNA, 680 bp, Homo sapiens
  misc_feature (116)..(116): n is a, c, g, or t
  misc_feature (149)..(149): n is a, c, g, or t
tttaaatttattggaaatcagttgcattaatggaaaattaaaaataattggaaaactaagataatttagcagcttactaaaaatgattgaatgtaaatttttattttagaaaaacnactttatggaactagttcgtattcacttctatnattgtttctgaaatgggcctgcttttaaatgcctatttctttggacaaaagaggaaaaatagatctggaactcttatgcctatacatacataatctcttgttgaagaatgtagcaagatgtgcagggtttgctttgcagaaaacccagactgagtcttggataaacacaagatgataacaggataaacctaggagaggtgtggtacatttcatttgtaagtgatctggacttgggatccacgtcttgaggaccctgtgggaacaggttacttaactagcttctatttttctgttcctcctttcttctgccggagatgaagcaaccaaataaaccagcaatcctgactctttgcagcaagatgaacacctgaatcctccctgcccctaattatgatgacaaagctcactccattagatcctgtgatttgacccaatgaaactggccttaaacactgagcaaaatgagtagttggtggttgtgtactatgcttcctcatttgctgtgttgagacccttctttaagtatgttgt

SEQ ID NO: 602857 - DNA, 761 bp, Homo sapiens
  misc_feature (15)..(15): n is a, c, g, or t
  misc_feature (22)..(22): n is a, c, g, or t
  misc_feature (38)..(38): n is a, c, g, or t
  misc_feature (40)..(40): n is a, c, g, or t
  misc_feature (46)..(46): n is a, c, g, or t
  misc_feature (71)..(71): n is a, c, g, or t
  misc_feature (86)..(86): n is a, c, g, or t
  misc_feature (115)..(116): n is a, c, g, or t
  misc_feature (131)..(131): n is a, c, g, or t
  misc_feature (173)..(173): n is a, c, g, or t
  misc_feature (226)..(226): n is a, c, g, or t
  misc_feature (232)..(232): n is a, c, g, or t
  misc_feature (524)..(524): n is a, c, g, or t
ttggggcctctgcantctagcntgggttacacagtganantccagntcaaaaaaaaaaaaaaagaaaagtncatacaaaaagagancattaaagatgatcatttatctagaaatnnctaagaatccaaacnatagagcactaggccaggcacagtggctcatgcctataatcncagcactttgggaaacagaggtgggaggatcatttgagcccaggagttcaagncaagcntgggcaacatagcgacaccctgcctgtacaaaaaataaaattgtggccaggagcggtggctgactcttttgtaataaccattaacacacaaacacatttatagctgtacaaaaattttttctttctttatatcttcattctataagctgttttctattaaaatttatttttctttttaaacttttttgtaaaaaactaagacacacacacattagcctaggtctacacagggtcaggatcatcaagatgtcactaggcaacagaaatttttttagctccattataatcttangggacaaccatagaattaatatatgggatctgttatgtggtgcatgacaatatagagagagatccagttatggcctgcatggtttggtattgttcaactttttttttttttttgagacagactctcggtctgtcgccaggctggactgcagtggcgagatctcggctcactgcaacctccgtctcccgggttcaagcaattctcctgcctagcctcccgagtagttgggaggctgag

SEQ ID NO: 602858 - DNA, 160 bp, Homo sapiens
tgaataccggatcttagggaagccttagccgggtctcctcagtactcttgagctagtagtcccccactcatccgttattggttcattctacctatatacgctttttctatctaaaagcatatacattttacttcatctcattcacgtgagtatagggagt

SEQ ID NO: 602859 - DNA, 925 bp, Homo sapiens
cagggggattaaataaattcacatgtcgtgcagccatcaccctgatccttctctagaactttcttattccaaatggaaattccatactcctcaaacagtaactcccgttcttccttcatgttaccttttttttttttttggagatggagtctctctctgtcacccaggctggagtgcggggcgcggctctgggctcgtctgcagcctccgcctccgtgggtttcaggcagttctccgttgccatcggctctcccgagtttggctgggatcgcaggtgtcttgccaccatcgcccgagctaatttttttttagtttgggtagagacaggggtttcaccatgttggccaggtgggtctcgaactcctgacctcaggtgatccacctgcctcggctcccaaagtgtggggatttacgggcgtgagccatgtgcaccgtggccccgtgataactatttatgagcgtgattctctctacagaagatatctttatattttaaaaacacaggatacaccttacctgggctccttaaagaatatgtaggactacattccggcatgtggttccaagcattattattccatataaagtttcccccctaagagcatatcacgggtctaagcggcgagccagccaagtaacgccatgatgaaacatgccagcgctaactgaaggctccccagggcgcccctaccataaacatcccttgagaaacgctaaacagaaggtgatctcaagaagtggcctccagggattttacctaaatcggggaacgtcagcccaagggcgaggtacagagcacaaaaatttcgcacagcctggagctgccacggaactcacacatttcaagccgatggatcccgacggccggctggcaacccaaacgccagggatgcgaagccggagaaggcacaaacgacaaggaccc

SEQ ID NO: 602860 - DNA, 330 bp, Homo sapiens
gagagtggggatgagggtgagtgtgagggagggaaaagtggtggcatagagagttccgggtgtaactggagtagtgcatagagtgcgtgagaggtgagattccaccgaagctagagtgagagggcagataggcaggattctatgagtggttatacttaagggggacaaaactgcccaagaagaatcttgagaatagactctttcgaggtgggggagatactctttagcagggtacactgagctaatactaccagttctttatgagcactggaatgtgtatgtgaaaggagtcctaagtttagcaaggtagtctacagaaccatgctccca

SEQ ID NO: 602861 - DNA, 290 bp, Homo sapiens
  misc_feature (114)..(114): n is a, c, g, or t
gcgcatcaggggtgtaagattcctcccgtagtttttctcctcatggatgtgaatgaaatgccaataacacatccactttcaacgtgtagtttacgcggagcactttcgaggccntggccgggtgggcctacttctcacctgggcttatcttctgaactcgctaggttcttatcaacattggggggataacttggtatatttttttcattgggcttttctttaccagtttctgatttttattctcaatatattttggctaaacctatttcacaaatcaccaccgactgatg

SEQ ID NO: 602862 - DNA, 460 bp, Homo sapiens
actatagtagtatagtttggaaagtagaaacgcctttttatgaatgtattattatatttttggaggcagagtctcactctgttgtccagcctggagtgcagcggtgccatctcggctcactacactctccgtctcctgggttcacgcaattctcatgcctcggctgggattacaggtgcctaccaccatgcctggctaatttttgtatttttagtagagataaggtttccccatgttggccagggctggttttgaccaactgaacctgacctcaagtgatccacccacctcggcctcgtaaagtgctgggattacaggtgtgagccacctactttcatttctttctttctttttttttttttttgagacggagtcttgcattgtactccagcctgggcaacaagagcgaaactccatctcaaaaataaataaataaataaataaataaataaataaataa

SEQ ID NO: 602863 - DNA, 1007 bp, Homo sapiens
caccgaaaccatgagccctaataggcgtcctcttaaccctgcctaatgacctgcggctctagatcgagtgatcttcacttcgcgattcctagtaaaagctcgctggatattagcggacctcatgtaatgcaacccatcactgagaccagtactcattgcagagttggttgcgccgccgatgctagatcacagagaaacgcaacatgatgctagcgtgcacacagctacacacgcacaactgtcacacgactacgggctttcacgagaatcgtggcataattgtacttaagaatagcctacacgaaagttatatcgtcctaacggactggaatatttcctctgatgcgctgttttataacagcgtgcgcagcactaggcacaacatatcctactccatgtttatgaagagtgccacatagggctctccaccagatgaagtgtcgattcaacacgactggattagactcgctcctatgaaagtcacactattctcgcattcatccatagctccagtcaattactatcctgtcacttcctgtgaggtaatctaggtcgactcatcgaagctgttactctagctatagtcgtatagtatagatcaaacgagagcctgaacactcacaacataattttgcaagtgccagaatgcatttactcttgcaattttttagcctccggggtcatacgagtgggctaacccggtccctgaaacagaacgtcaaattctacccaagtaagttcccgttggtctttcccctttggcagcccgatggattccggagacaaagagcctcactactgcgcttcggacctttgtttgaaaggtccacagcgcacctggggctcttccgaacttggaatccttgctaggagtttcactttattattgcgtcttgccagacttgtttcggggcttcttattcctaggttctcaattcgccgttcatacctaggtggtcctttgctcttcttgccttttccggaccctttttttttttaggggcttc

SEQ ID NO: 602864 - DNA, 274 bp, Homo sapiens
  misc_feature (41)..(42): n is a, c, g, or t
cccccccccccccccctttttttttttaagaggggttttgnnggttggggcccccctcccgggggggccccccatcattttttttgttttccccccggggaaaaggggggaaaagggggggggggggcgtgggtgggggggccgccccccttccccccttggggggggagcccccttttaagaaacccccccccccccccccccctttttttttgggggtttttttggggggggggcccccaaaaaaaaaaaaaaaatttttttttttttttca

SEQ ID NO: 602865 - DNA, 381 bp, Homo sapiens
  misc_feature (102)..(102): n is a, c, g, or t
  misc_feature (140)..(141): n is a, c, g, or t
  misc_feature (159)..(159): n is a, c, g, or t
  misc_feature (178)..(179): n is a, c, g, or t
  misc_feature (198)..(198): n is a, c, g, or t
  misc_feature (307)..(307): n is a, c, g, or t
  misc_feature (340)..(340): n is a, c, g, or t
  misc_feature (371)..(371): n is a, c, g, or t
cgtggtcctgaaccagttatgtgtgccgcatgagaaaacgccagccagtgacagagtcaccaaccgctgcacagaatccttgccgaacaggcgaccatgctnctcagctctggaagtcgaccaaacatacgttcccaaanngtttaatgctgaaacatncaccttccatgcagatatnngcacactttctgagaaggngagacaaatcaagaaacaaactgcacttgttgagctcgtgaaacacaagcccaaggcaacaaaagagcaactgaaagctgttatggatggatttcgcagcttttgtagngaagttgctgcaaggctggacgataaggagacntgtttttggccgtagggaggggttaaaaaantttgtttggc

SEQ ID NO: 602866 - DNA, 392 bp, Homo sapiens
tcgcttggaggtgcagtgcacagacgtacaagcagtaggggggtttggcagcctctgcctagatttcagagaatgtataagaaagactgggtgcccaggcaaagcctactgaaggggcagaatcctcacaaagaacctctactagggcagtgccaaagggaaatgtgagattggaggcctcacacagattcctcactgcagtactacctagtggagctgcaagaaggggaccactgtcccccagaccccagaagggtatatccacgagtagcttgaaccctgcacctggaaaagccataggcattcaatgccaaccagtgacagcagccatgggggctgaaccctgcggagatacaaagatggagctgtccaaggccttaggagcctaagga

SEQ ID NO: 602867 - DNA, 289 bp, Homo sapiens
gtctgaggagaatctggttcaacagcttcactttagcatactgcttgtgatagggaagcaatggaggagatgctccaccagttgttggctgcaatttagcaagggccacttggcacaaatttaatggctccatacaccctccagaggcgcctttttgtcctagattctattccaaggttcagtctgaagccctaaaagaaaatcagatctgagggatccagaggcagtcaacagtagaaggctagggcacagcccaggtgagcatgactatcccttctgtcgtcttctc

SEQ ID NO: 602868 - DNA, 105 bp, Homo sapiens
gctgataactttggaatccaattccctttagaccttgatgtaaaaatgaaagctgtaatgattggtgcctgtttcctcattgacttcatgtaaagagaaagcact

SEQ ID NO: 602869 - DNA, 875 bp, Homo sapiens
atggcacatgcagcgcaagtaggtctacaagagctattcccctatcatagaagagcttatcacctttcatgatcacgccctcataatcatttccttatctgcttcctagtcctgtatgcccttttcctaacactcacaaaaaataactaatactaacatctcagacgctcaggaacaatggaaaccgttctgaatatcctgccgccatcatcctagtcctcatcgcctcccatccctacgcatcctttacataacagaggaggtcaaagatccctcccttaccatcaaatcaatgtggccaccaagtgtactgaacctacgagtacacggactacggggatactcttcaatcctacatattcccccattattcctagaaccaggagactgagatcctgtgagtggacaatcgagtagtactccgatgtgaagcccccatcgtatacatacttacattcacaaggaggtcttgcacctcatgagctgtccccaccttaggcttaaaaacaagatgcaattccggagtctaaaccaaaccattttcaccgctacacgacggggtatacctagggcaaggctctgacatcttgtggcgcacacccacagttcatgcccatcgtcctagaataatccctaaaattctgtgaaaagggcagtattaacctataaggacccttaccctgtagagcaaagaaaaacaaacaaacaaaatggggggccgccagaagtcaaacctcgtggggggggccgagaggacggcacggccaagaacggccgacgggtcccaaacccggcggtgaacacagggcgggctcgcacgcacgtcccccggggggaagcaaagacacgcaggacgaccaacccccagcagaaac

SEQ ID NO: 602870 - DNA, 121 bp, Homo sapiens
  misc_feature (77)..(77): n is a, c, g, or t
agctgcatcatggatgtgtcaaaaggcaaagtgtgttctgagatgaaggttacagagaagatcccagtaaggcattnatatacaaaagatattgacatacatgaagttcgtatggctggtc

SEQ ID NO: 602871 - DNA, 365 bp, Homo sapiens
ggtctgtctcttgcttcaacagtggttggggacggagagcagatcctgtggtactctctttccagtcctccgtatccgtccctccgtatttccgtctccgtcttggcagacctccgcgggaccagtcgttcgtcgggcgcatctcctgacttctggtgacctggcgcaggcgagccggtgtgtatgggtgtgattaggcgatccatttcatttggccaaaacgcgagagcgcgagtgggagggcgtcctcaagaaattacggtccgagaagagtgtaatatacgcagcgcgaatcgttggcgcaggtgcctatgtccgttacaagagcgaggccctgggattccaaaattttggttaccccttag

SEQ ID NO: 602872 - DNA, 286 bp, Homo sapiens
gcacttgttatccacattttcctctgcatacctccagtgggagaacagatgcttttacaattcagatggggacttcttgatctgtccgcagaagagggaaccttctcatttacaccgatgtttggcaatgatgcttgtacacgcccaagtgagatcgtgcgtcattcagacgaggaatgctggttcacgcatagactgtcttctgacggagaccatggggctacactcttggacggtctcatggtgtccacttctgagttacctgactcttggacccaatttgggg

SEQ ID NO: 602873 - DNA, 911 bp, Homo sapiens
  misc_feature (274)..(274): n is a, c, g, or t
tctggaggcaggaaaatggcttaacccggggaggcaaaggtttgcaggtgagccgaaatcgccccaagtgcactccagcccaggtgacagagcagggacctcgggtattcagaaaaaaaaacaaaaaaaaactcgcggggacatacctacgagcgggctgcgcggcaaaacggcggcgcagaaagtgggacgaagtgcctaatacgcagtagcacggcgaacccacgacggataacagatgaggtacaacacaaggcgggactcaacctccatncagggagactccgcacaaaatatgcgggagatcggccaataaaaaccacgcggaacaacaaacaccactggtagcacacaccagcgcgcaatacaacacaacatcagggacaacaacgacagacccgacgcaacaaaacaataaggcactactaggacaacagaacaacaacaatgggacacgcacgcgaacacaacagagacgagaaggagagagaaagaagagacacaaacacacagccaacacgaaccacagcagacacgaacgaacacaacacgagacaaggaagaacacagaaagagaaacgcgagcacacaaaaacagcaccacgaggctacgcgatcgcaatgaggcgcagcagaacgcgaacgtgaaccggaagacagtagatgacaacgacggagggggcagaaccacggagcaggacacagaagcgcgagcagaaggacgcggcgggaaggagggagagaggaagcagtgacgaaaggaacggacagcagacacgacaggaggaaggaggacgagaaggagcaggagggaggacgcagatgccgggcggaagagacgcagcaggagagagagacagaagcaaggagcagaagggtagcagcgaatagaggggacggatagaagcgac

SEQ ID NO: 602874 - DNA, 765 bp, Homo sapiens
agcactttccaagggagtggtcgtgtgatcgccatcttagtggaacagatgtctcgtccgtggtcgcagctggcgcggtcgaaccccttcaacactgccacatctgcagcgtggtgcacgatggtctcggggacctccgcagcagctccccagggcccacgggccagccccgaccgcccctcgcaacctggcagccgccgccggtggaagagtacagtctgtgaatttggctccgcgaagtattatgcactgtgtggctaatggtggggtcttaagttgtcggtcttgaacacacgagcatgcgtgtggttccccgtggatttagtgaaatgccgtatgcaggtggacccccaaaagtacaagggcactatttaacggagttctcagttacaccttaacagaggatggtgttcgtggtttggctaaaggatgggctccgacctttccttggtactccatgacagggactctggaagttaggttttatgaagtctttaaagtcttgtatagacaaatatgcttggagaggagaataccttatctctggcgcacatcactatattgtggctgccgtctgccagtggctgaagtctcgttctgcttgaacaatttgccccttggacttccctaatgggaaatgctgcataaccgagttccgaattcaacaggccaagccaggtgatgccaacaacttttgaggggattgcaagtccaacaaattgtattcgggcacgacaggctaacaggcattctacaacgggggcg

SEQ ID NO: 602875 - DNA, 129 bp, Homo sapiens
cttttatctgtgttttagcagaaatgttcctctgtatcctcaaacggtatttcaatgtatgtgtttccttattaaaatatgcatagagattttttgtgtgtatgaaattaaagcgtttattagccttca

SEQ ID NO: 602876 - DNA, 1062 bp, Homo sapiens
gaaccgccatcttccaggtacttcgtcaataatgacgatcacacatgggaatgaggagaggcacccgatatatgttcatctaggccttttatgaaaacattggatgttgttcctttggccactatatatgcgaatctataagaaagcgtgatattgctagactgtcaagggaatgtggttacgtgtttcatatacaatggaactagcaccccttttcacgttctgagctcccagaggttagcctcaatggctactccctctgatcatctcggatctgcttcttctcacatgatcaataaactagccgcacctatctcaatcatataccaagatctcatccctcatctaacatcgtaagccttcgtcctcacatctctcaatcttatccgatcatagctgggtcatgttgatggtggatttacatctcaatacccagctacgcaaaattcttagcattacttcctcatattacccacatacggatgacatcatacgcagttctaccctgtactaaaccttaacatatagcgcatttctctcattttaaactcagtgttcagtattagtcctatactacttaccgtacttcctatctactcaaagttaaactccagtctactcacgagccctgctactattatcgcaccttgataacaatcttaactatgacttaacaacccttttattctctatactaaccctcctctcccttagggaggccttgaccccgaataaacctgggctttttagccgcaaaattgggcccattcatcggaagaataccggcgaaaaaaccaatcaggccttccttcatcccccaactatcaataaggccatccatcagctcatccatgagcctctactttctatgcttagcgctaatcctatcccacttccaatcacactaatctccatgttctaacaccgtataaattaacttgaccggttgaccttttcaaaaaccaccccattccttcaccaaagtgattggcctttacaaggagagtgcttgctaattgtaccccttgatagtaagtactcgttttacgcaccacacataag

SEQ ID NO: 602877 - DNA, 127 bp, Homo sapiens
gccacccttcaacctgggtgatgctccttggggccctatgtagagggactgacttttgtccattgccacaaaccccttttagtactgttttgagcattgtcattaaaacagccacctttgtatttta

SEQ ID NO: 602878 - DNA, 298 bp, Homo sapiens
ctaaggatcgtttgcggtcctttcattcgaatgtggatcatgcatgactcgaatcatgatgatgatcgaatgttggatgcagtgatgatcgatgcatggatgagttactcaatggattgatgaatggaccaaatagatgcatgaatgaatgactcgaatgaatgaatgaatggatttgcagaatgaatgaattggatgatggatgggggggaatagggagaatagagtcaaatgaatggttgaatgcatgaatgaatggaatggactcaatgaagagataaatgaatgactcaatggc

SEQ ID NO: 602879 - DNA, 564 bp, Homo sapiens
acatacacacacacacacacacacacacacacacacacccctcacaacatatagacggatccttctaagagggggatgccgcaaagaggcagaatgttattagaggacacaatatagacatcagcttttctctgcctctttctaatgctgccagacagtctgtcaactcccactcaggagcaaggaaactccctgagtttggaatattttaaggccattttgaaagtcacgctggcatattgttgcagtgtgcttcagtgacatataaaatcaatctctctttctgcctctctccatctcctaattgtcacagctctagacagcctcagaccagcagtggttcagttcactacataactagatataatttaatggaattaattggtccccgaagctgcctgcagaagacttttatattccagctcaaaaagagagctaataccaaaatgtacatacggatagcataggtaagcaagcatcctcaaattagggttccggcacatctaataaaatgtaataaaaaactgtgtttgttattaaatagaccttgtttactttgtcaaa

SEQ ID NO: 602880 - DNA, 135 bp, Homo sapiens
gatccacggcatttccagccaatcgctgcatgcaggcatctacacagcactccgtgcccgcacatgtcgtctggtccctgttcaacaccctcttcttgcaactggtgctgtctgggcttccatagcattcgcctc

SEQ ID NO: 602881 - DNA, 1313 bp, Homo sapiens
  misc_feature (745)..(745): n is a, c, g, or t
actgatgtgctgccgttactgtgtgctcgttagtctgttgtgctgcctgctagctgtctgatcggtccttcgtgcacgagttcgttttctgttgttcttctcgttgtggttggcccgcgcgttagtgtgtggttgttggcagcctctctcccctggtgtgtcgctcggtgggggcccccggggtgttgtgcggcacacctttgtcgtgttcacctcgccggtgtttcgctctcccccttcgttcgccgcctgttttttggcttctcgaccctctggggccgttcataccgttctgtgtgagattggccgtcgtctcggtccgccccgaggttgctcaattcttctggggctcccccaccgttatattggctaggcctttaccccacaggcgcgttaatgagagagccctgtttccggtctccccgttttgactcgccccttagcccaatgtcgaagccccccatctgctggggccaatagtaactgtcgcccagtacttctttaaattaggcggcctaatggtataattacccccttcaccatcgagttgttcagacccccctggccagacacctttgcctaccccccttccttgtactatccctatgaggcataattataccacagctccatctgcctacgaccaaccagacctgtaaatcgctcacttcgcatactcttcacatccagcccacattagcccctcgtagtacaccagcccattttcgatcccaaccccccctgnaagctttcacccggcgcgccagatcacattcttccataaatctcgccccacgggcgttacaatccctccattacataattctgcccctagcccaaactcccaagctattcgagaacgccactcttcaccacgttcgcacttcactaatcccttcttctccaaggagcttcacaatcttctatcttcccacctatataggctcttttgagtgacactttctagcccagcccttcgcctatagcctcgcccttatccccccacgctatttaaccctatctgggaagaaacttcttctgtgctatgtaacccaccgctttctccctgatccaatattcaccttctcctatcttaccacggaactcacaccactactagtgcacacgccctatatctccctctacatagtttagccaacacacacccaatggggctcacctcacccacccaccacttaacacacattaaaccctcattcaccaccgagaaaacacccctcatgttcatacaccctatccccccttttcctcctatccctcaaccccgacatcattaccgggttttcctctta

SEQ ID NO: 602882 - DNA, 189 bp, Homo sapiens
atctagagctgagtctggtagtaacaaggggcactgacctcggacatcacgtcatagcaggtgagtagatcatcgagagcccctctttctgaagttgaacctaattacaaaggcacaacagagtctttccttgttcagccgttatttcggaggtactgttccatttggattattaaattcaaaattggg

SEQ ID NO: 602883 - DNA, 212 bp, Homo sapiens
gtggtgacaacaagggctgaaaacaaaacttagaccgggcgtcggggcgtgtgctataatccagctactcaagacgcgcacggcgagccgagcatttgggggttcaaggcgggagggtcggttggggccgggagttcaagaccagcctggactgcatagcaagatcctatttgtacaaaaaaatgtaaaacttaaaattgcacaaaatttgt

SEQ ID NO: 602884 - DNA, 340 bp, Homo sapiens
ggcggggggggggggtttcccccccccccttgggtgggtttctcctccctcccagcggggggtgtttttacccaaatcttggcgggggggttgtttgcttttgcccgcacccccttgactgaggggttggaacaaattccctgtcccctgggttgggagggcgggccctttttttttagttggggggggggggttttttttttctgaatggcgggcctttttttttttttccttcttcctttcgggcgcggttttttttgtttgaatgtccctttttttttccccccctccccttccatttgttgcggtttttttttaaaaaaaaagtcagtgttaaaca

SEQ ID NO: 602885 - DNA, 341 bp, Homo sapiens
ctggggaacttgtcaaatgtaatccaaaaaagttggggctggcccctttgccaagcagcgcccagttggtggaaggaaaaaaccaaggtgcagggtgccaggcaaaggccccaggcagaaaattttcctggcctgaaaccatcaggcctagtttgctgagtgtgagggtgacctttattggttaccatccccagtgcttgcatccaaaggctccagccctgaccaaccctttttgagtatccaaaaatgggcctttgtttgttaaataatttgctccctcccctgctccccccccaaagacaggtactactaataaaattaaagtcttcttccccctcata

SEQ ID NO: 602886 - DNA, 426 bp, Homo sapiens
  misc_feature (169)..(169): n is a, c, g, or t
  misc_feature (308)..(308): n is a, c, g, or t
  misc_feature (335)..(335): n is a, c, g, or t
ctgctctctacggagattaccgcacgggaactgctgctgtgtaagctgatcccttattactttctcgggatgctggcgatgttgctgtgtatgctggtgtcagtgtttattctcggcgtgccgtatcgcgggtcgctgctgattctgttttttatctccagcctgtttntactcagtaccctggggatggggctgctgatttccacgattacccgcaaccagttcaatgccgctcaggtcgccctgaacgccgcttttctgccgtcgattatgctttccggctttatttttcagatcgacagtatgcnccggtgatccgccggtgacgtacattnttcccgctcgttatttcgtcagcaccctgcaaagcctgttcctcgccgggaatattccagtggtgctggtggtttcattttcgagcagata

SEQ ID NO: 602887 - DNA, 122 bp, Homo sapiens
tggggtgggggcagtttaaagttattagttttaaaaatcagtatcttttaaatgggaaacaacttgcccaaaatttggtcccagatttttgggagacccctttaaaaaagtgttaattggag

SEQ ID NO: 602888 - DNA, 161 bp, Homo sapiens
ttccgcggtaatggggaggggccagactctgacagacaccacactcaggctctggcgcagagtctgtcattcgagtcaggtaggtggaggcccttgccccacctgggcaatggctggacactatggcaggagaaggaccctgtgtacaaacttccttggct

SEQ ID NO: 602889 - DNA, 1146 bp, Homo sapiens
  misc_feature (25)..(25): n is a, c, g, or t
  misc_feature (123)..(123): n is a, c, g, or t
  misc_feature (137)..(138): n is a, c, g, or t
  misc_feature (194)..(194): n is a, c, g, or t
  misc_feature (202)..(202): n is a, c, g, or t
  misc_feature (223)..(223): n is a, c, g, or t
  misc_feature (415)..(415): n is a, c, g, or t
  misc_feature (444)..(444): n is a, c, g, or t
  misc_feature (481)..(481): n is a, c, g, or t
  misc_feature (658)..(658): n is a, c, g, or t
  misc_feature (830)..(830): n is a, c, g, or t
  misc_feature (879)..(879): n is a, c, g, or t
  misc_feature (945)..(945): n is a, c, g, or t
  misc_feature (978)..(978): n is a, c, g, or t
  misc_feature (991)..(991): n is a, c, g, or t
  misc_feature (1003)..(1004): n is a, c, g, or t
  misc_feature (1031)..(1031): n is a, c, g, or t
  misc_feature (1063)..(1063): n is a, c, g, or t
  misc_feature (1081)..(1081): n is a, c, g, or t
  misc_feature (1083)..(1083): n is a, c, g, or t
  misc_feature (1085)..(1085): n is a, c, g, or t
ttttaaatttcacacactaacacanaccaccatcaacaaaaaaacctcattcttaacactgcactacctctccttacttaaccaccccttaccaaattttattaccacttccccaaccttctnccattttcctcccnnacccagtgggtacccgtggggatttaatacaaaaaaacttccccccaacctccttngtcctccnacaactctaacaccccccttncatacccccaacctaaccgttccttcccacaaactttcctctcatccctcttactttatcaaaccatcctttctaccccactcaaacactgtattaaccctcctcacctttccaacccactttttccagctctttttactacaacaaacgagcagccgcttgacgtaccacttattctccacagatcgtcgncgcagaaaaaataataaatacaaaaaagnccccataataccaccattccttttctccctctcaacncaacattccccactccttttctcaccccaccactcctttttattccctctacaaatcaacccaactaataaccaatcccaaacccattcacaattaccttaatttctaattagaacacacaaatccccctttcacccaacatcaataatcataacttttcccccttttcccctcccntatgacaccccccttaccttttttctcattatcctcaacccacatctcccacctttacaacaacacccttacttttttttaacatctctaccttttctttaaaaccctaaactattcccaaccaccccctttttccccatcccctcctacacactttctttaatacaccttntttcctcatacactcaccactcctctttacaccactacaccactacttntcatctccccatcacatccccactccacatacattatcacacatctctccttttcatatatattcnacaccatcacccctcactctctctctctatcanatccacctatccnacactcttactnnccaccacatatctactctctcacattntctctctcctgctcctctcccaacacaccctnctccacacgatatctaantnantcctctctctaccatcttctcccgacatcacatttatataccacaactttattttacacct

SEQ ID NO: 602890 - DNA, 1258 bp, Homo sapiens
  misc_feature (462)..(462): n is a, c, g, or t
  misc_feature (503)..(503): n is a, c, g, or t
  misc_feature (611)..(611): n is a, c, g, or t
  misc_feature (937)..(937): n is a, c, g, or t
aataccagacagtgaggtgagtctggatccgagagaaccgcgaggtgctagaaggcgtgggctattcataaattgtggtccaactctagcgcaaaaagattgtccagtcattaacactaacacccctgtgtgattgcgcatttacaggccctgcagccattgaacgtatgtaagagactgtttatctcaatacgactcgaagcacattattgtaaaggaaaaccggtgatggatctacctccaaaatattatatggattatatctagatagagcggaaacattgagtgttgttcaaatgattttatccaggcatgatatgtgagatttactcaatgtctccaacagatatgtctcaagaagaaagtcgagataggtttactccacaagaatcaatttaatattgctgaaccttgatcggttaaagcaacaaggctacctgtcaccgctgaaaaagatgtganccgatgaggaaactagtggagaagcatagtggctgatgggnaaagtgtgacaatatagtcgggtacggcgtatactataaggtataagtcatatatattcctctttgcattaattaccggaggcataggagtgggttagggtcaatccngcaatataggataggtgtgatgtaggttacaccataatattgtcgggaggcgtggatgacgaggaagaagcatgacggaggtgttcggatacttacttgggtaaatacttcgtttcttttaacttaagcgttatatattggaaggcgtaaactttgatgtggcgatactttgcttgttcaagcgtagtgagaactgccctattaaagttagggatgtttgcgaataaaatctgaacatggataaatgcgaattaggcctataactaacatatgggaagattctgggaggatgcttacgcgacacgcgtagtatggcgtttgcttangggcataatagaggggtcaagttcaatgaccgacacatttggtgattcttaccgcaagaatacagtggctggttcaattgggagtgcccactttcatggacaatccccggtccactggtgaccattctgttccgcatcccggacttctgccacgcacttgtgtgtgtttggacctcaacaaacctggacgggaatacccaacccatgatcgggaaaacggtggccttctaaaagctcattaaaacgggcacaagacaggaaagaaaaaacccgaaaacaacacacacgacatcacacacaaaaactgtcgtaacccaaaca

SEQ ID NO: 602891 - DNA, 272 bp, Homo sapiens
ggacagggaggtatggaaaggcgagagctgctggcacccaccgtgaggaggaaggcaagagggggtggaggggtgtggcagtggtttggaaacgctacagatgcccttgctccccatttcccatctgcaccccttctctcctccccaaatcaatacactagttgtttctacccctggctgctgtggtgtctatgttggtggacgtcgctgtgtgatactgagtgtcagactcggttttcatgcgcgcgcgatacacactacacaacacacac

SEQ ID NO: 602892 - DNA, 954 bp, Homo sapiens
tctgtgcttgacgaacacgataacggcccgtcaatggcctatttataatccgctgcctacatgcgtcccctccgtgttaacgccttctcccttctgcgattttgcccgccaaaaactgttaacccaccccaggtcttgccatagagtgtccgtaccggctccacccatatatctctatagccttggcccccaacagtatagggccctttcaagttaatcggcaaactttgtggaaatgtgagccgccactggttcactttcataaagagcgcgctcccctgttgagaaaagggggttaccgcgggcgctgcccaaccaaattcttcaaacctgtaatatgcgcccgtgtcatcccaactggctgttcggccaacggacagttcttcatccctggaacgggccaaacgacaggccgtgggaaaccctcttagtagcccgataatgcggggcaacccggcccaacttggggagggcaagaaacaacgtttgacaaatgcacacatgtgggcaacataccaaaaaagaggtaaccacggcgagaaacaccggatagagaagccgagtcgctgacacgcaacaacggtagaaccccccttgttcaaaagtagtgagaaactatcaccgcgtcgttggtgaagcaaaaacagggtgcctttttctccccccctacatgtgctcggctcgctaggtcatctccacgtgaatagcgctcccacgttaataaacgccaatggggcacaaaacaccttgggccacagtaaaatatgaggaggagacagataacccctgtttatatcttttcagcactggaaataaaacacctgattttgcggaaaaggaattaattctgaaatatctcgtgtaggcccaggaacttacaggggcacctcatagcagaacgtcattgttcatgaaaccacccttttttttgggaaaaatgaaggtttcggccca

SEQ ID NO: 602893 - DNA, 308 bp, Homo sapiens
tgaaaattttttttatcactgtcttaatttcatttgccaaataggtttttgtgctatgttatctgctgtaaactcaagattgtctccttaagggacaacttactatgtttcagatagtagatttggggaattgattttttcaccgatagaacattaagcacttaaaaaatagcatcactaaactctaaaggggcctttacttaaaacaaattttgttggtagttatttttgtggttaaaaattgaaaaagtacaaaagtttatgagtaggaaattccattcccactgcactcctgcactccagcctgg

SEQ ID NO: 602894 - DNA, 446 bp, Homo sapiens
gggcgagtgtacacgtccgactctggattttagtagtcatggccctacgctaccctatggccgagtgccttaacaaggggcactaaatgtccaagaacgagagcaagctcatgcacaagccacgccaagggcttgtgaccaaacacaccaagatatggtccgacatgaataaggaggtgtgtggctatgacccgtacgaacggttcacaatggagttactgaaggaattcaatgacaaacgggcctctaaattgatcatggggtagcgacgcatatccgctccatgaagaaacagcactagctgatctacttactgtgcttcatgaggaaagttactggcaataaagagtgagcccctgtcatgatctctgtctgaaatgaacattttgagtgttacatttaggatgctggttcatggcatgaggtatatagtatactgttatcct

SEQ ID NO: 602895 - DNA, 405 bp, Homo sapiens
ttgctttcttctttttacttctctgtggttaaaaacaaacaaaaagaactaataatacagtagtaaaaatatagttaactttcatatgataaccaaaattagaattatgccattttagttttagtttctaaactcatggtttttggtccaaagtagcaaaacagaacaaatgaacttttaggtcaatgtttttgaaacaaaaacatgataatgcaatttaccaatatctttaagtctacatctccaaaggaatttttaagccttcaaatatttgcacaaatccacaaggattcctcatcttatagggaccacgaccttaacagtatagaggaatttctccactgcttgaaaagaatatttctattatattgtgcagccaggtacagcggttcacacctgttaccc

SEQ ID NO: 602896 - DNA, 568 bp, Homo sapiens
  misc_feature (346)..(346): n is a, c, g, or t
  misc_feature (559)..(559): n is a, c, g, or t
tggagacgggggtctcaggtaatattctcctcttggtagggccggggtcggggacactttagacagacagggtagataaaatatccaagaactcggccaccaaggcttttccggtcctgggctccaccaaaagtattttatggctgatgactaaacggcctaggatggaaagaacaaaggcctgtcctcaccttctcccaagtcataatggggaagtcattcagtcttcaaagggctgcagaaaaaaagaaattaactaataagaaagacggagggtgaaggacagcagcaagtacaaaataaagagatagaggtctaaaattcaggtggagagacagcatgtgtntctgaactcagaggaaggcagcaaggggaggaaacaggcagactggactcacgggcaatgagatgcaggtgacccctcaacaaggcctcacggcccagcctcgttaactggtagtcagcagggaccaggcacgggggctcaagctggcaatcccagcacttggggaggcaaggcaggtggatccttgaagtcaggagtacaggaccagtctgnccaaatggt

SEQ ID NO: 602897 - DNA, 725 bp, Homo sapiens
  misc_feature (2)..(2): n is a, c, g, or t
  misc_feature (123)..(123): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (162)..(162): n is a, c, g, or t
  misc_feature (267)..(267): n is a, c, g, or t
  misc_feature (298)..(298): n is a, c, g, or t
  misc_feature (343)..(343): n is a, c, g, or t
  misc_feature (396)..(396): n is a, c, g, or t
  misc_feature (398)..(398): n is a, c, g, or t
  misc_feature (419)..(419): n is a, c, g, or t
  misc_feature (495)..(495): n is a, c, g, or t
  misc_feature (540)..(540): n is a, c, g, or t
  misc_feature (610)..(610): n is a, c, g, or t
  misc_feature (644)..(644): n is a, c, g, or t
  misc_feature (648)..(648): n is a, c, g, or t
  misc_feature (652)..(652): n is a, c, g, or t
  misc_feature (692)..(692): n is a, c, g, or t
gnggggagcaacagcaaagggagaaatgagatgttgcaaaaagatgggggggggttcccctctcctctgggggctgactcaacacactgatgtggcagtttaccccactccagagtcaggggngttcattcttttttgggggtgngncanggtgggggttangagggcgtttctgggggcttgggggccccggctggtctctttcccccctccccccccccttggtccctttctctggtcggggggagggggctgggtggggggggnggggttgggaaggggggggttccccttggcngggtggggcgggctcctccggggtggggcttgggggggggttganggtgggggtaatactgctgacacctcccttgaggctgaggtggggaatgggcntncttggggatttggtggctttnatggcctgggtttccctctccaaaactttttgaatgggaaatcccctccccttccttatatggtggcttcttcccnctaccttctacccttttctactttgggcttaggatgatggccatnatctacatgtgttttcagcacctggttggttctaaatgggatctggagacccagcttcttggagattttnaagaggaagtattaactggacaaatggaatgggnacanaaanaaatacagggtcacccagaatggcagaaacctaggtttcncagagtggaaagagagaggagacattcaacaca

SEQ ID NO: 602898 - DNA, 1635 bp, Homo sapiens
gggccacgcttaagcgacctttgcaggacgatgaggggcgctggtgtcatcatgtgtcagggctccaagaaggattacttcaagaagttcttatatgagccatggccagtagaatctcacctggaccactgtatgcatgaccatcttctaatgctgagatcgtcaccaagacctattgagaagcaagcaggatgctgtggactacctcacctgggacctttctgtactcgccgcatgacagagaacctcgcagattagctagcaacctgcagggtatttcccatcgtcacttgtcggaccacttgtcagagcgggtggagcatgaccctgagtgacctggagcagtccaatgtgcatcagtatgcgaggacgatgcatggggacgtggcgccgtcctgataccgtagtgcatgatcgtcgccgtactattacatcaattacaccaccattggggctcttcagcatgtcctcaatgccaagaccaaggtgcgaggggcttgtccgagatcatctccaatgcaacagaggtatgagaacagttcccatccggccaccatgaaggacaatcgtcccgggccagttggctcaggaagcgtcccccaacaggcggaataaacctaaagtcaaagatccgcagtgtggacacacctgtcctggggggtcccatggcccgcgtgcgtgacaggaattgccccgaaaggggacacctctgacgcacaggcacacagacggggggggctccacaaggaggagacctactcgaataaaggcaaagcacctgtttcgaacagaggcgctctgtcttactcatttgtctgttcttttttcctctgttctcctcactctcctctctctgccagtataccagccacagcaaacgcacaaaaaaatacatcaacaacacaacacaaatacaacacaccaaaatacaaaacaatcacatcaaagacatcaacacacacagaagacaaacacaaattacaaaacaagcaactacaagggagcgtagagagggacgacgaagagtaggagagaggcgcacgcgcgccgaggcccaggccggcaacgggcagagacagcgcgacgacagccgccgagagagagagcacacgacagagacgacgaccacagacacagcacgcagccagacaggcaggacgaggcggacggagacgaccgagcgacaccaagaacacgcgaacgcacacccgagaggaacagcaggaacgcggcaaccgcacgacacacggcagagagaagcagcagagaaagaagcagacgacaaagcggaacgcagcaaggccgagacaagatagggagcaagcaagagcagagaagaagcaccagcaggacaggaagacaagagaaggccaggagcacgcacagagggaagaaacacgaggaggcaaacgagagggagaagacagcaagaagcaaaacaaggacgggacgagcagcagagagagagcaaacgaggaccacgaagcagaaagaacaggagcacgaagagccacgagaagaaggagcgaggccaaaaaggacggcgagcacagccgcaggccagatggaaggggcaacagacaacaagactaagaagagacgcaggacagcaccaacgggggaccagagcaaagg

SEQ ID NO: 602899 - DNA, 483 bp, Homo sapiens
  misc_feature (8)..(8): n is a, c, g, or t
ttagcttnagactgccctcctcgccccaggaaggaggaggatgtggaaagttcaatcgaactaattgctgccctggaaattgatgacaatggacaaggccaattataggaataactgcaagaatgagaaaattcgcccatgttccagttcaaacttggaaagggtggtctccagattctctctttggagactggttttcatttttcagagggttcaagactttaatagcagtagttctggctgtactaggaagttgcctaatactcctttgtctcttacctctccttgctagaagcattcaatcagctatagaggcaatagtagctaggcaaactaccactcagctgacggctctgcataaatatcaacctttgcccaaagaagaaaacttgtctcttgacgcagaattaagtaatagtgaggccttctattaaacttcttttataaaaggacttgaagtggggaaaaatgtagtgagggtta

SEQ ID NO: 602900 - DNA, 1249 bp, Homo sapiens
tctctcctcccccgccgcggcgcgagcggcggcgcgccccttgagagagagagagagggatgagcgggggcggcggcagcgggggggggggtcccccccccccccgggggggggcgccgccggaggagagaggggagagaggagaggagaggcgggcggccctctaattcccccgcgcgcgcgggggggggcgccccgcgaggagagtatattagtgagaggggcgcgccagaaagagagagaggcgggggagagagagagaggaggggggcctcatctgggcgcgacaaccgagggggcgcgcacctctccttctaagagagagaggaggagagacccgcgcgcgcggggcggaaagaagagagtgagagggtgtgagctctctctgcggcgtctgcgagggggaggcgcgcggcggggaggggaggagagaaaaacagcgcggcggagagaggagagagaggaggcgcgcccctctcccgcgcgagggaggggcgcgggtgggggagaacgagaggggagcacgccacaaggagagaagtactccccgcgaggcggtcttaacaaagaaagcaagcggggtgaggagagggaaaagagggcaccacaacccaatacgaggaggaggagcgaaaacacaccccagggggcgccccaataggtggggcgccccccacgcacaacaagaggaggcgacaccaacacaacacacccaccgcggggcggacgaccacaggagaaaacaaaaaaacaagaaacaccatcgggggggggccaaccccacgcggaggacagtgatgagaaaccaccagacagggaaacaataacaaacaacaccccgagaaatgaaaaccaacaaccagaaagagaccaacactagcgagatccaacaaaagaacaccccacaaagagaactctggagaccaaaacacacacaaggagggtccactaaaaaaaacagagacaaccaccctacaaaaggggagagagggacgaacacacacaacaaaaaagaatagacacccccgacgggagcaaaccaggcggatacacaaggagggcgccacaacccacgtccccagagaaacagctggcaaccccgaaaagaagaaaaacaccgggggggcccgatccccccaaaacccccggacccaaaaggaggacacactaaaagcccaaaaaggggcgggaggggggcgaagccggacgcgtgcttgtccgccgcggccaaccaaacccacgcaccccc

SEQ ID NO: 602901 - DNA, 1033 bp, Homo sapiens
  misc_feature (4)..(4): n is a, c, g, or t
  misc_feature (36)..(36): n is a, c, g, or t
cgcntcggccccccccccgcccctgtgtgggtgtgnggggtctctaaatattatgacaccgccccgcggtggggcgcctgcctcgcggtttgtaatatgttggggcggccccccctgcgtcgtctgcagaggttgcttcgtccccgccttgtgggagtaggaccccctccgtcttcatcttcctgtctccgccgccggcggccggtcgggtgttgttgttggtaggcccgccgtcttccctccttcttcatttggaggagagggagcgtccccctccctctgcgggtaggtgtccctctgcatgttggttcctccaccggcgtcgtcttctctccggcgggagatgcttcctcttattaagcgtctcctctatgtggggggcttctctcggccggtgtgcacggcggaggtttattactccgacatcgtgttgttttcaccacacacgcgcggcgaagacacaccacggctcatatgggcgccgcccctcttaatagggccgcctcatctttttaatagagaggggcacacactccatcttatgtggagcccaccacggtgttgtggtgtagtccccgcaccaaagagcgcacgcgcgctcgcgtgatacccgcgctttcccgcggcgatatttttctcccgcgcgagatatattttcgtgtggcgagaccccccacgcgcgctctccgcgctctatataagagaacacacagcgcttttccacagggccctctcttctgccacacgttttttcacgcgggggcgcccacaagaatagaattgtgtgagaatataggagagatataggctctttatgttttgtatacaccacccgcccacctccctctccacacgaggtttatggaaaaagagttaccacacacagattttggttacccgcgaaaattcttgtgggctataaaaacctcttttaaaagagattttgtaaaaactcatttaaaactggcgtttttttttccacgcccagtatcccacaccacaattggttttggtttccaaaaaaattttggga

SEQ ID NO: 602902 - DNA, 169 bp, Homo sapiens
aaaccaaccttcaaaattacggtcccaaattcatgaaggaatttttcttaaaactaaaaggggggtgggtataatccctaaatggtacccactggcgcccctaaacggtttccggtcaggtcctccgtagtgattttaaaaatttaggtatatgaattagttaaataga

SEQ ID NO: 602903 - DNA, 546 bp, Homo sapiens
  misc_feature (319)..(319): n is a, c, g, or t
caagctgaagaatttggtgattattggtgggaacatctatttatcaaagaagcccaagagcctggtggctgatattcatccccattaatctccattagccctgggcaaggtaagacccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggntgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaa

SEQ ID NO: 602904 - DNA, 248 bp, Homo sapiens
gcacgaggccagtgtggggcacgatggcagtggtggtggattgtggcgttcctctggctcagtcgtggtcttcatcccacctggctgtctcctgccccagaggacaggggagcctcttccagcagccggaggtcctgcactttctcacatctgtcccccatcaacacggccgcctgtcgacagcagccccataggccacagcctcatcagggttgatgctcttgttcagctccttgccgttgaagaag

SEQ ID NO: 602905 - DNA, 859 bp, Homo sapiens
cctgattcaaaatgaactctttcaatcgtggaaagaagcagacattcatgaaagtatgaacatattccacgatggaaagagtgcattttgaatcaggattggaagtgaccccaatatccgcagcttcagcacgtggtgcttgatcacttatggacagcaaggacaaagtagccacgacatttcctctgctacaacgactactgcagcacacgtgtggcccgatccctatgccctgaaccatacagctgtgagctgctttactttcacaggcgacgacaagacatagcgctagtgcggaaatggaaccaacgtatatcaggcaacgcgtgaaactggtgcagcacgcaaatgagattgcgccttgcaaaagatagtacattattccaccatgatgtgcccgatcatgaacgctggttcaatctgacacgcgacagtacacgacaacgagcttacaacagaaaatagaggtggagaaagagagacatcaagcagacgagagaccagattgacgactgtaagaccactcaagcaacataacacggacgaggcatagcaagatgtggcagctactttactttgctcacgtaactgtgcactgctgtcatattgaagacctaagactagtatttcctcgcagcacaactgacatgacagtgtgctccatttgaacgataacgataacagcagtcaacatcgcctattgtcgctttcaaaatgatcatgtttatagctggatggtctttattacaaagtattagatttttacttctatttaacggaaaactggacttcgcgtgaatgtgcataacttccttttattagctcttaaatatttacattcagacgcctacacaataaa

SEQ ID NO: 602906 - DNA, 547 bp, Homo sapiens
  misc_feature (438)..(438): n is a, c, g, or t
gattcctagactggagtgtagtggacgatctcagctcacggagactccactagccaagtgcaagcgattctcggtgtcttaagattcctgaggtagctgggattacaggcgcacaccactatgcctggttaacagggtttcaccacgttgaccaggctggtttcgaactcctaacctcaagtgatcctcccacctcggcctcccaaggtgctgagattacaggcctgagccactgctcaaattcaactttttaaagatagtgtttagaactaggtaaactttgtatacctcagaattttgtgaagaggagtaattgttcatattcgtgtctgatactttcagtgttacaggctaaaaggaaaaaactgtttctctatagtcaaaatacttcgacaccaaatgtttggatttttcacaccaagcaattttctgtagacnaagggaaacagttgccctacaatttaattcagttctgacattacccagagttagcacagatcccacaggccagggatcagtgctgcaacatccatccgaagcagtgccg

SEQ ID NO: 602907 - DNA, 259 bp, Homo sapiens
  misc_feature (2)..(2): n is a, c, g, or t
  misc_feature (43)..(43): n is a, c, g, or t
  misc_feature (57)..(58): n is a, c, g, or t
  misc_feature (74)..(74): n is a, c, g, or t
  misc_feature (76)..(76): n is a, c, g, or t
  misc_feature (113)..(113): n is a, c, g, or t
  misc_feature (120)..(120): n is a, c, g, or t
  misc_feature (131)..(131): n is a, c, g, or t
  misc_feature (148)..(148): n is a, c, g, or t
  misc_feature (151)..(151): n is a, c, g, or t
  misc_feature (156)..(157): n is a, c, g, or t
  misc_feature (162)..(162): n is a, c, g, or t
  misc_feature (176)..(176): n is a, c, g, or t
  misc_feature (189)..(189): n is a, c, g, or t
  misc_feature (201)..(201): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (213)..(213): n is a, c, g, or t
  misc_feature (221)..(221): n is a, c, g, or t
  misc_feature (233)..(234): n is a, c, g, or t
  misc_feature (244)..(244): n is a, c, g, or t
  misc_feature (258)..(258): n is a, c, g, or t
anagaattgcattaacttaaaatttatcataccttggcaaganctaaaataattttnngatatcttttcccttnanttgtagacgacatctaagaggatgaagaaaggagagnctaagtntgactcttggnctactttcctaacaatngtnttggnnagttngatgatggtaaagnagaaagggcacanttccaatgcctntttcntnagntnagggaacntcaaaatcctgnntatgtactgnttttttttttgtgnc

SEQ ID NO: 602908 - DNA, 206 bp, Homo sapiens
tgtactggggtacgtaaatacaaaaaatgaaagcatcatcatgccaacactcatagcaataacagcactgtaaaacctctatttctacatacgactagcctactcctcctcactgactatgttcccatccaccaacaacataaaaataaaatgacaattcggaacacacaacaacaaataaacattacgttcccacaataattggt

SEQ ID NO: 602909 - DNA, 133 bp, Homo sapiens
cggagagagtgggctaggtgcttttactacatatgatgatctgaaatccctgcttggttctgagctgcgtatattgaattggtaaacgtaataccaataggcttattatatcatttcctatcttaccctatta

SEQ ID NO: 602910 - DNA, 587 bp, Homo sapiens
gtactacttggttcccgatatggatgatgaagaaggagaaggagaagaagatgatgcatgcatgcatgcaagcaggcatggcagcatgcaagcatgcaggcaagcctgagtccagctcactgggccaagctgggccagctgcacagcatgcatgcaggcatgcacgcatgtcgcatcacccacagcacagccagcacagcaccgcacgcaggcatgcactcagcacagccaacaacacaggcaaacagttcacacacgtcaaaacacacaatacacaacagtgccgcctgtgaacctatatcaacactctcccacattccccggtcctccagacaatcgtcacacacgtggctcccctttacgagttcatcatgagaggcccggccccggccacgcaacccggctgtgcgacagactgcgcacaacacaccgagcagccagtatgaaccaacgagacgcacgaccgccccaacacaaagccacagacccaccaagatcacagtgcagccaccctctacggcaaacaccagggcgagcaggccaccaccacggaacacccacacaactttcacccaaaggacaccgtg

SEQ ID NO: 602911 - DNA, 153 bp, Homo sapiens
cacgaggctgcggacgacaggccactcctgggcagatgtctttgcagaagtattttttgtgtcaggttgtgatggggttttgctatcgctggcagggctggtctcaaactcctgacctcaagtgattcgcccacctcgtgccgcagcctcgtg

SEQ ID NO: 602912 - DNA, 315 bp, Homo sapiens
attttaaatccataatcttttaaaaatgactgcatctctatgctcactagattttcctaaaagagatttcaaggtgtaaattggccaactagtcttctctcggaactaaatcttttcagggttacacggaatatttgcccttaagaacattttgggttctttgtcagttgtcagaaagtccttcattcaaggtttttgggccgggtgcagtggctcacgcctgtaatctcagcactttggaaggccaaggcaggaggatggcctgaggccaggagtttgagagcagcctgggcgacagagcgagactccgtctca

SEQ ID NO: 602913 - DNA, 366 bp, Homo sapiens
agtcaagagaaatttataggaggccttcgggagaattagagcaaagactctcaggagaattcagcagacaggaaccagaagaactaaagaaactttcagaagtgggcagaagagagccagaagaactgggaaaaacccaatttggagaaataggagaaccgaaaaaaacaggaaatgagatggaaaaggaatatgaatgaagccctcggtagagatgaggatcaggaagctggtgttcagagggatcatgggattttattaaactggattttcaagcgatttgtctgttataggaaaaatgagggttttacttctgctgctttccatccctattttgccattaaataggtgtctttcactcttgca

SEQ ID NO: 602914 - DNA, 383 bp, Homo sapiens
aatacttagtacttatcttaggtgtcaattaattgcgtgttgtttgtatttattgatttcaccatggaattaaaaaacaggacaatgggccggggtgccagctgtcacgcctgtaatcccagcatgtttggaggctgaggcggttgtatcacctgaggtcaggagttccagaccagcctggccaacatggcgaaaccctgtctctactaaaaatacaaaacttagccgggtgtggcggcatgtgcttataatcccagctacatgggaggccgaggcaggagaatcgcttgaatctgggaggcggaggttgcagtgagccgagattgcaccactgcactcagcctgggtgacagagcgagactctgtctcaaacaaaacaaaac

SEQ ID NO: 602915 - DNA, 546 bp, Homo sapiens
tcccctggcatatagggggatgtgtctgcacacagctcacacgaccgagggtacaggaagactcaaactcagtcaaccattcttcaacccaactgggagtctagaaggcctaggcacacaggtgctacactaaacacttgtaggtcatgacgacgtgaaggaaccgatcttgttcatctctgtgccccagaactcggcatgtagcccatgatcgacaatgcagatctgaacaactgtcacaatcttctgtatcactagtgcccggcaacacagtcagtgctcttcaggtgtgtgggaaagaagccaatgagtagagaagtacccacaacgtctagcagtgaggaaaaaaagaaaaacgtgaacagtaacctatgtaaactacccattcccatcccatagctcagctccctgcacacagcaggtgctcacgtaagtgtaccgaatcaggaactaatctttgtgacatgcgtgcaaggccaacagaaggtgaccaaaatgtgcttgaataaatggatagaaagatataataaatatcaatattccaga

SEQ ID NO: 602916 - DNA, 623 bp, Homo sapiens
gccaagagtacttttggggaagtatatacttcccaaaccggtataactgtatgggggcggggcatgcttagcactgcaactgcgctaggttaagctgccaggagtccacgattaatcctcggttcacagggaagaataagacatgatggctctgtgccaatagggacactaaactcacagcgtacgatgacttcacaaggaagctgtcatgactacagggaagcagctctattctctctgatgccagggaccccttgttgtgtaggcacctgccctgagacatgtcaatggcccaatatgggatctagcggaaatattctgaggtcaggagtattaggcccaccctgggctccacggccgaaagccgtaacttggaaaaaccccaaattacccggtccggtctggccgccataggaaaccaggaacgggggttgccacccttagataatggcttaacaccaggggccggggagggaaaaatgggcggcggtttacaagggaaggccggggaataccccgcgttacccaaaattaggggcttggggggaaacccccctttctcacaaggggaaaatggggaaagggccccaccccctttgccacaaatttccgggtggcgggcg

SEQ ID NO: 602917 - DNA, 89 bp, Homo sapiens
ggatttgctggtgcagtacaactaggcttaatagggacatgatagactttacatcaaaggtgagctgctgtgaggcagtatttagaaca

SEQ ID NO: 602918 - DNA, 801 bp, Homo sapiens
  misc_feature (527)..(527): n is a, c, g, or t
agcactcctaaccaggtgtggaacatcggacgtccgtcccttcctggtccataagtgaaccatggctctcatacgtcgatgtataaggctcgagtgccttggagaagttccctgttgatccagcgcttcaagttcgggagcctgatgaccatccgtcctgtcacgtcggtgcgtaggacgcgggcgcaattgctcagaaagagccacccgcacggccacaagtgtatccgtgatgccttgctgttcctgcaacctgaggtacacatgcggctgctgttaccagttccgctctgtcctcgatcatcctgggtcagcatgacatgtggattgagcaatggggcttgaaggtgcacggtatgccgggtgaaagagtcgtgatccatggctgtaatcgtctctcttggcctctgtctctgccgatcactgtcgtcccaggaatggttgaagggggcatcgtggttacccatgtgatcccacatgccccaggataactaaagagtcatgggacgtctagctgcataactaanacaattcattcggagataaagtgggaacatcgtatcatccacattccacatcccggggcgcgtcttggtttactagagtactcccggtggcgtggtgcctgcaggcaccttcagtggcccgggatgtgcgtaggatacacgtggggcccccacatggcgtggttccgcttccatggcgtcggcgcacgtcgcgtagccggttaggaagcctgcgtccctggcggagggcggctcagttgcccctgtcgtgtcggcgcgcccctctatgcgaggg

SEQ ID NO: 602919 - DNA, 109 bp, Homo sapiens
gcaagcgtggtgctcactcgcaagtcttgcgtggtgcagacggaagcggcgggctcttggagaagattgatcgttagttcattgtacaccacactccaagttttgggct

SEQ ID NO: 602920 - DNA, 966 bp, Homo sapiens
  misc_feature (8)..(8): n is a, c, g, or t
  misc_feature (14)..(14): n is a, c, g, or t
agcggggngggggngtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgctgtatgtcttagatatacagcacaggtgctgtatgtcttagatatacagcacaggtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaaaaaaaa

SEQ ID NO: 602921 - DNA, 226 bp, Homo sapiens
cgccaaactcggatttcatctgggacggcaaatcttaccccgtcctgtttaccaaaaacatcacctctacccatcaccagtattacaggcaccgcctgccccagtgacacatgtctatatcggccgcggtacctctcaccgtccaaaggtatcatttatcacttgttccttaattccggacctgtatgaatggctccacgagggttcagctgtctcttacttttta

SEQ ID NO: 602922 - DNA, 402 bp, Homo sapiens
ccccactggaaccatgtgtgacctcgcagtcaccggggccctgctgctgtggccgctcttactcctgctgttgtccatacgcaggcacgagcacagcagctgctatttgccaccacgccctttcccgcattccatcattggcaacctatagcatacgcaatagaacaatattcccacgtccttcacccgagtgggccagcgctttgttacgctgttcacgctgtacgtggactcacagcgcatgcgcgacgatgcacgcatacaatgcgctgaacgaagcgctgctggactacgacaaggtctaggccagaggcggacctgcacacggtccatgcgcacagggacaggcgaatcattcttaatacacggacctacctgtaacgacatccgtcggttccctgg

SEQ ID NO: 602923 - DNA, 373 bp, Homo sapiens
gttttttaagggattttccaccccccccccgaatttggatggttttaaaattggtccctccagccccccggaacccttttttttttagggggggcccccccgggccccccccctttttttaatttttggttttaaaaaaagccaaaaagccccctgcccccaggtggaaattaaggagggtttttttttccccaaaaagcccggaaaaaggttaatttttttagccctttagaaattggggaaaaatttggaatttttcccattttgggttcccccattcccaaaattttttttgggggaaaaattggttcctttcccgacccccccctattttgttttttaaaaaaaaaaccccgaaatttttggtggggga

SEQ ID NO: 602924 - DNA, 937 bp, Homo sapiens
  misc_feature (8)..(8): n is a, c, g, or t
  misc_feature (14)..(14): n is a, c, g, or t
agcggggngggggngtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgctgtatgtcttagatatacagcacaggtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaaaaaaaa

SEQ ID NO: 602925 - DNA, 217 bp, Homo sapiens
ggcatggaactgaacacattcaagtgcaggtggtgccggatatgcggtcactcagttcagacgcaaaatatctcgtgaactatgtgccacccgtgccacaaacattcaaaatgaccgttcaatgaactggatatgtgtctttcgaatgcgatgggtaccaaagattcgaccgccctttgaggtggcctttttgacgacaggaaaatcaatgacgcgg

SEQ ID NO: 602926 - DNA, 912 bp, Homo sapiens
  misc_feature (8)..(8): n is a, c, g, or t
  misc_feature (14)..(14): n is a, c, g, or t
agcggggngggggngtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgcgtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaaaaaaaa

SEQ ID NO: 602927 - DNA, 1177 bp, Homo sapiens
  misc_feature (1177)..(1177): n is a, c, g, or t
cgtttagaaaccgtggctaagccaatgggagcacaaacagatgaacgattagtctcagtataaggaagcggtataagagactgggaggatcctaatggaagaaactcctgcataccacttatgggacccactattcatctgcaatgattgtggcctcataccttgtaaggatggagcctttcacacagatattcgttaaggtctacagggtggccactattgacctggttgaccggatgtttcacagtgtgcgcgaggcctggctatgcagcgctcgaagcacaatatggcagatgtgcaaagaactgatcccagagtgcttatatttacctagaagtacctgattcaatatccaaacaactttgatctaggctgtagacatagaatggcaccaagcttggagtagtgtatccttccaacctgggccataaggggagccacgagaattcatcagagtccatcgtggaggcttggaagtgtgataacggtgagtagccatctacatgagtggaattgacttaatgcttcggttatagaacagcaaggccctagcagcaggtagaaagcttgtagaatgtcttccaatcagtcttactttactgagcggttcacgtggcatatctacgaaaatcaagtgaagcgcattgaggggagacacgacccaattgggggtcattgactaacttcggccagaatcctaaaccgctatttaacaaccgcattccaccaaagcgtgtcggcacacagttccactccagtgggcgaccaatggccgcaattcgtggtcgtagccgggagccataagttgtgccggatttttgtggtacgtcgaaacccattgcagagcctcacttacaacccgtcaggagcccagaacctgaggcaaatctctttcgcacagagatacttgaggtaaacaaaaagaagggctactcgacacgcacatggaaacaaaacagcatcgtggccgcacacaccaacgtgccggacccctctgctctaaagctacgaccttatacacggtgcatcgtgcgatcatctgcgagacacaaaatgaactacatgaagatactcgtcatagcacacaaaccaaactagctaagaatcgacgaccgaccatctgtgcagtagactatcagctcatgttactgttttgatctttgttctagtgcgatgn

SEQ ID NO: 602928 - DNA, 327 bp, Homo sapiens
atatgtaacatcatacaggtggtatatgaacttagatgagtatagcctactacacacctaggctatatggtatagcttgtggctcctaggccacaaacctgtatagcatgttgccgtactgaatactgcaggcaatggtaacacaatggtaagtacttgtgtatctacacatatgtaaacatacaaaaggtacggtaaaaaagcataaaaagataaaaggcataaaaataataaataaagtataaaaagcatgaacaaataaaaaaatggtttatcaatataagggacttcaacatgaacggagcttataggttacataattacgga

SEQ ID NO: 602929 - DNA, 584 bp, Homo sapiens
  misc_feature (8)..(8): n is a, c, g, or t
  misc_feature (14)..(14): n is a, c, g, or t
agcggggngggggngtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtaagatgaagtggaaaggtacggaatcgggtacgggggggactgtctacggagtagcctcctcagatacatggaactaggtcggtcccaatgtaggggatggcggatagtacgtcggtaattactgtggcgtgatgcacaac

SEQ ID NO: 602930 - DNA, 1443 bp, Homo sapiens
gtggccaccccaagacgcgccccagcccgccatggcccggatcctccgggcatcctgccttctgtccctgctcctggccgggtttgttccgccgggccggggacaagagaagtctaagacagactgccatggcggtatgagtggtaccatctacgagtatggagccctcaccatcgatggggaggaatacattccttttaagcagtatgcaggcaaatatatcctctttgtcaacgtagccagctactgaggtctgacagaccaataccttgaactgaatgcactacaagaagaacttgggccatttggcttggtcattctgggcttcccttccaaccaatttggcaaacaggagccaggcgagaactcggagatactccccagtctcaagtatgttcgaccaggtgggggctttgtgcctaatttccagctctttgagaaaggagatgtgaacggggagaaagagcagaaattctacactttcctgaagaactcctgccctcccactgcagaactcctgggctcacctggccgcctcttttgggaacccatgaagatccatgacatccgctggaactttgagaagttcctggtggggccagatggcataccggttatgcgctggtaccaccggaccacagtcagcaacgtcaagatggacatcctgtcttacatgaggcggcaggcagccctgagcgccagggggaagtaactgatgcccccaccctacccctaccccctgcccatcatgcaagggccgaggaggggctcttcaggaaggaagccacattcccagtcattctacccccaccccagattctctttcttattacataaaagacaagcctggcacaactgtgtgtctgaaccactgtggacacgtgacaattgtcccagtgtgtgcatggctacacagccacgtatctgcctgcttgaaacccagggatggtccatctgtgtttacggcttggcacaacaccctcatatttttttcagctttctgttccaaatgagcccaaaggaaacacaagttctaggtccaatggttctgctcaaacctgaacatcattcttggggccagcatctcccacatgcccacactacacaccaccagcctccttcttccttcctgaaggaccctcctgagcccccaagcccatcccacagtgctcctgagaccagccaagacaactgtgagcgcgatggccgtgtaccccaggtcaggggtggtgtctctatgaaggagggcccgaaagccttgtgggcgggcctcccctgagcccgtctgtggtgccagcccttagtgcattcaggcttaggctcccaggcagggacactacccccgcgcctctggaggacatgctatcctctcactctgtccactggtatctcaacacccccatctgcccagtaaaggtctttctgcagcaaaaaaaaaagtgg

SEQ ID NO: 602931 - DNA, 498 bp, Homo sapiens
caggcaatagctcgtactaaacaagaatgtttgaaaagccacattagtagtccaattttttttttcacaggtgactactgtaccagtgtggagaaatggggctgttaactgtggtgggcccagacagtcatttgtctatattcctagtgatgagaaatttattccccctaaccttccaatgaaacaagtgtccacatagttctcatttttccctatggtggaaacattagtgagagggacccatgcatgttattaaaaattaagttcaaaacacttaaaataattctgtattagaaacttgactctatcataagtctcttctttgggaagtcatactgggctggtctaaactgctccaattccatggttattaacatttaggaagccagaagactattccagctagttcaaactagaggtttagtaactacaacactgattcctggtaggttgtgtgggttcggaaaggtctactcctcttcctctggcagaatttgc

SEQ ID NO: 602932 - DNA, 1452 bp, Homo sapiens
tttcgggttgttagagcgcttccaatgtcacgtcctgccattactgcagcagccacttctgtgttctgtggctcatcccatcgccagcttcaccatgctgtcatacctcacgggaaaggaggccgctcatctgtcagtggagttgtggccactgtgtttggggctacaggattcctgggtcgatacgttgttaaccaccttggacgaatggggtcacaagtgatcataccatatcggtgtgatgtatatgacatcatgcaccttcgtctgatgggtgacctgggccagcttacctttctggaatgggatgcacgagacaaagattctatcaggaaagcagtgcagcacagcaacgtggtcatcaatcttattgggcgggagtgggaaaccagaaactttgattttgaggatgtttttgtgaatattcctcgagcaacagctctttgagaaaggagatgtgaacggggagaaagagcagaaattctacactttcctgaagaactcctgccctcccactgcagaactcctgggctcacctggccgcctcttttgggaacccatgaagatccatgacatccgctggaactttgagaagttcctggtggggccagatggcataccggttatgcgctggtaccaccggaccacagtcagcaacgtcaagatggacatcctgtcttacatgaggcggcaggcagccctgagcgccagggggaagtaactgatgcccccaccctacccctaccccctgcccatcatgcaagggccgaggaggggctcttcaggaaggaagccacattcccagtcattctacccccaccccagattctctttcttattacataaaagacaagcctggcacaactgtgtgtctgaaccactgtggacacgtgacaattgtcccagtgtgtgcatggctacacagccacgtatctgcctgcttgaaacccagggatggtccatctgtgtttacggcttggcacaacaccctcatatttttttcagctttctgttccaaatgagcccaaaggaaacacaagttctaggtccaatggttctgctcaaacctgaacatcattcttggggccagcatctcccacatgcccacactacacaccaccagcctccttcttccttcctgaaggaccctcctgagcccccaagcccatcccacagtgctcctgagaccagccaagacaactgtgagcgcgatggccgtgtaccccaggtcaggggtggtgtctctatgaaggagggcccgaaagccttgtgggcgggcctcccctgagcccgtctgtggtgccagcccttagtgcattcaggcttaggctcccaggcagggacactacccccgcgcctctggaggacatgctatcctctcactctgtccactggtatctcaacacccccatctgcccagtaaaggtctttctgcagcaaaaaaaaaagtgg

SEQ ID NO: 602933 - DNA, 1228 bp, Homo sapiens
gtggccaccccaagacgcgccccagcccgccatggcccggatcctccgggcatcctgccttctgtccctgctcctggccgggtttgttccgccgggccggggacaagagaagtctaagacagactgccatggcggtatgagtggtaccatctacgagtatggagccctcaccatcgatggggaggaatacattccttttaagcagtatgcaggcaaatatatcctctttgtcaacgtagccagctactgaggtctgacagaccaataccttgaactgaatgcactacaagaagaacttgggccatttggcttggtcattctgggcttcccttccaaccaatttggcaaacaggagccaggcgagaactcggagatactccccagtctcaagtatgttcgaccaggtgggggctttgtgcctaatttccagctctttgagaaaggagatgtgaacggggagaaagagcagaaattctacactttcctgaagaactcctgccctcccactgcagaactcctgggctcacctggccgcctcttttgggaacccatgaagatccatgacatccgctggaactttgagaagttcctggtggggccagatggcataccggttatgcgctggtaccaccggaccacagtcagcaacgtcaagatggacatcctgtcttacatgaggcggcaggcagccctgagcgccagggggaagtaactgatgcccccaccctacccctaccccctgcccatcatgcaagggccgaggaggggctcttcaggaaggaagccacattcccagtcattctacccccaccccagattctctttcttattacataaaagacaagcctggcacaactgtgtgtctgaaccactgtggacacgtgacaattgtcccagtgtgtgcatggctacacagccacgtatctgcctgcttgaaacccagggatggtccatctgtgtttacggcttggcacaacaccctcatatttttttcagctttctgttccaaatgagcccaaaggaaacacaagttctaggtccaatggttctgctcaaacctgaacatcattcttggggccagcatctcccacatgcccacccaacacacacaattttaaaaagtaaactttttaaaaagagtaatagcattttttgttgttgttaatcagtagataatgcttgaactgagttgatacattgaaaattaaaatacttgtgtataacaata

SEQ ID NO: 602934 - DNA, 256 bp, Homo sapiens
gctgattatgaaaaaaagaagtctgtatcatctgcttccaagtctgttatgtccaaatatattttaattatgcatttattttgctacttttataaatattagaggatttcaccttaaattattttttgtaactcggtctagagacatgtctttcccattattattttctctcaatgtgagacatatatattcaactctgtgctatgcatatatgtgctctacacagagtgactctctctatagagagtagtgtaga

SEQ ID NO: 602935 - DNA, 1063 bp, Homo sapiens
gtggccaccccaagacgcgccccagcccgccatggcccggatcctccgggcatcctgccttctgtccctgctcctggccgggtttgttccgccgggccggggacaagagaagtctaagacagactgccatggcggtatgagtggtaccatctacgagtatggagccctcaccatcgatggggaggaatacattccttttaagcagtatgcaggcaaatatatcctctttgtcaacgtagccagctactgaggtctgacagaccaataccttgaactgaatgcactacaagaagaacttgggccatttggcttggtcattctgggcttcccttccaaccaatttggcaaacaggagccaggcgagaactcggagatactccccagtctcaagtatgttcgaccaggtgggggctttgtgcctaatttccagctctttgagaaaggagatgtgaacggggagaaagagcagaaattctacactttcctgaagaactcctgccctcccactgcagaactcctgggctcacctggccgcctcttttgggaacccatgaagatccatgacatccgctggaactttgagaagttcctggtggggccagatggcataccggttatgcgctggtaccaccggaccacagtcagcaacgtcaagatggacatcctgtcttacatgaggcggcaggcagccctgagcgccagggggaagtaactgatgcccccaccctacccctaccccctgcccatcatgcaaggaccctcctgagcccccaagcccatcccacagtgctcctgagaccagccaagacaactgtgagcgcgatggccgtgtaccccaggtcaggggtggtgtctctatgaaggagggcccgaaagccttgtgggcgggcctcccctgagcccgtctgtggtgccagcccttagtgcattcaggcttaggctcccaggcagggacactacccccgcgcctctggaggacatgctatcctctcactctgtccactggtatctcaacacccccatctgcccagtaaaggtctttctgcagcaaaaaaaaaagtgg

SEQ ID NO: 602936 - DNA, 288 bp, Homo sapiens
ccatctgattttggggggtcccggatttctgggaaaattcccccagaaccccttgggaacggggattgaaattccgtccccctaagggagatttttcaagcttttcaaccctggggaccccccctggctttgggccccccccctctcagaacagaagggggggaagccagagcccccccccctgcccccccccggcccccccgcataacgggggtcccctggccgcgggtttttgggggtgggggggggccccctaaagccccttaataaaatttgggcccaagccca

SEQ ID NO: 602937 - DNA, 323 bp, Homo sapiens
  misc_feature (76)..(76): n is a, c, g, or t
  misc_feature (208)..(208): n is a, c, g, or t
aaaatagtaaacctttagcaaatacacaaatgatgccccattctgtattctttttaattttaaaaataatgacacncacatacaggaagataaaaggtataaaaatatactaagtactttttaaaaaggaaaattcatgttttggattattactgaattgttgctaattactgtaatgtaagtcatatgtccttacatagttttgaanaatgctttctttgaaaatctaaaaaaagtgtgaatatactgatagtcattgctgtatcattgatgtttcactcaatttttggtaaagatttataaagatcttacctagaaactaa

SEQ ID NO: 602938 - DNA, 140 bp, Homo sapiens
aggctccatgctaaacgagtatttggaggtcagcacggctgctcacgtgtcgacggaacttgtacaggggaggcatgcaccgaaggtggtgaatacacgtcgaccaggctccagtgtttacgattattgtggaggtcagc

SEQ ID NO: 602939 - DNA, 222 bp, Homo sapiens
tggtctcctcccgttactcctgagctcttcctcatccacactatacaccaccacatagtggttaatgaggtcttccaccacactggccagccttgtagtcctgcccatctgtctggaatagcgtgggccaaacacaattgccaggttgtgcacgttcatcttggttcgtgtactgagaagcacttgaacacagtacatggtggcttgataaggggcctatca

SEQ ID NO: 602940 - DNA, 1216 bp, Homo sapiens
tgcagtgcctcacacctgtaatcccagcactttgggaggccgaggcgggtggctcacgaggtcaggagatcaagactatcctggctaacatggtgaaacctgtctctactaaaaatacaaaaaaattggccgggtgtggtggtgggcgcctgtagtcccaggtattcgggaggctgaggcaggagaatggcgtgaacccaggaggtggagcttgcagtgagctgagattgcgccactgcactccagcctgggcgactgagcaagactccgtctcaaaaaaacatattgaaaggccgaggtaggtagatcgcttgaggtcaggagttcaagactagtctggccaacacagtgaaaccccatctctactaaaagtacaaaacacgaataaaaattagccaggcatgatggcacacacctgtaatcccagctacttgggaggctgaggcagaagaatcacctgaccccagaggtgaaggttggagttccagggaggtgagaggcaccattgaattccggcctttgcaacagagtaccactctgtctcaaaacataaacctacattgaagagaaaaaatttggacgcccgcttggccccagccgactttaagactcgggcaagcttaagcaatgcggcccgaatttcaggtcaatttggccaattcgccttatagggggccgattacaattcaactggccggggtttacaaaggcggaactggtaaaaccttggcgttcccaacttaaaagccttggagaaaatccccttttcccagttggctaaaaccgaaaaggccctgaccggttggcttcccaaatttccctaacctaatgggcacggaattcaaagcggtaaatttgttaaaacgcgggaaatttggaataaccgcacttctttccccaggcgcaattcggaaatacctcttcacacaaaataccccgcacagttagaggtttccaattgagacaggtccctctttagagagggcctccctctaggcggcccttttgtgggggtccctctggggacatcccatacaacttttgcgcggggccccatttggtctcctcagtccccctgtacgctgcggacacgctccttccaacacgcgtgtcactgatgccgttccgctccgaccgggcacactgcgctcgcacacccccctcgcgctcgacagagtccgctgcttctcctcacatctcacgtactctctacccc

SEQ ID NO: 602941 - DNA, 202 bp, Homo sapiens
agaagaacagactcgaaaagctctagaactggatcagaacgaaaacgagcaaaagaaggaagcagaacgacttgaaaaggagcgtcgagctgctgaggaggcaagtctgccatagcaaaacaagctgccgaccagatgaggattcaggagcagctagcagcagaacttgctgaattcactgccaagattgcacttctggagg

SEQ ID NO: 602942 - DNA, 503 bp, Homo sapiens
  misc_feature (17)..(17): n is a, c, g, or t
  misc_feature (38)..(38): n is a, c, g, or t
ttgagccccatggaagnacgcgcctttgaagccgttanacgggcactcgaccattatggacgagcccccaccggaagcgagtttcgacacggcaggttcccgcccgtaagaagcgaccgaagcgcctgaggaccggcaacatgttgcggtcgcagaataaggcagctgacgtgctgcgcatggacgcgggctttaccatgagtaactccattcctgctatacgaatccccatttgaacaagcacagaaggtgataaccatgctcgaacagcgacaggagcttgctgagaacaaggatgagatcgctctagccccgctcggaacagagggtactgacaatcccctttctggtgaggaacagcatcagaaccacacagggcacagacatctgatgctaccagacttcgacccgctgcagcacatcggccacaaccaaccacgctaccaacaggccgacttcctgcgcgcacaacagtgcgcatccacgccgcaccaccccccccc

SEQ ID NO: 602943 - DNA, 169 bp, Homo sapiens
aactctccaggagtattgaatccaaactgagtaagagcgaaacaaatatcaggcaaggcacagcctcaggcgggctccgtgggtctggggcaggaggtgggagacaggagaggcaaaatggcagggacttgacagcaggttcctcttgtctacttcttcctcccgcctc

SEQ ID NO: 602944 - DNA, 462 bp, Homo sapiens
  misc_feature (152)..(152): n is a, c, g, or t
ggcggtccgcggcgcgcagctgtttcggtaacgtgcttttgcctcccgggctcccggcgaggcaggattgctgggttgggtggcaggtggcgaacggcggctccctggtgtggggagccgaggctggtcgcaggccctccgggagcgcctgnggtgcgtgggggggccgcagcggttaggcgccctgcccggtgggccccgccagaatctcgcgcttgggcctcccgtttgcttggctttggaatttgccccccggaaaaaggaagggccggccgggctccttgtgggcccggagattcggggcgcccggtgacttcctggtcagcgcccggcgtccagactctcgcggaccacagccgtggcccgtgacattcctttcaagggcgccaagccaaagaggggaggaagctttcccaagggaaggcagaggcggcccttgtggggaaggtcttggagggcccg

SEQ ID NO: 602945 - DNA, 868 bp, Homo sapiens
tcgtagtcgaggcctgggtgttaacaccggcgaccgggatacggatgggtggctgggtgggggacgctgcagctggtggccatttgaggggagcccatggaggcctgaaaggcatctgtcagtgcgcccctgcccggatggcaacatgtagttctatgagagtgagacaaccctaagttgatgagacacccagtggaagacgtatcttttccaccacgaaatcacgaacgttggaaggggacacattgggtgacactcaagtggaacaacaatgtacaggaaaaaggtgaccaaccttggggggggactttggggaggacatgaggacggacgcccttgaagtgacagcgaggccaaaggatggtgaaaacagcggggggggtccagaggccacacgaagacatggaacgtaaacttccgcggttaaaccgatggacgccccccttgagaagagcacccaacatcggaagtacaacgtaaggcaagaagccaagacgggaacaggggcaaaaggagagtatggggcaaaagccctttggtgggtctatactctccaatggggcattctgaaggatggcatgatggaaccattggtggaacgggaacattatggcttacgctggcgttaccatggacctttctggcagaccccactctttatctcccgaagttggcggggcaaacgtttaacccgggaaacaactgtatacccccaaacgggtggggtcctcccccccttggggtggatggcgtgggcccctcttttcacgagtacccacgcttaatattcggatacccccaatgagggaaaatactcccttcccgagtagacgccaaaattattataccagtaacagtgcgacacggg

SEQ ID NO: 602946 - DNA, 620 bp, Homo sapiens
tgtttcgtcttcttaagcacacaatcctctcaactccggataacaaaacactgattttccttgggggtcaacttttcccggttatttgcagagttcggtaggacagtgtcccgacccctcacgggccgaggtctggaaagaattgctcaattagactctctctcttgagaatttgaatcctcagctgagtggcttgatggaaaattgtccccattctatgacagaatccccctgagactgcctactagtttccgctgctcagatcttttgagttttctggttctaatcctttctgaggtctgtatggtcagatttttttttaattctatgaatttccccatactcttttgatgaatttctttgtgattagcttagccagatttattttagttgcttatactaaaatatgcctaacttatgtaggaattatgaaagtaaagtagaaacaagaagtgtgtgtgcatgtgtgcaagcacgcgtgtgtgcgagatttacctcttgtcagatatatttcctcccttctcactttcatggaaggagtatacttccctgctcctttaatgtgggacttgaccatatggctttctttggcttcatggtggatagacagtattcaccac

SEQ ID NO: 602947 - DNA, 213 bp, Homo sapiens
ccttttttttttttggggccttttttcccccccggggggggggggggggggaaaaaaaaaaacggggggccccccccccccccccttggtttttccccccccccaaaagggggggttttttttttttcccggaaaaggggggccccgttttttttttcccaattttttgccccccggggggtttttttttttttaaacccgggggccccccca

SEQ ID NO: 602948 - DNA, 111 bp, Homo sapiens
cctttttttttaatgaaaaaaactttttaattaaatcgcttttggggaagggcatataaaataaaggatttatcccatatatgtttctagaaataaaagaacccttttgga

SEQ ID NO: 602949 - DNA, 100 bp, Homo sapiens
  misc_feature (93)..(93): n is a, c, g, or t
actaattgatttattttatttttaatttcattatttatttattatttatttattttttattatactcattatttatttgtaagaaaggaaganggaaagg

SEQ ID NO: 602950 - DNA, 441 bp, Homo sapiens
  misc_feature (25)..(25): n is a, c, g, or t
  misc_feature (40)..(40): n is a, c, g, or t
  misc_feature (60)..(60): n is a, c, g, or t
  misc_feature (90)..(90): n is a, c, g, or t
  misc_feature (405)..(405): n is a, c, g, or t
tttaatattagtgaaaaaccccaantgaatagactccccntgggataggtgagaacatgnttattgcaatatgttcttggtaaacattgncacagttctacctccattctgaaataaagtttgtgaatctggtttttattgtgacaaatttcatagataacattggaatttgatttgtaatatttctaattgggagatttaaatgaaaagtaaaattaatttatttttaaatggtcaggggaaatttaaaagccaatcttttgtagatatttaaaaaatcagtgtgggttattttacttatttaaccccctgggtgttaatctgtaacagtttgtaaaaatggtaattttgaatgtgttgtatttttacctagatgtaaatttccacatgtattaaaatgtacanaatgttttgttaataaaatttaataatgtttataaa

SEQ ID NO: 602951 - DNA, 103 bp, Homo sapiens
acataggatatcttcagagatctgctcttaaacgcaaggcccgacgggaagccacggtcaacccacgaagccacggtcaacccacaagccacggtcaacccac

SEQ ID NO: 602952 - DNA, 308 bp, Homo sapiens
  misc_feature (121)..(121): n is a, c, g, or t
  misc_feature (126)..(126): n is a, c, g, or t
tggaccccccctcccaaccccaggggggcctgtgggggtccatttgggtaagtttgggccccccctttcaccagttttttgggccttcccccgggccttaaccccaaaggaggaaatcccntaaanccctccccaccccccctgggggtgggggggggggtccgtccggaaaaaaaaaaaaaacccaaggcccgggctggggtttatttaaacttttttgtgtgggtttggggagggaaagccccttaaaattattggggttggttgggggggggcaggatttcacccaaaaagggccagtttgttta

SEQ ID NO: 602953 - DNA, 396 bp, Homo sapiens
tgagttgtgtcccccacaaaattcatttgaagccctaaccaggcagtaccaccagaatgtgactatattgagagatggggttttaaaagaagtaattaagttaaaatggtttcattagggtgggccctaatccaatataactgatgttcttataacaagaggcaatatggacatgggcacacacagagggaagatcatgtgatgacatgagtcaagaagagaggcctcagaagaaaccaacctgacaacacctggatctcagacttctaccttctagaattgtgaaaaatacatttatcttgcttaacccacctagtctatgataatttgttatggcatctctagcaaactaatacaatatgtaatcaattaatgaaaataaaatgtattaataag

SEQ ID NO: 602954 - DNA, 114 bp, Homo sapiens
agctttgttcacattatagagactcctaggatgtgtgttcatggacattatagctatttgaagaaaggccagtgatccagcaaagggggaacaatatgcatttcaccccacatg

SEQ ID NO: 602955 - DNA, 181 bp, Homo sapiens
ctcctgactaggcctctctgtagagatggatcagatacgatggaacgaggggacagatcatagaccatgcacaaattccaagatcatagagaatagaccaccgatccatgaacccatatgcatacacagagccagaacctacagagaaggtggcccatgaaatccggttcccttcactgtc

SEQ ID NO: 602956 - DNA, 143 bp, Homo sapiens
atttttagttttatttcctgatagcaaaaggaaaaaaaccccccatccctcaaaaaggccaaggtcccgtccccctgttgtcggtaatttgtttgtctttctgaaaggttgaaaattgtgtaataaacttgatgccgctgtca

SEQ ID NO: 602957 - DNA, 816 bp, Homo sapiens
agggcaactggagacaacccagtttggagaactgctgcttcacatcgggggaacgtggcttcgtgttcaccaagaggacctcactgagattcgggatatgctgttggccaataaggtgcccgctgctgctcggctggtgccatcgccccgtgtgaggtcactgtgccagctcagaacactggtctagaccccgagaagacctccttcttccaggctttgggcatcaccacgaaaatctccagaggcaccattgaaattctgagtgatgtgcagctgataaagactggagacaaggtgggagccagcgaggccacactgctgaacatgctgaacatctcccccttctccttcgggctgatcatccagcaggtgtttgacaacggcagcatttataaccctgaagtgctcgacatcacagagcaggccctgcactctcgctttctggagggtgtccgcaagttggccagtgtgtgtctgcagatcgggtacccaactgttgcctcggtgccacactccatcatcaatgggtacaagcgcgtcctggcattgtctgtggagactgagtacaccttcccacttgctgaaaaggtcaaggccttcctggctgatccatctgcatttgcggctctgcccctgcagctgctgccaccactgctgcccctgcggctgctgcagcccctgccaaagctgaagcaaaggaagagtcggaggaatcagatgaggatatgggattcggtctcttcgactaatcccgccaaagcaaccaagtcagcctgcttaatttgagaaagatggaaataaaggcttacttctctt

SEQ ID NO: 602958 - DNA, 121 bp, Homo sapiens
gcccggcaagtaaatgggaacccctccctaaccaccacacccccgcttatggcggtcaaggggggccgttgggggtttttctttaccacggggggttttaccccaaaacggaaactctttg

SEQ ID NO: 602959 - DNA, 267 bp, Homo sapiens
tagagcatccccccccttccccgggtaggcaggaaggactgtcccagacgatttgcttcctctagagcctaactgctggggaggagaggactgttcctgatggaagttaacccgcagctaagtcacccagagcacaggagctgccatgtcagaggggaaatttgcctatgtcataccgtgacagcccgcaggatcaggtgacttttagcagagaccctggtatttttcctgtgcccactccggcttgtcctcatctctacccatccg

SEQ ID NO: 602960 - DNA, 714 bp, Homo sapiens
  misc_feature (1)..(1): n is a, c, g, or t
  misc_feature (13)..(13): n is a, c, g, or t
ngcgcaacgcgtnctgcctcgcacccctggacagcgacccccgacgcgaaagccgcccggtgccgaccccaggagtactgcacgtctgaccgctgacatcgtggaggtggtgcgcaccgagtacgtgtacacgcggccccgccatggtccgactacgctgcccaccatccacgtggtgacgcccacctacagccgcccggtgcagaaggccgagctgacgcgcatggccagacacaggctgctgctacgtgacccaatctccactggctggtggtggaggatgcgccgcgccggacgccgttgatcgtcgcgcctgttgcgcgacaccgggctcaactacacgcacctgcacgtggagacgccccgagagtacaagctgctgaccggagacgtcccgcgagccacgcatcccgcggggcaccatgcagcgcaatctggccctgcgctggctgcgcgagaccttcccgcgcaactccagccagcctggcgtggtctacttcgcccgactgacgactaacaacctacatgcctggagctcttcgacagagatgccgcacgtcaccagtgagggtgtccgtgtggcccgtcgccttcgtgggtgatctgcggtacgagggccccacgggtgaccggggccggcaaggtggtcggctggtacgacggtgttgacgcgcaccgcgcatatgcatagacactgcgtggatacgccgtcac

SEQ ID NO: 602961 - DNA, 290 bp, Homo sapiens
  misc_feature (88)..(88): n is a, c, g, or t
ccatgccagaggtattcatttgtgcatctcccacagctccaactgtcctctgctagttcttcaccactattattgtatgcagctctangttaaagccacattttgcatgtataacctttaagtctctacttaccacaaacttgctttttacttgtatttattagaaataggtcttcagcttaatcaaatgcatttttttaaggggaagggatgtatttttggaaatgggttttttctcctcctttcagcttcttgtttttatttttatttttatttttgaggggaaaaga

SEQ ID NO: 602962 - DNA, 165 bp, Homo sapiens
ggtaatgcagacgctgcgtagccggctccaagttcaagaacacaggctctggagcagttgcccggtttagatgtgtagttgcaaatgtggagataatcaaaggccttcctgtgtaaatgagcactgtgggagctacaggaggaaactcccgagaaccgtgcctgg

SEQ ID NO: 602963 - DNA, 973 bp, Homo sapiens
  misc_feature (694)..(694): n is a, c, g, or t
  misc_feature (970)..(971): n is a, c, g, or t
ggacaacgcggcgggatgtccgcgagccaggcgagtgccgcggggcaggggggccttgcgcgcggagggcggcctgggttcggcctccctccgttccctgaagcgggcccgcgaccagcgcgggagcaggcaagaagaggcggagggctccagcgcgtctctctcctccccacttaagctgagccgggggaagccaggcgggcccggggtgtcttggaaggaggggggggttccggttgccccgaaaattggaaattcctcttcacttagaaatatggaagacttgttccattcaacccaggggagccacaacagttcattcattggtgggggtggaataatgcagggaaaactttaccattttttaaccaaatttcctattgaatgtgagtggtacattacctttttcctaaaaattagggaggtatgtacacagaagatagtgtgtaataaatacatgtttccaaatgtggcaatatggtggacaaaaaaatcttcttggtctccctggaaacatttactattatttaccacaggagttggtaattagttgttgtggaccagaacagacagagagaggattgtggtactagagaagaactctataaaaggtaggcatgaaggaactaagaaaagctggaatggcgggatttgtgctaataacaaggatgtttaaggatgtgcttgatggttnccagaaatctccaggttttggaagctacttctatttaaggatcacagggggaattcagggagtctgtggccaacggcgagggaaaggtgccaggaatggatgggtatgcggatagaatagaacgtaggacctccaaatggaaaagagggggactacgcagaggcaaaaagggcgacattaacggcgagtttagaaaaaacatgaagaagatctcggtgtataacagggggtattcagcggaggaacttctttttgctttgctttattttcgttggnngg

SEQ ID NO: 602964 - DNA, 868 bp, Homo sapiens
cgggcacagtggctcacacctgtaatcccagtactttcggagggccaaggcgggtggatcacttgaggtcaggagttcgagaccagcctggcaacgtggcaaatcccatttctactattaaaaaaaaaaaaaaatttaggaataactctaaattacactttttttcacacgcaactttattcacaatagccaaaaactcaaaggtccattaccaggtgatggttaaccaaccggtgggtagatacataatagatagaatattattagatatcactagggaatgacggggctgatacattggctacaagggagataaacctcaaaaactataatggctaagtaacagaagccagacttaaaagtggtcatatttgtgataactccatttatttatttcataattcattctatttatataaattattggaagagtggagtctcgctgtgtgtgcccaggcgtggaattgcagtgttgtgacctcggtcactgtaagctcggctccaggttcatgcattctctgactaaacctccgagcagtgagaccaaggttccaccactaggcccagctaatttttggcattttagtagacgggggcgttcaccgggggtatagacacaggggggtgcgaaacaccggggaaaaaaggggaaaccgtgtgtgttagcgaaaaagtggcaccaacacgaagcacaacaacgaaaaacatgtggggcggcgcgcctggaaaaaactaaaacaacgagtggggccggggcagcgaaaaagaaaaagacaagagggtctataggaccagacggagcaaacggggcgctacacaaaaacagcggcggcggcgaaaacacaatgggcgtgagacaaagaagact

SEQ ID NO: 602965 - DNA, 165 bp, Homo sapiens
tgtcggtacatggactccatcatcgctgtcagctctgactcggagtgcatcaggctgctacttagcaacaaggcctttctgtttgatgcctgctcgggaggttggcttcagtctccaggctttcctgatccgtgtgcatccaggtatcttgttacttgctttctc

SEQ ID NO: 602966 - DNA, 244 bp, Homo sapiens
  misc_feature (129)..(129): n is a, c, g, or t
  misc_feature (162)..(162): n is a, c, g, or t
  misc_feature (221)..(221): n is a, c, g, or t
  misc_feature (227)..(227): n is a, c, g, or t
attattcgtgagcacatgggagacatcctctataaactttcctccatgaaattcaaggatccactgaaagatggtgaggcaaagatcaaaagcgactatgcacaacttcttgaagacatgcagaatgtnttccgtagccttgaagattagaagccttgaagnattacaactgtgatttccttttcctcaggcaagctcctatgtgtatattttcctgaatntctcanctcaaaccctttgcttc

SEQ ID NO: 602967 - DNA, 254 bp, Homo sapiens
cgtcacggggattgtgcggtgtgtgatgctcgggtacaatccgagtactttggacacataaaatgtgcatcgtgcggattttattttacagtttgttggttaggtacgcttcacgggttaggatgagtgggacgaagaccgagaggaagtaaagtttaattatgcctttttgggtcgaggtgatcattgaggtggagatttggtgctgtgaaattgtcctaggttatagcttttctagtccggttaggtctaag

SEQ ID NO: 602968 - DNA, 191 bp, Homo sapiens
tcaggagagagaactgaaccgcgagtggcaccaacagtagcttgtcagagtggcaagagtagatctctggagctcggcgcaccatgcaggcttgtgagatagagctgcagtcccagctcacgatgaaagcattcccttgtggggcaacctggcgggagacagacgaacctgctactgcggtgcagcttgtc

SEQ ID NO: 602969 - DNA, 287 bp, Homo sapiens
aggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgctaaacgtaggtgcacagccagcgtgaactataaggagcccaccctcgcttcgaaactgagaagaggggac

SEQ ID NO: 602970 - DNA, 160 bp, Homo sapiens
ggcggcagtgatcgagctcggtaccaggatttgagccaatcaaaaaaggagctgtcagcgactaggggatggagccaattgccgtgcgagcaaatcccttgtcgctaggcggaaaacaactgggcttgaccagtttctacataatcgccggtcacgagat

SEQ ID NO: 602971 - DNA, 741 bp, Homo sapiens
cattgtgagggccaacaagttattacgaaactggactatccgcgcatcccatacaattgggacagaccgtagttccactgtaatcatgaggaggctgactccagtaagaccagtccctaccctcacacagattctttaccatttgcacgtctcatccgggcgccttcaagttatgagcagccctgagctatcagctccagccgtcctagttcttgcacgtaagcgggactcaaaacaaccccctaggaaatcacctcccagttccgataaggagtcaccttgcgcacccttacttacagcatactctatagaccgcccctcggctctacttctcttccttcgtctccttaatgacattaacactattctcaccagacctcctaggcgacccagacaattataccctagccaaccccgttaaacacccctccccacatcaagcccgaatgatattgtcctattcgctctacacgattctctcgatcccgtccccatagacataacgtaggaggcgtccttgccctattactatccatcctcatcctagcaataatccccatcctccacatatccaaacaacaaagcataatatttcgcccacgtaagccaatcgactttattgactcctacccgcagacctccgtcattctaacctgaatcggaggacaaccagtaagctaccctttaccatcagtggacaagtagcatccgtacaattcttctacaacaatcctataatgc

SEQ ID NO: 602972 - DNA, 300 bp, Homo sapiens
aggtagtgtaggtggatgccgataattccagggactctgggattgccaacggcatggagggtcgcttgagcacaggagtacaagagcagcctagcccccatctctacgaaaaataaaaaaattagcctgggcatggtggtacacacgttgtagtcccatgctactgtgggatgtgctgagtgtggtgatgtgatcacattgatgcttcctgggatgattgatggttacatgggaacttgtgactcataccagctgcactccatgccgtgggtggcatgagcaatgtgccctattgtattg

SEQ ID NO: 602973 - DNA, 614 bp, Homo sapiens
ccttaaaacattgttaacgggcccccccagagtttgataacaaacgagctgtggagcaattcacctcttctcaaatatcggaagaaggtcctcctcccctcttgtcgcccctgagataaacgcatgtagcaccacaggttacaatgggagcacttctcgttgaacactcatgtggagcaaagactcctcgctgttttttcgctaaacagatcactcccgagtcgtgggagagtgagcgataaaatatccccgcttttcttttcatgaacacacacaccgcacactccggataacaacaagagtgttgtgcgcgcgctaaagcgtgccgcattcccttgtttagcccggtgttttgagcagaaagatattatattccgccacagagaggcgtccgtatgatgacccccccactgatgtgggcgctctagcaccagattctgttctttaaacgcgatctcctcttccccacgcgggtgtacagtcgacacactgtgcgctcaccacacagatttccccacccatctatcatgcggtcttttgacaaccagggttctttacatggaccgggacccaacaaggtgacggataattaacggcccagcaatgtacgaaaa

SEQ ID NO: 602974 - DNA, 369 bp, Homo sapiens
cccagcccattcgaatgaggctcctggtcatgcttctttaccttcccttaggaaatcctcctggatgggtttctataaatcttattctgctctgtataattgtatttttcatgtggacagcatttctttcatctgcttgttcgtgctctaaaaacatcattaattaattattcatgattttatgccattatgcttctactaaaggtatatgtatcccatctcttgatctgtttaactagttttgattactttcaatcgtgcagttcttagcatttcttttaatttagtgtacacttctatcccctggcagtgtcattgtctcggctgtgagcacttattgtttgataactctcttcacagaaacatgat

SEQ ID NO: 602975 - DNA, 331 bp, Homo sapiens
gagatgatgaagtttcactcttgttgcccaggctgcaggacaatggcgtgatctcggctcaccacaacctccccctcctgggttcaagcaattctcctgcctcagcctcctgagtagctgggattacaggcatgtaccaccaggccgggctaattttgtatttttagtagagacagggtttctccatgttggtcagtctggttgcgaactcccaacctcagttgatctgcccgcctcggcctcccaaaatgctgggattacaggcgtgagccaccgctcctggctgaagttttcccttctggatgtcccctcacccttctgtcgtcttctc

SEQ ID NO: 602976 - DNA, 227 bp, Homo sapiens
tcctgaaataccagtttgtgaaaaaggctgccagccacctcctgggctccaccatggtcatcatacaggtggaaatacggtcttctttgtctctgggatgactgtagactacacttgtgaccctggctatttgcttgtgggaaacaaatccattcactgtatgccttcaggaaattggagtccttctgccccacggtgtgaagaaacatgccagcatgtgagacaga

SEQ ID NO: 602977 - DNA, 203 bp, Homo sapiens
actagctgccatgttctgctgcctagtacatgtgtgacagtcctgaacaagtgaagaaacatgtgtctatattaatgtgctataattacacatggacaaggttaaatccccatactagaaaccactttcctaaattccccaagccctaccgcaatccctcctaaaagtctgcaataatccgcaaccacagatcacccttcgtg

SEQ ID NO: 602978 - DNA, 406 bp, Homo sapiens
tgtcgcacagccctccacacgcacatgtgcatcattcgccagatggcagcataaggggcagggaattcaggtcagcatgtggtcatgcagggtggggccaccatgcatgggattagagcctttataagcaagcacaactcgggatgcttgcatgccctctgccctctctccactcacatgcatgtggaaaggcatgtgagcacacagcccgaagggcagctcccaggcaaccagcaggagaggccctcccccagacactgatcctgctaacaactatgatctgggacttcaagtctccagaagtaaatacctgtagtatgacgccagccagagtatggtatttaactgtggcagcccacgctatgacaatacttaaattttgtcatcgtcttaggcctaccactcc

SEQ ID NO: 602979 - DNA, 862 bp, Homo sapiens
ggtccacaaggacaaggatctttgttttattcacggctttatccctaaggcctaaaacaggacctggcacatagtaggtatacaaaaagtatatttgcagaccgaatgaacgggatgtccctgggggtttaggactcagaaaaaagacctagttcagtcatcccagtccaaacaaacttcccgagggttggctggatgcccagccttgtgctagggcttcaggggtggtgggagaagatgggagttgcctcgattttcagacctgtttcctcatttcaaagatggggaaagagacagccctatcccacagtggtctggggaggacccagtgagatagtggtggcaaagcctacccccaaattaatcgtacatttgaggcaaagatgactttctgaggcaggaggatggcttgagcccaggagtaagagaccagtctgggcaacatagtgagacctcgcctctacaaaactacccaaaacacaacaacaaacaaactagctgggcatggtgttggaacatgcctatagtcctggctacttgctgacaggccacgaggatccacttgaagctcaggaagatgggggcttgcaatgagctatgactgtgcccctgcaactcccagcctgggtgacagagcaagaaccctgtctctacaatactcaatctacataccctgataatatccagtgtaaggattcaccactccaaggaaggtctgtaagagaatctggaggtgcctccattccacgtcaactgcccccacatctgcaactatgtcaaattctgcattcctcacacaagcaaaatcctacggtcttcaaggtgcacaacgtcccatgcacagtgctactgcttgtcaccg

SEQ ID NO: 602980 - DNA, 871 bp, Homo sapiens
gttattctcagatgcttgatgcactgttggaaatgtgattaatttaatcatgcagataaaccatttaaatgtcaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaagaaaaagagagagagagaggggggggaggagaaaaatatatgaaagagagagagcgacggagagtagtgtggtcttaatcactacctgcagtcagttgttgtatgtggatggaacgagagcggcggcgcccgatttaatggtggaggattatatatatatatacaaagcgcaggagagcagtaaacagtagatagtaataatacaaaaaaagaatagaaagccggagaccagcgggagacagaagagagaacaaccgaaaagagaagaggagaaccaaaacgacagagagcggggggagaagagcaaaaaggagggagagaagaagcaaaacaaaaaaaaaaaaaaaacagaaagcaagggaagaaggaggagtaaaatatacaacatcacccaggagacggaataagggaggagggggagaaacaacgagtaagcaaaagaagaggagagagagggggagaaggagagaaaagagaagaagcgagaagcgcgcggtgaggaagtctaagatgtaatcatcgagcaacaaaataactatataaaatacaaaggaagataggaggacgaaccaaatacaaaacaaaaaaaaaaaaaaacaccatgaacacaaacccaagaacgagaaacaaaaagactaaaaagaaaaaacaaatcacaaccaaccaaagacaaacacagcacagcggaccacaaacaacccca

SEQ ID NO: 602981 - DNA, 308 bp, Homo sapiens
cattataagatataactacataaacacgcatatatgtgcacataaagacagcagtattccttcttaaccaatctagacgcctaacctactaaaagttgatatctttatattcttcctctctctctttttatctcttactttcatcctttttcttttacaccttatttccctggctgaaacttccaataaaatgtatcaaaatattcagcacctataaaacttacaaaagataatacatgataaaatctacatgaccttggacttcgtgatgaatttttaaatacaacatcgaaagcatgatccataaa

SEQ ID NO: 602982 - DNA, 164 bp, Homo sapiens
  misc_feature (25)..(25): n is a, c, g, or t
  misc_feature (82)..(82): n is a, c, g, or t
  misc_feature (87)..(89): n is a, c, g, or t
  misc_feature (93)..(93): n is a, c, g, or t
  misc_feature (96)..(97): n is a, c, g, or t
tcgtagaaggcaagtcagccaaganaagtgctttcccacattccttacattcatatggcttctctccagagtgaatccatangaatnnnaggnatnnggaaaagcattctcttggctcacttgcccggaattccagcttagcgtcgcccgctaccattaccagt

SEQ ID NO: 602983 - DNA, 637 bp, Homo sapiens
atttttctcccgtgaaaaaaagacttataaacaaagaagaagaggaaaacaacaagcggaaacaaaaaaaaaaacaagccatccgacaaagatcaaaacaactataaagctacgacagattgacgactaggagcccatgtggggccgctttgcccagttgctcctaaagtgggccgcttttctagctgcggccccatgtcgtccaacttggccaatggggcccctatgggggtccctaccctgaccgggtggccggtttaccccctttcgccggggggagccctggggttccgccccttaaggtgcgcgctgccaaacccccttttacccggaggggtgattgtgaaatgcacccgcccatattgcttttcacaacgggtgacccccgtggtgggcaaggcggattttaacctgtaaactgctgtgaaaaccaggttaaatatcggttacccccttttagcccagagggcggcccgctgaaacccgttaccatatacattcgcgcggtcagggtcaagggtggccacctggtgcccagggccaagttccaaggcggggcctcccccgccgttttgggttggcgccactggactcttggggcccttagggaccccgtttgggctttcctgggcccgcc

SEQ ID NO: 602984 - DNA, 421 bp, Homo sapiens
  misc_feature (221)..(221): n is a, c, g, or t
  misc_feature (224)..(224): n is a, c, g, or t
  misc_feature (240)..(240): n is a, c, g, or t
  misc_feature (258)..(258): n is a, c, g, or t
  misc_feature (276)..(276): n is a, c, g, or t
  misc_feature (279)..(279): n is a, c, g, or t
  misc_feature (283)..(283): n is a, c, g, or t
  misc_feature (293)..(293): n is a, c, g, or t
  misc_feature (295)..(295): n is a, c, g, or t
  misc_feature (330)..(330): n is a, c, g, or t
ggaaaacaaagttgcaggactaacacagcctgatttaaagcctgcagacagtgtggtgttggtgtcagtattgaggtttacatcttcatgttatgcaatgaaattgtgtcagttaggttttgctgtgtaacaaactttcccacaacttaatagcttaacaaagtgttaatcaattaatttgcccagagttctgcgggtcaagaattttggggaatggtttnagncttggccgaatttgcngagcctcagtggttctanggataacctcactctaangtntggnagttggaagntnagttgatctgggggctcagctggaagcaggttcanctgtattccacttggctctcgtccttcacactttcttccacaccagtaagtgtcggggttccagagagtagcaagagagggcaagcctcag

SEQ ID NO: 602985 - DNA, 580 bp, Homo sapiens
  misc_feature (194)..(194): n is a, c, g, or t
  misc_feature (215)..(215): n is a, c, g, or t
  misc_feature (217)..(217): n is a, c, g, or t
  misc_feature (231)..(231): n is a, c, g, or t
  misc_feature (234)..(234): n is a, c, g, or t
  misc_feature (242)..(242): n is a, c, g, or t
  misc_feature (245)..(245): n is a, c, g, or t
  misc_feature (253)..(253): n is a, c, g, or t
  misc_feature (260)..(260): n is a, c, g, or t
  misc_feature (288)..(288): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (301)..(301): n is a, c, g, or t
  misc_feature (307)..(307): n is a, c, g, or t
  misc_feature (318)..(318): n is a, c, g, or t
  misc_feature (404)..(405): n is a, c, g, or t
  misc_feature (409)..(409): n is a, c, g, or t
  misc_feature (427)..(427): n is a, c, g, or t
  misc_feature (439)..(439): n is a, c, g, or t
  misc_feature (447)..(447): n is a, c, g, or t
  misc_feature (459)..(459): n is a, c, g, or t
  misc_feature (462)..(462): n is a, c, g, or t
  misc_feature (464)..(464): n is a, c, g, or t
  misc_feature (475)..(476): n is a, c, g, or t
  misc_feature (578)..(579): n is a, c, g, or t
gctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcnccaggaagttgagttttcaanangccttgttgctttnaanaagggagngangtcaattntcttgtnacattctccctttagcaacctgagtaananactntntgccnctgggntgcaaaaaaanaaattacttgaatctccccttggcccaggctgaggtaccccttttttttaaaaaaaaaaatttttccccccccctttttgtttggnntttnccccccctttaaaatttnaaaccccacttntacttggncactttgctttnttngntaatggaacanncagtagcatgttaaaagggatttcatgtttttgtttttttaaagttaaaaattacatgatgcagagattcaggttttcctttaaataaacaaaacagcccanna

SEQ ID NO: 602986 - DNA, 1426 bp, Homo sapiens
gacagacgctgcccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacggcgacggcgacggcgaaatcagcttccaggagttcctgacggcggcaaggaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgcctccagaccttgggcagaaggaggcctccttgggcctggtccccctttgccctgcagtggaatgagggcccctcagccccgcattgatctaaataaaggactgccgagttcaaaaaaaaaaaaaaaaaaaaaaaaaaaaaaaaaaaaaaagagagggggcgggccgccgcagaaaatttctcccgcggagggggcccacaaattaggaggcgctcaccccgttttgctggtgcgaacaagagggtggccccctaagaggggggagccgcttaattataaaagcgcattgaggagcggtgggcgcggggtttttataaacaaggtgtcggttaggtgggaaaaagcgtggcgataagcgtgggagaatttttgggggaggaggggaacacctctttatcttgcgggggggggggggagaaatatatgtgtggggacaaaatacaccccagagagagagatttttttaaagagctctttaagagggggaaacaaatataataagccgatttttaaaagggggtgcatcaagagggtgggttaacacactaggcgcggattatatgtgcggcgcggtgggcgtcaggaaaagaattgtgtggactcacagggggggggtgtgcatgatttggtggaagacatttttttatacccgggggggatctgtgtttaaatatact

SEQ ID NO: 602987 - DNA, 517 bp, Homo sapiens
  misc_feature (194)..(194): n is a, c, g, or t
  misc_feature (215)..(215): n is a, c, g, or t
  misc_feature (217)..(217): n is a, c, g, or t
  misc_feature (231)..(231): n is a, c, g, or t
  misc_feature (234)..(234): n is a, c, g, or t
  misc_feature (242)..(242): n is a, c, g, or t
  misc_feature (245)..(245): n is a, c, g, or t
  misc_feature (253)..(253): n is a, c, g, or t
  misc_feature (260)..(260): n is a, c, g, or t
  misc_feature (288)..(288): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (301)..(301): n is a, c, g, or t
  misc_feature (307)..(307): n is a, c, g, or t
  misc_feature (318)..(318): n is a, c, g, or t
  misc_feature (376)..(376): n is a, c, g, or t
  misc_feature (384)..(384): n is a, c, g, or t
  misc_feature (396)..(396): n is a, c, g, or t
  misc_feature (399)..(399): n is a, c, g, or t
  misc_feature (401)..(401): n is a, c, g, or t
  misc_feature (412)..(413): n is a, c, g, or t
  misc_feature (515)..(516): n is a, c, g, or t
gctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcnccaggaagttgagttttcaanangccttgttgctttnaanaagggagngangtcaattntcttgtnacattctccctttagcaacctgagtaananactntntgccnctgggntgcaaaaaaanaaattacttgaatctccccttggcccagggtaagggactatcttgtcccaaacacttntacttggncactttgctttnttngntaatggaacanncagtagcatgttaaaagggatttcatgtttttgtttttttaaagttaaaaattacatgatgcagagattcaggttttcctttaaataaacaaaacagcccanna

SEQ ID NO: 602988 - DNA, 860 bp, Homo sapiens
gacagacgctgcccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacggcgacggcgacggcgaaatcagcttccaggagttcctgacggcggcaaggaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgcctccagaccttgggcagaaggaggcctccttgggcctggtccccctttgccctgcagtggaatgagggcccctcagccccgcattgatctaaataaaggactgccgagttc

SEQ ID NO: 602989 - DNA, 729 bp, Homo sapiens
  misc_feature (45)..(45): n is a, c, g, or t
acatacaacaccaacctgacaagcacacaaaacaaacggaagggncagagagctagaatacacaaacaaaatacaccacaaaaaacaacacaaatccagacactgaccaacagtgcctcggctccagcgccatggcgccctccaggaagatcttcgatgggggaaactggaagatgaacgggcggaagcagagactgggggagctcatcggcactctgaacgcggccaaggagccggccgacaccgaggaggaaagagctccccctacagcctatatcgacttcgcccggcagaagctagatcccaagaatgctgaggatgcgcagaactgctacaaagagactaatggggctattactggggagatcagccctggcatgatcaaagactgcggagccaagtgggaggtcctggggcactcagagagaaggcatgtcataggggagtcagatgagctgattgggcagaaagaggcccaagctcaggcagagggactcggaagaaacgactgcataggggagaagctagatgaaagggaagctggcatcactgagaaggtggatatcgagcagacaaaggcaatcgcagataacggggaaggactggagcaaggtcgaccaggccaaagagcctgagaggaccataggaaccggcaagactgcaacacccaggaccaggaagaacaccagaagctccgaggaaggatgaaacccgttcattgacgggggc

SEQ ID NO: 602990 - DNA, 831 bp, Homo sapiens
  misc_feature (36)..(36): n is a, c, g, or t
  misc_feature (38)..(38): n is a, c, g, or t
  misc_feature (47)..(47): n is a, c, g, or t
acgcaaccgcgccgcccccctttgaaaaccaatagnanaggcagagngctattgcgccgagacccgggaatccggccattacgagcgggaggaatgcacaagaccatttcagctcacgactccagcaatataacaacacggggacacaacccctactccaaggccacgggccgaacacaagaagttcaacggacagagcaaaacgcactatcacaacaccgacctccaagaaaaataaccgaggccactatcacagctaaggacagtcagcaaaacagcgcagaacaaacacggctcatatcaagcactaaggcccatagcgaaggctaccacagagaagaacaaccgaacaagaccaaaagcccacacgccgcagggcaggcacacgcggctcgacgcacagaaagccggagaaacactgggagcggcgaggacgggctcacaatagaggacacgaagaccgagaggatcagaggacaacacagaccaaaaccggcgcgatacaaaaagacacaaaactaggctggaaacgaaggagcgccggcagcaaacccaggcaaccaaggaaggcgacggcagaacaaacacctggaaccaaggcaaccaagagaacaaggcgaaggcgaaaaacacgctaccggacccgccgaccagacgcaccgcgcaacgaacattaaaaacgacaaaaacccacacgacccacaacacaagcgactaaggaacacacatcagggcaaacggacaccgtcgaaagcagcaaactctaagcaaggaggcacgaagctgtagcacaaacaggcacaaacacaccacgggacgatagcgacgccg

SEQ ID NO: 602991 - DNA, 452 bp, Homo sapiens
gttggaaactattattctaagtgaagtaactcaggattggaaagccaaatatctcatgttcttataaatgggaactaagctatgagaatgcaaaggcagaagaatgatataatgcactctggggactcaggaggaagggtgggagggtggtgagagataaaagactgcacattgggtacagtgtacactgctcgggtgatgggtacaccaaaatctcagacatcaccactaaagaacttatccatgtaaccaaaaaccacctgttcccccaaaactattgaaatctaaaaatcagagaaacaataacaacaaacatggtgtgtgcctttgaagaccagatcagaaaaggcatagcagttcctttttttctttggaggaaacaagctgccatgtcaggaggacactcaagcagcctttggaaagctcatatggcacgaaactgaggcttcctg

SEQ ID NO: 602992 - DNA, 289 bp, Homo sapiens
atgactgagttccataacccggacctaatatatggatcactgctgtgtatcgatcatgaaaaagtctgcgcgcgtagtcgagtatcagcgctgttaaacttgcagcatggtagcttatgttctaaaggtaccggtgtgtacgttgaaccgtcctacgtatactccggaatattcaataggcctaggttgcatatgggggccggctgcagctggcgccatcgatacgcgtacgtcgcgaccgcggacatgtacagagctcgagaagtactagtggccacgtgggccgtgc

SEQ ID NO: 602993 - DNA, 345 bp, Homo sapiens
aggatcccggctatcacattatcccaagaagctataccagtaggacaggcaggaaaatactacacttttcaggatcaagcccttctgactctcatttggaaaactgcatgtttggtaagcacctgcttctttaaggattgcgaagggatttaaatgatactccccagaaaccttggagagattaaatgggggcctattggagaaggtgctcttgaacttcaggtggttggggacttggaataaaaatttaaccattgtcattgtttttcagaaacaactaaagctgttttactattttcatgttgcatggaaagcccctagaaactaaggttgtggtttaatttc

SEQ ID NO: 602994 - DNA, 325 bp, Homo sapiens
gataccacttcacatccattaggatggcagttatcacaaaagcaaattataaatgtcaaagatgtggagacattggcacccctatgcattgtttgtgggaatgtaaaatgttgacaacagtgtggcagatcctcacaatattaaacatacagttaccatatggcctagcaattctgcttctaggtagattcccaaaagacagcagaactagaataggtatttgtacaacagtgttcacagctgcattattcacaatagccaaaaggtggatgtcacacagtgtccatcgatggatgattagataaacacaatctgtatatacatg

SEQ ID NO: 602995 - DNA, 294 bp, Homo sapiens
ttcgggtgtgccgtccgtgcgcggacgcgttgcaacgatccggcgcgcgctctttcgctgaccgctcttgagtggcgattgacggtgcttgttcctgaactcgatatcggtactcatcgtcatgctcattcccatctggtctgtggtttgcgtggcttttgcttgcttcgaacttccatcgtggagatctgtagactcagctactcgggaggctgaggcgggaggattgcttgagcccaggaggtcgaggctgcagtgagctgcaactgtgtcactgcactccagcctgggtga

SEQ ID NO: 602996 - DNA, 344 bp, Homo sapiens
taatctcatctcaggttttgatgtccctgagggctcggacaaggtggctgaagatgagtttgaccctattcctgtattgataaccaaaaacccacaaggtgggcactctagaaacagcagtgggagctctgagtccagtcttcccaacctagccaggtctttactgctggtggatcagctcatagacctgtagccgtgacccagtagcagatgcagttctgtaaccttcataccgtaaaatacattttcattacggagttatgaaaaaaatgatttttttaaaaaaatctgcaaataaggggccctccagcccttttctcctaccccttgccttctcctgtaga

SEQ ID NO: 602997 - DNA, 811 bp, Homo sapiens
ccgtgttgccttgtcgtggcgtgtggcctttggccgacaagcggccacggaggggcggtgtctgtccagaggagggcgcttgcgcgttcccggggagtttcgcaaggcgggggaagatgcccgggcggaaaatccgccttgcctgtggggcctttaccttgtgggtgtgtgcgcgccagcgcccgtctggggttaagcccttgctcgttgaagttccacgttatagaataacttgagagcggagtctcccaccggtgctgcggggagggcacatttgtgtgggggccacatgggaacccacatgtgcgggggggtttccacaggggtcacacacacgccaaccaattggatcacggagccgaaaagtagcacgcacacacacggttgtgctttttttgttgcacaataaccttgaaaataagttgccccactgtgcttggaacttagaagagagaaaatccccgctgaactttttcctcactcaccccctgagtggctttaatctaaccctctgttggggcactgtttgtatttaattgcttcactggccgaactggaatcctgaagtcctgggaaactggcaaacttacggggattttgccccgtgtcctgggccttcttgcttccgttccggccgcaagtgcgtgtggtcacacaacaggtcctgggcgcgctcaaatgctgcccctggttgaaagttcttcttgataatgctggaccccttgtctattttaaagcgaattttgtgtgatttcctagccctttgcgttatattgtataaaaacccactgaaggaaatgaacctttggat

SEQ ID NO: 602998 - DNA, 864 bp, Homo sapiens
ccggttggtgttcgcccccttttggagtggatttcggaccgttattccctctgttggggcgaccctccccgccttctctcggttctggcatccgagccgcttgtgcccgtgaacgcaacccacccgggggcccacgggggatgttcccgaatggccagcttaaaatgggttcacctgtggggggaaactcttcaggccccctggaagtggaggagccgcctggtccgtcttcacgccggcctttttttcggcgacacccggtccctggctgctctgcggtcccccttcgcacagggttgtccgtcttcgacgatgtaaacccccggcgcgtcgtcccaggcgcccatcttccccgggcgtacccttatgtttcgcacgaactaaagccctgtgtttataattcaaggttatatgccagatggctgtccacgtgtgccccaatatcgttgagtcctatgacgtggtaatttgaagactgtgttgttagctccacgtaagagtgaacaaacctgtgttccccggggtggtcacacgcctccaccatagccctcggttgagggtggtgatatgcccgcgtcaaggaatttaataccaacttacaatgtcgcctattggtgtgttaaagctgtcataccatgtaaggtcagattccctttaggaatactgggtgctgtcacccacggtttgatagttagactttaacaacttgaaattcactttttggggggagggatatactgaaatagagagttgagaattccccattgggggaaaatagcatttcaaatgggaaactgtgtttgggaaattgggtatgagtatttttgtatttaaaacctttttaaggcttttttttttacttta

SEQ ID NO: 602999 - DNA, 222 bp, Homo sapiens
ccaatggcaggagagcaccatttatggctctctgatctaagacataaaagttgctaatgcagcatttggaatcccaataccgcaaagtcagcaccccgtcacatctacagagtgatgcattttaaaaaagaccccactgcagagacaaccttcgctcagacaatttcacatggccaagtataaactcagatccttctcactggtttatttaaaaggaattgc

SEQ ID NO: 603000 - DNA, 515 bp, Homo sapiens
cgagaactgacattagtcactggcaagagggactgaaaatttaggcagatagccaccttccaattttatttccaaatctggttctatcttgaaacagcaatgaattctgctggattaaaatgaacatatttcagaccaggcgcggtggctcacgcctgtaatcccagcactttgggaggccaaggcgggcagatcacttgaggtcaggagttcaagatcagcctggccaacatggtgaaacctcatctctactaaaaatacaaaaattagccaggcgtggtggcatgtgcctgtaatcccagctactagggaagcaggggaatcacttgaactcaggaggcggaggatgcagtgagccaagatcgcaccactgcactccagactgggcggcaagagcgaaactctgtctcaaaaaaaaaaaagaaggagcaacatttttattaagataaatcttgatggccaggtgtggtgcctcatgcccgtaatcatcccagcacttgggcaggccgatgcag

SEQ ID NO: 603001 - DNA, 257 bp, Homo sapiens
  misc_feature (34)..(34): n is a, c, g, or t
  misc_feature (47)..(47): n is a, c, g, or t
gaccacactaattattatgcaaagctctggtgtntgggttccaaccnattggtcaacagctgtaataacgactgagtctgtagcgccgagtgaagcggggtgcctgacgtagagaggggggaggccagctgggtcgagggtcagtggtgcagtgattggtacatgccttaggcactccgttgcagatagcggcttgtggctgaacgggaggagtggcggttgtgcacaggggtacccgacgctcagaacttcgttga

SEQ ID NO: 603002 - DNA, 351 bp, Homo sapiens
tagggggagttcactcttcaggggtagggattttgtgtgggcatagggaggttaaggttgaggattattttgtagttaagcaagggagggttttgggggtggatgtcacattaagggattgtaggtatagattagttggggtgaacgggccacaggcggcggcagacagaagggagatggtggactgtctgacgcccctgtgtgccacaaataggcagttggtgatagggggggattttaatatagatttggggatagggggggatagcagtgcaggcgccatcaccgggctaatggcttgccatggtctgggtcgacgcggccgcgaatttagtagtagtaggcggccgc

SEQ ID NO: 603003 - DNA, 107 bp, Homo sapiens
tacatcatatgtaatcccgcttttctaatttacaaccagttcaagaattacaatatccaaagaaagtatttgtagaatatatatgctcactggtcaggtgatatttc

SEQ ID NO: 603004 - DNA, 134 bp, Homo sapiens
gctacagaggacagatcatacactaagcgtgatgatgacgctccaggatgctgtattactcacttctgcaaggtctatgagagaggagagtacttctgggaggtacgagcggtgcatggagaggggctctcaaa

SEQ ID NO: 603005 - DNA, 606 bp, Homo sapiens
gggacgtatgtagtcgtcgggccgggtgctgacgccttgccttctctttacttctccactctaggccacgtatgccgtagtagcattacctgggaggagtgcagaccaggctggcgaaaagctttaactcgcctgaacctatgaaggcacgtgtggtgctcagatatatatggcaggctgatgggaacttgtgtgttaaaggtaacagatgatttagttagacagtgtcttgctctatagctcaggctgcaggtgccgggggctgatcatagctcactgctatcctcaaagctcactgggctcaatgcggtcctcttgcttcagcctcctgaatagcagagactacagtgtttggtgtatacaacagaccacacctcaagatgtagagaagattgcgacattccatcatgtcaaggctaatgcgagttatggtagccaaggatgcccgcgagtgttaccatggaaactgagtgaagtggtttgaaatgcagactttgtcgtgtacttaggaagtaaatatctttcgatttcgagaaagtgttgggacagagagtactttatgtaactaacgtgggctgttcagaagcttagaggtcattgtgtgat

SEQ ID NO: 603006 - DNA, 375 bp, Homo sapiens
  misc_feature (223)..(223): n is a, c, g, or t
tttttggtcccgttccgtttccttcagggtccactgaggaagtgttccccagtgggccccagcagccccctcccctcccccaaaaaaaaatagtgagccgggcagccttttccccggatgggtttttttggacccaagggtcccccaaggccgggacagcaagcccccaggtgaacctaagcccctcgggaaacaaagtccacacttgttttcctttttggantaaggcccccctggttttttttggaattaaacccatttccagttccatgcaacgtcctgagggcagttttgtgaactgaatgcagcctgggccctggccccaaaaccctgtttaggattttttcccccctttggccaattgttttttaaaga

SEQ ID NO: 603007 - DNA, 533 bp, Homo sapiens
  misc_feature (12)..(12): n is a, c, g, or t
  misc_feature (44)..(44): n is a, c, g, or t
  misc_feature (105)..(105): n is a, c, g, or t
  misc_feature (139)..(139): n is a, c, g, or t
tattccattgtnccacaaatacaaggtcttcaggctactatgancaccattatgtacataaattgaaacctggggagacggataaattcctggaatacacaaccntcctagattaaaccggaagattagaaactctaanagaccaataacagcagtgagattgaaatggtaatttaaagttaccaacaaaaaaaagtccaggaccagtcaattcacagctgaattctataagacattcaaagaagaattggtaccaatcctactgacagtattccaaaagatagaggaagaggaaatcctcactaaatctctctatgaagccaatatcacccaaataccaaaaccaggaaaggacacgacaaaaaaggaaagctacaggccaatatccctaatgcacatagatgcaaaatcttcaagtagctaacagaatccaacagcatatcaaaaagataatacaccatgatcaagtgggtttcataccagggatgcagggatggtttaatatccacaagtcaataaatgacacaccatat

SEQ ID NO: 603008 - DNA, 360 bp, Homo sapiens
  misc_feature (18)..(18): n is a, c, g, or t
gtcgaccccagaccaagnatgctgaactagagaaggatgctcagaacagattggcacccattgggagtgagtgtcttggaagaagagtgggctgtgtctaaaatgcaatggtactaaagtaacaggaggacaaaatgccagaaaagtggtgtctcctgtcttggggacaagagagcaacatctgtaatagtatgttgtattcaagcctagtaacaagcagtactgaccttgtgtacataataagcaggatatgtggggtttgcccaaaaccaggcatttttagacatacgggtttcaggagttgaccctaccagacctaagcaggtgctttctgggctggagcttgtcgacgcggccgcg

SEQ ID NO: 603009 - DNA, 531 bp, Homo sapiens
  misc_feature (18)..(18): n is a, c, g, or t
gtcgaccccagaccaagnatgctgaactagagaaggatgctcagaacagattggcacccattgggagtgagtgtcttggaagaagagtgggctgtgtctaaaatgcaatggtactaaagtaacaggaggacaaaatgccagaaaagtggtgtctcctgtcttggggacaagagagcaacatctgtaatagtatgttgtattcaagcctagtaacaagcagtactgaccttgtgtacataataagcaggatatgtggggtttgcccaaaaccaggcatttttagacatacgggtttcaggagttgaccctaccagacctaagcaggtgctttctgggaggaaatgggaaccagggataggcactcaagcccttctttcttggcattaggctcatatactcatgttaataaggccagttctgacattacaggcatgaaacattctagtagatacaagtgagcatttctatcccagcaacctgatgggcagtatctgttctgagccttccagatatggacccccaggaccttta

SEQ ID NO: 603010 - DNA, 200 bp, Homo sapiens
tgtctcagtttcgggacggagtgtgtgctctggaaagagcagttacagtgtcagggctgtcatcacaggacagcctttcagctctttgaaaactgcatcctgctacattttctcctcttcagcctggttaccaccgggtcccttgactcattcatttgctcatatattcattcagctggtccataaagacctgccaggca

SEQ ID NO: 603011 - DNA, 486 bp, Homo sapiens
  misc_feature (283)..(283): n is a, c, g, or t
aaaaaaaaaaaaaaaaaaaaaaaaataaaaaaaaaaaaaaaggggggggcgtgcgaattaaaaataaaattttccctgggggggcccagtttggggttccggtttttttgaaagagggggccctaatagggggtgtttttataagtaggggggggcggggttaaaaagggggaatggtgggaaaaagctgggcagacgtggggaattttgtgtggagagaaaccaataactgtgtggtgggtgctgacaataattggttggcaccaacatataccctacagangagatatttagaagcagcctcttaggcggataacacttactatacaattatttcacggtgttgttatctagctgtggtggtctaaaacacagagcggtgatattatgtgcactggccggcatggacaaagagttatgtggatatacacggagagtatagtgatgttgatgggcataaattttttttatattcacaccgagtga

SEQ ID NO: 603012 - DNA, 371 bp, Homo sapiens
taagctcggctaccgcttccgtgagactcacatctgatctcccagtctcccagccacgttttttttcttttctttatggccgcacccactgcacccaggacatatgaatcccagacacagctacggagcaacgatgcagctgctgaggcaacactggatcctttaacccactgctcaggtggggaatcgagccagcacctccgtgagactcacatcctgattaccatagccttgtaatattgcatgaagtctgggagagttatgcctcctgcttggtttttgttcctcaggattgctttggcaattctgggtcttttatgaatccatatatatttttgggttatttgttctagttctgtgaaaaatatcat

SEQ ID NO: 603013 - DNA, 1850 bp, Homo sapiens
ggtctttcccactcttgcaagaactggcgggggtgaaaacacacgccttgagcaacgcccagaactacctaacacgacgaacgaacaccccgacacgcccaaagcaacaggcttgcactgcctgcgctggcacacggcctgaacacaaagcggctaaccctttcaacacgcctaacacaacgccccaaagcacaggggcgacagacccacaactctgtcacggcccgccaaaaccccctgccttccctttagcttccacggcacgcgcaaaactttggcgcccacgcggctaaatttcccccgggacttccttggccccacttgattacttctccccacggcacacaaggcgcccccaaatggcttacccacacggcaagggcacaaggcttaacccttcccatgtccccggcctcttaataacaccttcccccagacgcggcctctggcaacacacaaggcaccacatcacacggccaaaaggcgcaaggcaacaacgccggtcctccctctccggccctaaatccctttggccttttaaaccaaaaacaacacccccccaaaggtcttcctggcgccctggcgaccttcgaaacccacaaacgcaacaaccccgccggccccggcggccttcaaccccccccggaggagcgccttgcgggcctcttaacaaacaattccctttattcccggcacccaacaacaaccacgcttggtccccccactaaaggcgcaaccttcaacgttctcaactttcccccgttaagagcgctttgtcaatcatggcaaccttggggcttggcccccccatttccgggcgacactaccatacgaccccattgcgcccttctggcaacgctccccctaatccggcggcccctccatcactcacacatagcgatcgcgcgtcccttattccagggggcttcccaaactgtgtctacaccgggcttagggaacgggaataccactaatccgtttagggtccaggaaactggcccacctaaggggccccaactttttgcaaccccaccaacatcctcgggaggagggaaagcgcccaaagtttcataccctttcggaaagctatcccgacactttccccccttttcctatccccctttggcgggctacccccgcgccccctaattctcaatcgggcggcgccgggtccctactaccgcggaaacgggggggagggttttggggcctatcatacctcctcccctccctttggcgcaacaccctcccccatacgcgccctatcgtgctcggccccttcaccggtcgctgtgcggcgcgccctttcctaccctttctctaacccgctttcttgtgcatctgcgaatagcacccctggcgcgagcaacaccccccctatatcccgattggctcgcgtttccccccgtgtgtcgcgtaacacacacattactcaccgaaccgtagtgtctttctcccccccgcttccgcattatgacgccgcgctaaaaccacctgacctaacaaaacccgcaactccatcagctcccgcccacacgtgatcaacgacacgcacgctcttctccctacggcgtcttccaccacaatttactgtgagggacctccccatacacaccgattcctcacccatcagatcccgcctccgaacactaccaagcacacgctcatcacgagcaacacacctcttagaattctctccgcaaagggcccccaaacaacacactcttgggacttcaccgaccacacgactacacaatctttctccacccccctcataacacatgtcaaccacacacccacaccttctccatccatcacttcagcagctctttgggacaaacctctgtggc

SEQ ID NO: 603014 - DNA, 1038 bp, Homo sapiens
  misc_feature (4)..(4): n is a, c, g, or t
  misc_feature (9)..(9): n is a, c, g, or t
  misc_feature (12)..(12): n is a, c, g, or t
  misc_feature (23)..(24): n is a, c, g, or t
  misc_feature (29)..(29): n is a, c, g, or t
  misc_feature (31)..(32): n is a, c, g, or t
  misc_feature (35)..(35): n is a, c, g, or t
  misc_feature (37)..(37): n is a, c, g, or t
  misc_feature (43)..(43): n is a, c, g, or t
  misc_feature (45)..(45): n is a, c, g, or t
  misc_feature (53)..(54): n is a, c, g, or t
  misc_feature (56)..(58): n is a, c, g, or t
  misc_feature (63)..(63): n is a, c, g, or t
  misc_feature (73)..(75): n is a, c, g, or t
  misc_feature (79)..(79): n is a, c, g, or t
  misc_feature (81)..(81): n is a, c, g, or t
  misc_feature (85)..(86): n is a, c, g, or t
  misc_feature (89)..(90): n is a, c, g, or t
  misc_feature (94)..(94): n is a, c, g, or t
  misc_feature (98)..(98): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (131)..(131): n is a, c, g, or t
  misc_feature (144)..(144): n is a, c, g, or t
  misc_feature (148)..(149): n is a, c, g, or t
  misc_feature (151)..(151): n is a, c, g, or t
  misc_feature (153)..(153): n is a, c, g, or t
  misc_feature (160)..(160): n is a, c, g, or t
  misc_feature (168)..(168): n is a, c, g, or t
  misc_feature (173)..(174): n is a, c, g, or t
  misc_feature (177)..(179): n is a, c, g, or t
  misc_feature (181)..(181): n is a, c, g, or t
  misc_feature (184)..(185): n is a, c, g, or t
  misc_feature (187)..(188): n is a, c, g, or t
  misc_feature (190)..(190): n is a, c, g, or t
  misc_feature (196)..(196): n is a, c, g, or t
  misc_feature (202)..(203): n is a, c, g, or t
  misc_feature (205)..(205): n is a, c, g, or t
  misc_feature (209)..(210): n is a, c, g, or t
  misc_feature (213)..(214): n is a, c, g, or t
  misc_feature (216)..(216): n is a, c, g, or t
  misc_feature (218)..(219): n is a, c, g, or t
  misc_feature (225)..(225): n is a, c, g, or t
  misc_feature (230)..(234): n is a, c, g, or t
  misc_feature (249)..(249): n is a, c, g, or t
  misc_feature (255)..(255): n is a, c, g, or t
  misc_feature (278)..(278): n is a, c, g, or t
  misc_feature (286)..(286): n is a, c, g, or t
  misc_feature (308)..(308): n is a, c, g, or t
  misc_feature (314)..(314): n is a, c, g, or t
  misc_feature (328)..(328): n is a, c, g, or t
  misc_feature (332)..(332): n is a, c, g, or t
  misc_feature (344)..(344): n is a, c, g, or t
  misc_feature (348)..(348): n is a, c, g, or t
  misc_feature (353)..(353): n is a, c, g, or t
  misc_feature (374)..(374): n is a, c, g, or t
  misc_feature (510)..(510): n is a, c, g, or t
  misc_feature (513)..(513): n is a, c, g, or t
  misc_feature (540)..(540): n is a, c, g, or t
  misc_feature (550)..(550): n is a, c, g, or t
  misc_feature (559)..(559): n is a, c, g, or t
  misc_feature (593)..(593): n is a, c, g, or t
  misc_feature (605)..(605): n is a, c, g, or t
  misc_feature (738)..(738): n is a, c, g, or t
  misc_feature (877)..(877): n is a, c, g, or t
  misc_feature (951)..(951): n is a, c, g, or t
atgnttganccngatgacccaanntgcangnnatncnatccantntccctgtnncnnnatgcncaccccgcannntggngnttgnnggnntacnttgnagccatccntncngaganggntggancgctgtngcctggcctgccntcgnngncnccccgangccccacnccatnnaannncntgnngnnanaatcanggaggnntngctnnggnncncnntctggnatgcnnnnngcggttatcagtttncagcgnacagctcaaatctactaaaaagncccccaanaaagcgattgagaaaatagaancatctnctgaacagcaagtngcantttaacgccttnaggnttccngctccggctcagattccagcncctcctctacctcgtcgtcgtcttcaaacaccagtaaatacaaactcaggctaaggggtcaggccagatggcgcaggaagctccacaggaccggacccctagaccaccctacccccccagccccttccccctttgnttntaaacttcttcttatcccccccccccncccccctctnggagagctngctctgcagtgggaggagggatgcagggacattnactgaagaaggnacatggacaaaaccacattgaattcccagccccattggggagtgatctcttggacacagagcccccattcaaaatggggcagggcaagggtgggagtgtgcaaagccctgatctggagttacctgaggccacngctgccctatttacttcttagggccctgttttgagattgtttgttctaatttattttaagctaggtaaggctggggggagggtggggccgtggtcccctcagcctccatggggagggaagaagggggagctcttttttnacgttgatttttttttttctactctgttttccctttttccttccgctccatttggggccctgggggtttcagtnatctccccatttggtcccctggactgtctttgttgattctaacttgtaaataaagaaaatattattcaagaaatggaaaaagaaacc

SEQ ID NO: 603015 - DNA, 625 bp, Homo sapiens
ctaaaacagaggcctgcgctgttctggctgggatgagggcagggaaggtcgaggtggctgaggtctgggggtggtgagtcagggtgggggctcgtgtaattcttctggggtgcctctgagtcatgggaggctttgcaggcctgtgcttccccagacgcccgatccctcgtgaggcctgggctggtcagcaagggccgccaggtccctgtaggccgcatgttagtacttgcctgggctgatgccgaagagagggaggggtgaggatgccactggtgagctgggacgcccttaaggtacgtccggggagctcacacctcaccctactagactgagtgcatgaagtcggaagtgtgcatgctacacgacccatgctggcgtggcagggagccttccaccaactgtgcttgtggaggggccacgggcagagagccgtcctcggtggaccggaaggatagaggaggagggagagtcttatacccggtcggcgctccggcgggggaggagttctcagggtggagaactcaggagaattagcatttcgagctaggaagtcagttcgaacggcaagatccgtggtatgagccgtgcagattggtcgagggaaacgagagaaatatcctcgaag

SEQ ID NO: 603016 - DNA, 478 bp, Homo sapiens
cgccagaggaaatccctgctttccaaaaaacgttggccggagaaccaaccagcggattgtaatgaggcggcgccgcccatatgccctgtcccttcccccagccttgccctcttattttactttttttagccggttcaccttgtaaaacgccaaagggttgggtccagttttaatggctgggctgcccccttcccctcaaaaaactactggcaacgagggccgggcccgcctttcccctctgtctttctttttgggggccggggagggaaaaaacttgcctgttggtgaaggaaaaagtgggggggaaaaagtggggggggccccccgtgaatttttgggttaaaccccgcgggccccaggggtcccgccggggggaatgccgttttatccgggggccctttttttttttggtccaatggtttttatttttgggaggccccattttttttatatgccaaaaaaaagtttaaaaacttta

SEQ ID NO: 603017 - DNA, 846 bp, Homo sapiens
gaggatgcttgagcccaggaggtgaatgtagcagtgagctgagatgcaccactgcactccagcctgggcaacagagcgagactccatctcaaaacaaaacagttaaatcagacaaatactactagtgcacttgtctaggtgggtagacagattcctggtggtttcttctctgccatcttcccaaaatactgtcaatccatctgtcgttgatacttagttgtttcctgtgtgtggagctatgtgatgatgaagctctctgaaaattcatgcaggagtctgtgtgtggacatatgtttttatttcccttgggtaaataactaggaattaagttaatgcttaactttgtaagaatctaccaagtaattgctgaagtaattgtattatttacatgcccgctagcagtggatgaggatgccggttggtccacgtctttgacaaaagatgatgttgtatttttaattatagtcattctagtgagtataggatatgtcattgtggttttaaattgtatttctgtagtgaccagtactgttgaacatttttttcatgtgcttactggctgttcatatatcctgtttgactatctttcatttttcatcacttttactaggtgtgtatcatgggtgagagtcttattttttcgggtcaaggccttatcgatttgggggggcctttttcccggccgctttcttcctttcactagtttggccaagcgctttcgggggatagccccgtgggggagttttcgcgcgagggcctttccgtgccggggtttcgggtgggggggcgctatgggggcccccttcggcgttggctggagcaccctttgctcttgtgtccgtccgg

SEQ ID NO: 603018 - DNA, 417 bp, Homo sapiens
  misc_feature (1)..(1): n is a, c, g, or t
  misc_feature (11)..(11): n is a, c, g, or t
  misc_feature (181)..(181): n is a, c, g, or t
ngccaagccgncatcagctgatttcccaaagagcagctcagccagcaggaagatcaagagcaaaaggatgaggagagtgaggagaaagccttgcacaggatgcgagagtgggacggactggaaggacacccatcccaggggctacggcaaccgacagaacatgggctagtcatccagaagnccaaaggacagcgtggtgcacaccttcacaccaaggacaacttcaggagggtgcagtgagggcagccgtgtggagtcttgctttgcatttgatagtgtcaaataattgcttgtaccctaggtaatgaccagtggatttttgtttggctttattaatctcatcacagtgtattctgatgtcttaagtggtcagaaaagagcactaagaaatggatctatataaccaatgagttgatt

SEQ ID NO: 603019 - DNA, 565 bp, Homo sapiens
cgcaatgtgacctgttgtacacgcgcgggccacgaaggggagattggagcgcctgtggagagtggaggtggtgatatgggataggaggtttctcatatactctggagaagagaggctatgtgaaggctgggctctggacttcagaggcggtgatagaacacccagacgcaggtcggcaactctacatgggattcttgagagccggatcaaatggcatgcagacttttacacttttctggcagtgaggaaaatatggaaaggaagtgggaagaagtaaatgctggtggctgtgacactctccagggaagtggctgtgaaagaggatgctttggtagcaagggggatctgtcagacattaatattcacataccacaagggtgaagcttgagattaaaaactttttcgagaacaggtataagtttttggctggatgtggacattttgagtgcagagtgatttgagcacgttgaagaagatgtgtgggctgtggaagacttcatgcgtgatataacccccggagtggctctgagagctttgaaggcacgggctttcttggtggggtgct

SEQ ID NO: 603020 - DNA, 206 bp, Homo sapiens
ctgaggtgctttgggggctcctatcttgatcctgcccttgctgcacttgggattcctggagcaaacttgaactctcagtctcttgctgcagatcagttgctgaagcttatgagtactagagatcccaagttgaatcatgtagctgctggtctcgatatcaccaagtctgaaatcggatacctctaggggtaccgagactcgaaata

SEQ ID NO: 603021 - DNA, 246 bp, Homo sapiens
atctagaggatccctcggccccatgttaagcagaacatgtgcagggaagtcgggctccacgggcacactctggcttcccgttgtgtgggctggcacacgaaggctcagcgaaatgatctcaggcttgcagtggggagaagacactgtattatgacggcagacgaacagttcctgcaagtgccccagcacccgcagcgcagacactgtgatgacaacggcggacacagacgtgcccgctatgcctct

SEQ ID NO: 603022 - DNA, 376 bp, Homo sapiens
  misc_feature (193)..(193): n is a, c, g, or t
  misc_feature (213)..(213): n is a, c, g, or t
ggcgctgtgggctgcgggagggtccggccgggcgtctctgcgagcctggagtttgcatgaaactttcaccgtgcgctccggggagactttcggctccggtctcccacacgacgcgcctcgcacgcctctcgcgactcgtcggggcgtccgttccaaactcacggttcccgagcatgggacggtgcatccccangttgcagacagtctgtccangaaggcgtccatgagtcgatgcgacgatgtaccggctacgttctctggcgctgcacgtctcatgcgaggcagtactgtggcaacagagcctggcctagaagctggaagcgttactctccagaagcgatgcccgtgcgtatcgtttcacgcctgcagaatatca

SEQ ID NO: 603023 - DNA, 627 bp, Homo sapiens
tggcggctctggcggcctaaatgaaggctggcctgtggctcagccgtgggctctaacgcggggctgggggcctggagacagacttcgcccagtgtgacgggtagtagggtgcggcgccgcttggcctcgtggggtgtaatgacccacttgcttgttgcccccggaccttgcctgccacaccatgccctgtcctggtggcgtgaacctgaaggaatgtgtcgtggccctgctgccccgccccgtccttcctccttccctgggctgtgtcactgtgctgtggctcacttttagatgtttacttcaaccacgtgtgagcttccatggctggcctctcagtgtcctgggtggagaagattaacatcctgtctggtgatgagactgtcaaacgctggtggacatgtggaccctgctggggaacgactgtcccgagcaagatagtgctcccccagactgctcctggaggcagaagtgtgcctcctacgtgttggccctgagtgccctggagcttcagtgcctcactcacacctggtggccctgggcagtgcccttgcctacagatcccactggtgtcctggatcccaggctcttggtgggttgtgccgtggctgtcctggctgtgcactggta

SEQ ID NO: 603024 - DNA, 186 bp, Homo sapiens
ttgtgtggtgatctacaggatccttacaaacggttggacaatagactatgatcctgcaaccatttggacatcataaatggaaatgagtattgaataatgtattctttcctagaatgattaattcagatgtggatatgatgatagattaactttccacaaaatgtagtaccccaaagctgagacatg

SEQ ID NO: 603025 - DNA, 107 bp, Homo sapiens
tctagaagtgagaggtggctgcatagcaccatggtggacttcccagtcaggtagaaatggctaccctgctgccgtgggagggtgcgagtctctctagcctgaagtgg

SEQ ID NO: 603026 - DNA, 1225 bp, Homo sapiens
atggacgctggggcgggccggccctggctgcgcggagccaggagtcgggcctcccggctgctgagcgtcctcgaagcctcccctcaccccggcttcctcctaggatccgcgctgacccccgcccggcttactggactcacgactccgcacggtacacatagaaagccccgagaaacgcaaggcagagagagcgagcaacacaacacgaacacaacgaaaacacaccgccaagagcaaaggcagacacgacacacacacacacagaacgactaccagaacacaaccaccaccaacgacacgcgaccgccgattccgcacgcgacagcgtgagaacggtgcgagagaggagacgagcacaaggaacgcgacggccgacgccgagccgagcgaggacaagcaacgcagaccaggcgagccgagaacacgcagacacgcgacgagcgcgagcgaacgcagcacgcgcgcggacgcaccccagcccagcgggaaacgacccagggacggcgagcgaggacgacagcaccaagagcacaccgacggagcgccggaacacgacgacagcgaacatcccgggcaacggcgcaccacgacgcgcgcgcacacgcacagacgcggagcggcacaagaagacccaagggtccaccccgacagccagaaggaaacgacgcgcccacagccagccacaacgtccaacgacgagcgaccaggagcgcgcaggggcaaggcgcaggaggaggcgccgcaccccgcgccgcggcgccgcgggggggaggcgggggggggaggggggagaggagggagcggcgcgcgcgaaagcggcgaagcgggaagggagcgagcggaggaggtagcaggggagcgaggaccgaggaggcccggacacgggcgagacccgggggaggcgaggaagagaccggacagcgagcggagggcgcacgggcaagtgcgcgccgggcggacggcagcagcgacgagggcagagggcaggacggcgaacgagagacaagaccgccaaaacaacaaacaagaagtaccaccccccccacaacaacacaataccaaacgacaaagcactacaattacaccaaccaccagaaccaaatccaaccataactgaccaacacatcctccagcataacaccaccccacgtcccaacacaacaccgccacaaccacacccccaacactatccccactacccacccaacccctccacacctcccct

SEQ ID NO: 603027 - DNA, 147 bp, Homo sapiens
ctgtcgccacagtagggagacttgggaacggtccgtttaaaggcaaaactgtggagtcctagcaggtgtgtgtgttaatggcgagggtgtctgcagcagtggccatcaggggcaggggcacgctaggggtgtcgtggctacgtcggt

SEQ ID NO: 603028 - DNA, 151 bp, Homo sapiens
ggtccgccttacactctatgcgaatttcagtgtccgatggtaagatgtgaactgtacggccagcaggggcagcaggtatttgggctgcaggagtttgccatttaataagttaaaaaaagatacaaaaacaaaaacctactagtcttgaaca

SEQ ID NO: 603029 - DNA, 133 bp, Homo sapiens
catctccctcctcctggggtgggagggcgctcctgttcccatttttgtgttccctggaggcaggtatcacaaaagatttgttaattgctttaggtgcacgcccaccacccactcaggactcttcacccgccat

SEQ ID NO: 603030 - DNA, 280 bp, Homo sapiens
gtgggaggatcgcttgaacccaggagtagagactacagtgagctctactgtgctccagcctgggtgacagagcaatatcccgtttcaaaaaaaaaaaccaacaacttttaaaaaaatacaaaatttagctgggcgtggtgacaggtgcctgcaatcccagctactcaggaggctgaggcagaaaacattcccttgaacccaggaaaccggaggtggcagtagggacgagatggtgccactgcactcacagccggggacaccaaaggaagactcaaaaaac

SEQ ID NO: 603031 - DNA, 684 bp, Homo sapiens
agggtattcaattaggaaaagaggaagtcaaattgtccctgtttgcagatgacatgattgtatttttagaaaaccccattgtctcagcccaaaatcttaagctgataagcaacttcagcaaagtctcaggatacaaaatcaatgtacaaaaatcacaagcattcttatacaccaacaacggacagagagccaaatcatgagtgaattcccattcacaattgcttcaaagagaataaaatacctaggaatccagcttacaagggacgtgaaggacctctttaaggagaactacaaaccactcactgctcaaggaaataaaagaggatacaaacaaatggaagcacattccatgctcatgggtaggaagaatcaatatcgtgaaaatggccatactgcccaaggtaatttacagattcaatgccatccccatcaagctaccaatgactttcttcacagaattggaaaagctactttaacgttcatatggaaccaaaaaagagcccgcattgccaagtcaatcctaagccaaaagaaaattggcttctttcttttcttctctttcttcctttttataaacaaaggcagtcatttactttaaaattggatattattcgttcttaaaatttttttagaatttctttcgtactatcactgtcattactgctgcttagagatttcagtgct

SEQ ID NO: 603032 - DNA, 1771 bp, Homo sapiens
  misc_feature (49)..(49): n is a, c, g, or t
  misc_feature (283)..(283): n is a, c, g, or t
aaaaaaaaaaaaaaaaacagaaattactagggaagggccaggcgttggntggcttcacgccttcttaaacccagcacttttgagaggccaaggttgggaggatcaccttgaggtcaagagtttcaagaccagcctgtgaccaacatgtggagaaaccccattcttcttactttaaggttaaactttttatttttcaagcctttgtgtgggtgtttgcaagttgtaaactctggttttattaaaattgtttctattaaattattatacccacttattctccttntggtaacgctacttttaacacatttaacacaaaacaaaaaaaaaaaaagaacagaggggcgcggcgcgcgcgctctcatagagagatatatctccctctcggagggggcgccccaaaggcttataccgcggtgtcaccccaggctttctcttgtgtttccccacacggtgtggctccccctatatatgtgtgtgggagcgcgcgcgatattatatatagcgcgtcttgaggcccgcgtgggccgcgcgcgcgttttatttacacacacgcgttctgcgtggtgaccacgcgtgtgtgagaacaccgcgtgcgtatacgcgcgtggggagaccctccctgcgtgggtgggagggggcaacaccctttatatctctctctgtggggggggtgtgtgccaccactatatactgtgtgggccacaaaaaatctatcccctcataacgaggagacatttttaagagggccctctaaaaaggggggatacaccttttttaaaaccattttttcaaaacgggggtgtcgtcttatacaagtgtgcggggtctaaaacccctataaggccggggcaataattatggcgctgcagcgcgggctcttgtgaaagacacgtttggggggggctacaacgcgagggaagattactggatattcttcttgcgcaaccacatctttttttttttaccccgcgggatccgcttctctcgttaatatacacaataataaaacgcgaggactgcgcgcacaacgaacaggcacacaacgactacaccagtgaaaacagtaaacaactcacaacaagtacatgagagggaccgcgaaggctgctagcgcacggcgaactggttgacgaactaagaagagacagagcataggaaggcgggcgaggagagaggctaagcgaacagtagcatagcaggcggccgaggtaagagcaggacgaccaaaggaacaacgacaaaagccagcgaagcccgagcataaagcacggaccgtaccaaaagaagaagacgacgaaggccgaatgcaagagacacaaagaacgatcagagaatgcgagccagaacagcatcaaaccgcacgatacgagtgcgaatcgtaacaccataaacaagaatagcttacacacacatcaaatacaaacagcataccttacataataaaaagctatatcagacaaagactatttatacaaaatacaaataataactcatcaataaagcaaacaaaaaaaatcacacactaacaaatacaaacataaactcaataaatagcaaaaaagagaaagacaacgaaagataaacaaacacaaaaaccagaatagtacacacgacagatgcaacaagcccaacaacacacagaagtacagactaaacatctaacacacagtctcgtagctaaggtacaaaacaaacgacatatagagcatatcatgtatttaaccacttctcaactatacacatagcatgacaacaatacccatatacaaag

SEQ ID NO: 603033 - DNA, 224 bp, Homo sapiens
ggtacagtggctgccaccctctcttttgtttgtcccgcagtcttgaattcttgcaggtgaccaaggtggagttttcttgtggggaagtagaggaagcttagtgttggcaggtgaccagaggaatgcttcctacccgaattgccttcagttttacttgcagccaccttgtgaaaacatatctttaatagatatttgtaaaacttttgctatttggatagagttta

SEQ ID NO: 603034 - DNA, 1749 bp, Homo sapiens
  misc_feature (1593)..(1593): n is a, c, g, or t
tcctcttacaggggctttttattccccggtcagaaaaaaaccaggaacaggccccttctgcctgagcccgggtaaacacaaaacaaaaaccgggaatatggggcgggggaggaatcagaaaagcggtctcctacagcatgtgtgtgtgtcaccttgggtccccttaggttgtgtcccgtggcgtgggtctcaggaaaggccgtgaccgggggtgtcgtgtggcatgtgaaacacctgtgggggaaacgaggccccaaggccagtgtgcgcccgagggacacggcacacgacacggaagcgccaataaaacacacgtgagtgcgccagcgcggggggctctcctgggtgtggcgccccaaggttgtggtgtgtgggataacggctggcccaattcacagggggccatctttgggagagaggggtgagtggcgcctctgcgtgggcagatgtgccccgctgtgaaaacaacagaaacagagcggcagaaagcgcaggggcacaagaatcaccgcaaagcaccccgcgagggaaggagcacacgtgggaagagagtgtcacttttgagaagatctgtgtagggcaaaattgtggggagcctttttttcccccccaaagagtcacagcactgcgagaaaagccactaatttttcaacaagagagacccgtgatgttacccgagggggcaaaacgggggcggcgacaaagtgttctgatagcacccccaagtgcccccacgttgtgtgatggggccacacagttggagggcagacaccccagaacgaccagcgcaaggagcaaagaacacaccccaagagagtgttgtagtctcccccctgacgggagcgtacaccaccgtgggggggatgtcttctcacgacccacccacggggggggaaaaaaaggtggagcagagcgacgaggcgaaaagggcggcaccaacaaaatggtggccaccaacgtcgcagaagagaaaaccaccgagggggggacgacagtcaacataaagcagagcaggctaataacgtatggtgagaaggcggccgccccacacaggaggggtgattacaaaccacatactgccaccgaaaagatgttgtggttataaaaggcgaggggccacacacctcacaaggtggagcgactacaccagacagacggcaggtagcacaccccagcacgaatgatgattcgaaaacacacacgcaggggtggggcggcttgtggcaatcccacaggaggagcgaaacacaacacaaaggagcagggcgatgcaatgtgagagctagcgagtacctaggcaccccgcggtggcccccccacagcagaagagagggaggccgcgtacggggaaatatccacacagaacaacgcacaaagggtggttccaccctccgggtgatgagcagagtagacaaaccgccacacacgtggtatccgagggggagcacaaacccacagcggtcgcgccccgtgtgagaaaaaacatggggagtgaggcagcccgacacaccacctctccgagtaaaagaccgaaggcacaccacgagagttgagtacacacgggcggaaacaaaacaaaacacccagtggtgnggggggacgcacaaacaggagcagcaacgcaagcagccaatgatgcatagggccactgcttctcccccacagagcaacgagcagcaaagaccagcaacgactacaagagataccacacgaacgacgtgtgaccgactagcatagtggcacgcagcc

SEQ ID NO: 603035 - DNA, 649 bp, Homo sapiens
  misc_feature (325)..(325): n is a, c, g, or t
  misc_feature (535)..(535): n is a, c, g, or t
  misc_feature (549)..(549): n is a, c, g, or t
ctgtagtcccagctactcctgaggctgaggcaggagaatcgctcgaacctgggacgcagaaactgcagtgagccgatattgcaccaccgtactccagtctgggtgacagagcgagactccatctcaaaaaaaagaaaacaaaattactgtattatgcacaaaaggattaacagataatatgtccactcatgtgcctaccacccagtttaagaagcagaaccttatcatcccttatagcggaccctttgagccctgaattgcagtctaccctttctccaccagaaataaccagcatttggaattttgaacttcttgcttttagctnttctctatacatttactacatatgtatgcacctccaccagcatactgtgtagctatacatggttttatatgttatgtacacagcgctacagcgtttgtattctgcagattactttcttgctcaccaaatgtgagacttatccatgctgatggatgacatgccatgtataatgatacactttcatccaacgatgttatgccaccatttaantacacattcttctnccaatgagtatcaggtggttctaagtttttgcttttacacggagcctttgaacttttttggacatttttaccaagccagaatttgtctaggatttgccct

SEQ ID NO: 603036 - DNA, 1052 bp, Homo sapiens
  misc_feature (357)..(357): n is a, c, g, or t
aggcgataactgatgtcatgccgaagcattcaattagtatgctggaactaggttgtcgaaacctcaatgtcctatgttacttggacctactaggttgatagataaactcctatattaaccaagtcattaccgttgtcgagggtaccagacctggtaataactcgcatgtatcttaatgagagctctacggctagaatacttctccttagttgtgcaccgaacctaggagcccattgtccctatgtagagcctttgacgagagccctgaacatcgaacgccttaactatggtcaagtgcttcatgaggactgtaccgcagcacatgctggtggccagctgacagtgagactagtgggntaggacacgcgatgtcttcctgcacgtgtacgtacgcgtcctatgcattctctctgtcgccgtatgtccttgattctgtcaataggcgtgagcaactggcgctacaatcaagtacgcgaaagtcttatattgccacatgttatgatgtcacggtcttgtatccgcatgtgacaaatcctcctggtacgctagattcagcccatgaatttctgcttttcacggctgtcaaacggttctcctattgccattgccagtaaccggaaagcgcgtacgggatagtaaacaagatctctggtaggaccgaagagggctctgagagtgtccattaatgccgtgcgatagtgctcttacttgggaagtcaagtctactgaactagaagaccgataaacaccttgcggctcagtttccacctagcctaaatcagatggtcgcctaattgcttggtctcttggcaaattgcgtcctcgtgggaggtcttggctcaatttctttcgcgccatatttaagtatctttatgctcaggtgaaatgtaacaggcgcttagtacttcacgaaagtgttcagagtggggtggaacccggtgggcttttaattttttaagcccgtttaaacaccttgacagcaggattagtacccatattaaccctgataagtcccggcaaacgcactggtcttccgttccccagggcggtcc

SEQ ID NO: 603037 - DNA, 431 bp, Homo sapiens
cagaggagatcatccccttcctctcactctcacctcaacacagaggcctgtgagcgttaaagtgaaaggtttagacacacatctctcactctaaatcaaaagctagaaatgattaagcttagtgaggaaggcatgttgaaaaccgcgataggccaaaagctaggcctcttgtgacaaaatttagtcaagttgtgaatgcaaaacaaaatttctttaaggaaattaaaagtggtattccagtgaacacatgaatgatgagaaagtcaaacagccttattgctgttacggagaaagttttagtgctccagatagaagatcaaaccagccatagcattctctcaagccacagcctaatccagagcaaggccttgactcttttcaattctgtgaaggctgagagaggtgggaggagaggaagggtaccgagctcg

SEQ ID NO: 603038 - DNA, 844 bp, Homo sapiens
  misc_feature (250)..(250): n is a, c, g, or t
atgggggggggaggcggtgatgttgcgaggggagctgggcttacatgagggtgacgtagtcgaggctgagcaagcagagtcggtgagaactggtacgagggcatgctggatcggccaggtcggggcttcttcccgctcagttacgtggatgggtgcgttgtgccccctgcgctgcgaggtgactcacgcgcgtgtccccgctctcggccccgtccgtccacactggccgtcgttcttacaagtggtgtcntccttgcgttccacggttgtgcgcatgcgtgcgaggttcttgtgtctggtcgaccagccggcgccacctgggccccggcccttgaggtactccctgagcaggaccccacacttgggtgggggggcttatctgggtgggtggggatgcctgtttacactacgcgcgtgactcccaacgggtgacggcatcccattccgccactccatggcgccaagccgtcctcccccggatcccgcaagcttctcgaccccaggcatggccgacggccggggtgcaaccacatagaggtgctcttagaaaacacgtaatgttcctctgggggcaggaccccaactccgtactgacgccgacggggggcccgggccactgcctaacgctcgagtcccgcagacatatcacaaggattgggatcgaggggccccccatgaggggtggctcagagcataggagcctgggtataaaaatcacgtcccagactggtagcagggtgaatggggccaaggaccaaaaatcaaggccaaaagggaccccggccgtaaaacaagcactccgtacgccctcacagacaggacaaagggcccacagacatccagg

SEQ ID NO: 603039 - DNA, 428 bp, Homo sapiens
  misc_feature (38)..(38): n is a, c, g, or t
  misc_feature (162)..(162): n is a, c, g, or t
aggaaaaaaccacctgcccaaagtacctttcattttanaagaatcgagtcacttgaaaacttctgattgtttccctgcactttaagttaagcccgggcaacatgttgaagaacctgatctggtttggctgtgtccccaaccaaatctcacttgaattgtaantcccacaattcccacgtgtcatgggtggtgactgaattatgggggtgggtctttccggtgcctgttcttatgatagtgaatgagtcttacgagatctgatggttttaaaaaccatcagtgcagggagttgccctgcacaagctctctgcctgctgccctccacataagatgtgtcttgctcctcttgccttctgccatgattgtgaggcttcctcagcccatgtggaactgtaagtccaattaaacctgtttcttgcaaaaaaaaa

SEQ ID NO: 603040 - DNA, 838 bp, Homo sapiens
tctacaatcaatgcaacaagtcattattaccctcactgtcggaatcccaatcacaggcatgctcataaggaaaggttagaaaaagtaaaaggaactcggcgaatcttaccccgcgctgtttaccaaaaacatgcacctctaggcatcaaccagtattagtaggcgaccgcctgcccagtggacacatgtttaaacggacgcggtaccctaaccgtgcaagaggtagcataatcacttgttccttgaaaatagggacctgtatgaatggctccacgagggttcaggctgtctcttacttataaccagtgaaatggactctgcccgtgaagcaggcgggcatgaacgacagtcaagacgagaagatcctatggagctttaattttatataatagcaaacaggtacctaagcaatagtccacaggtgcctatagagctaccaaacctgcattaaaaatttgcggttggggcgacctcggagctagaacccaacctccgagcagtacatgctaagacttcaccagtcaaagcgaactagtatactcaatttgatccaataagcttgaccaacggaacaagttaccctagggatacacagcgcaagtcccgtattctagagtccatatcaacaatagggtttacgactcgatgttggatcaggacatgccgatggtgcagcgctattaaaggttccgggttcaacgattaaagtccctacgtgatctgagtcagaccggaggtatccaggcggggctaactaacttcaaattctccccgtagaaagggcaaaaaataaggtcatttaataaaaggcttccccggaaagaattatctcactgtt

SEQ ID NO: 603041 - DNA, 387 bp, Homo sapiens
agcattttaaaacattctatatttttgtataaataaggaaaagtactagaacaaaaacatttgaattatattgtctctacctggtaataactattaacactttagagtatttccttttgattttgttttctggtcatatatttacctaactggtagccagttgccagtactgtacagttttgtctgttgctttcttcatcatatcctctatatttttcatgttattaagaatatgttattagaatcctaaaatatattaaaagtattttatggcttggtaatagtccatttaatacacgtgccatattttgtttaaccatttcttattgttaaacaatttggtttctaatttgttagaattagaaataactttaccataaaaaaaaa

SEQ ID NO: 603042 - DNA, 172 bp, Homo sapiens
ctggccaggactcgcacagaacctttcttgaataggtcagtttcacctctcctacacacaaaaactccaccccggactggcgccgtccacaataccagctagtaggctagaataagttcagcgactcaagggaggcctgtacgaggttaaaataaactggcacaacaagaca

SEQ ID NO: 603043 - DNA, 351 bp, Homo sapiens
tagtgcatttgctggtaggtcaaggagggatggactttgaattagtgttcagagtcacagatcctacgtatgtgctctgtggcaaggggtttaacgataaacccaacaagggggggccgccaagcggggcgccgcgtttaagccacagggccccccccccggtggggggggggtggggtgggggtggggtggtgggggggggtgggcgtgggggtgtgcggtccccgccccctaatggatgggaaagctatataatttattggtacttcctaaagatagagactaaagtcatggtagtattggccaaattaattttaaaactgaacaagtcatgaattttcatataaatca

SEQ ID NO: 603044 - DNA, 684 bp, Homo sapiens
gaataaatgtgactgggtcatacgaaaggtataatctctgataatctaagttccatgacatgtgaaaaattcttttccggtgagtgtcaccggaaccggattgacaacaaagtttccagatgaagctacttgtatgggcgttcatgcgcaccgagatgagtacattccatcattttgcatacagtccaagaagatgagggactgtgctctgccgaatgtgactcgctataatttgaatccaagatacagaacctgtgatgctttcacctatactggctgtggagggaatgacaataactttgtgagcagggaggattgcaaacgtgcatgtgcgaaagctttgaccaagaaaaagaagatgcccaagagctttcgcatatagccaagattagaatccggaaacaattccggaaggaaagcaacttagttaaatacatttctttgagatatgttcattccttgtttttgtgcatcttattgcgcctttattttgttgacctttttaatggtcatagtaattcattgaacagaaacttataattacttgagcatgtcattttgaggcggaaaagcaaatacttccatttgggctggaattattaaatttgcaaccccaaagattttttgtgtaagttttaaacttacccaaaaggttcaaaccttttattttaaaacgaaaaaata

SEQ ID NO: 603045 - DNA, 388 bp, Homo sapiens
actcgcacgtccgattgtagtggtgctccgtggcagcctggcaggctgtgtttccatagcggcgctcttctctttctcaaccaaatctgagttgacgctcccatacgcgtgggagcccttgttgttttcaggctagaaggaagagagattcctatagttcaccgagtcttgaagattcatgacacgcaaaatgggcctatcacgttattgaccaaaggagataataatgcggttgatgaccgaggcctctataaacaaggacaacatttggctacgaggaaacaacagatgtagtggggagagccaggggatttggtccttatattggaattgtgacgatcctcatgagtgactattctagatttccgtatgcagttctctttttgct

SEQ ID NO: 603046 - DNA, 391 bp, Homo sapiens
  misc_feature (72)..(72): n is a, c, g, or t
cgctaaaggggaaaataattattcccatcaaagcagtttagacattgaaacaggccaatgacttcaactgtngaggaagccactggactgacaaaacagaagacatttgttggatgtgatagtaaattttgtatgccagcttgactgggtcatggggtgcccaggatgtttggtagattattctgggtgtgtcttttgagtgtgtttctggatgagattagcatttgaatcagtagactgaatatagcatactgccctccctaatgtgggtgggcctcatccaatcagttgaaggtctgaatagaacaaaaagtctaggtaaatggaaactcctcctgcctgactgtttgagctaaaacattggtctttccctagctttggacttgaactg

SEQ ID NO: 603047 - DNA, 343 bp, Homo sapiens
ggacctcatgcatcactccccgaacacagattagcttatgctaaattagtttccttttaaggtaatgacaaattcggaagatattttatatctaacactgtaacagttacatttatttgcttaccatgtgcattaagctaagtgctttacattattatctcaaatgataaccttataaagtggctaaagtcctcatttctgtaggtgaagaaaataaagctgaatgattaactgaagctaaagtagtctgctcagaattgcgctggtggagccagtgcatggctccacctacgttgtctgactctagactactactgtagacaacttctaccatgcgtccatt

SEQ ID NO: 603048 - DNA, 695 bp, Homo sapiens
tggaatgtagggtaagacgggccacctttcgcccgggccaccaaagtggcgaagtgtgacccgctggccctcagggaggggcctgtgatactggcctgcttctacccaaatttgctacagtaggcctggggtgaagacccggggccctttgggggattttccctgcagggggcgattagatatgagggactttcctctacttaccggagtgaggtcctccggaaagggggacaatggtctgcccttcgggtaagaatggatatgatcttcactcttggtatggtaaggctggcgtggcctaaaagcatgagtgcttttgctaaacggtctcagggctggcagggtcaggcattccgctgtgggcagatacatgcccaggatggcatctagggggcggcatagcaaacgatacggggagaggggtgtggagtccttaggacaggcgctcgtgggcttatcaccaatcaatgtcaggtaagtacccatgaagtgtcactccttttcaagtttacaatgtccagcggggtgatgaaaattcaaaagaagtgcagtaggctcctggaaacgacataaccagatcggctgcattgtatgtaacaagcccaacttttttttaaaataagatatttagagtaccatgcaggattggagacaataataacaatgaagtgcaagcagttaatcccgagaaagat

SEQ ID NO: 603049 - DNA, 576 bp, Homo sapiens
  misc_feature (1)..(1): n is a, c, g, or t
ngaacactgtcttagtcaacattatatcaatggtgccggtgttgtgcctggcatgtagtcaacttgcagcataaattcactgactgaaggaatgagtactagagagaaggatacgaaaaagggacatcagggaaagacaaagatgatttccaagtggcagttgttatgtgttgatacaacttcatttacaatgagtagaattttttaagtaacatggtacctactctcagaaactaaccagagtagacatttaaattgtcctggagggggtaaaaaagaaacaactgaatctttgtgctatgttgcctaccataaagtacagctgcccaatggctgtccctttgtcccagatcttaggatattccagctctcatgatctagacccagtccagctacaattaatatgcttttccttctcttcactgtaagacctctgcactttcctggaagtgattagttccaaaaaaaagccagcaagaaactatgaacaagaaaataattaccatgaatcttttcatcttattgataacaattttataaattagtttccaaggaataaagattattcttgcttta

SEQ ID NO: 603050 - DNA, 260 bp, Homo sapiens
actcgccctgccttctctgcagaggacatgcgggctgtcgctgagccacagaaataagggtgagctcaatttgtggccagactagacggcaatagggatagtcaataggaccggatcgttgcaaactctgagctagttcggatgagtatagaaagggactgatgagaggtagaaaatcatgtcgcaatcaagagtagagtaccacttgaatggagagtggctgatttagccggtcagctgggcccacagagagagcgtcc

SEQ ID NO: 603051 - DNA, 444 bp, Homo sapiens
ttaagtcctggaaagtaaagaatgatgtattttcttaactattattgtatagctttaaaaagcactacaagcagtatcaggcagtcagtaatgtgatgactatgaataatcatacatcaacaaactgtatagcctagaagaaataaattcctagacacatacaacctaccaagacagaataattaaagaaatagaaaatttgaacaaaccaataatgaaaaggagattgaatcagtaatcggatacatcccaacgaggaaaagctcaggaccagatggcttcactggtgaattctaccaaatacttaaagaagaatgaatgtcagttcttctcaaagtctttccaaaaattgaagtggagggaacacttcccagctgtattatgaggatatattataccctgattttaaaagcccagacaaagggaaacaccggggatcctcta

SEQ ID NO: 603052 - DNA, 123 bp, Homo sapiens
gagtgcacatgacataatctcagctccccttctgagttcaggtgatactcctgcctcagcctcctgagatagctagggactacaggcacgcaccaccatgtccaagagtaatttattattgta

SEQ ID NO: 603053 - DNA, 915 bp, Homo sapiens
gggagcggcagatggccaggcccccaaaacgggacatcgagggtcacctccatggtgtctgaccgatggtggtggtttgcggtggtgaccactgtgcacacccactcctgagggcacatccttggctgctgcacacccgttcagccgtctgcagtggagtgctgaggacctgcgatgtattgggcgcggtgggtggtggcctatgctgcgacgtcacatcttgcgcggtgatgctctgtggcatcggtagaggcgcgcccctgggactgggctggagtgactgatctgcttctctgtgaccagacctgcgacctgcatcaacgcatgtcacgacagcggaaccaagcgaggtgcgtgttcatcagtctgacgacacaaggtgctggcataacctgtgtgctaccctggccaacaatggagggggctcagcggccggagctgatgccgcatacattatcgaagagcccgtatcgacatcagggatctgcagtccaagagtggagcaccatgacaggaggaaaaatgagagaccaccatccagagaggccttgtgctcagaaatgagagctgcagtgcaaaactacaacagcgacttcatttaccagctgtattcagaagagggcaaaggcagtgtatgacggcaggaagaacgtgctgggtcacatgcagacagggtggggcaccctctccatatggatagaaactttggaacagaatctctgccagagctatggagtggatcactgaaaaatcaaaggaggccgtggcaaaaggaacaacattaaccaccgatgataccagtggtgtgcgggaaaaaccaaagaaaagtacaagcaacctgtggacagatgaaacagaaacggatatgagcacagcaaccagagaaagtgaggacaacgaggccctagtaaacgg

SEQ ID NO: 603054 - DNA, 267 bp, Homo sapiens
  misc_feature (219)..(219): n is a, c, g, or t
atgtatgtgtgtatatatagacaaaaacttgtaagagacaaaagaagctgacttatataatgacaaagggattgatacatcagaaaggtataacaattttacatatatgtgcacccaacactggagcacttcagatatataaagcaaatattattagagcttaaagagagagatgcaaccttataaggattgaaccatgagccattctaaactcatccntatgatgccagtattaccctgctaccaaaaccggacaatcaaaaaaaa

SEQ ID NO: 603055 - DNA, 364 bp, Homo sapiens
tgtggagctgaaaaaataactattgagtactagggtagcacctgactgacaaaataatctggacgacaaccccagagttccttcctgtaacatccttaatacaggtcaagatttaccgcggctaagatttggtatctgttttgctgcccggggaagagcgagggactgactaaccacttacaatgaaaccttttcttgctacacttcatcatgaggcaagtatttcagatgttgggagatagattgtaaaggtataaaagctaacttcacagctatacaaagctatacgtatgtgcaccatgtgtcaaatgagagaaagtatagatattcaatgttgttgaatcctcacaattttctatattag

SEQ ID NO: 603056 - DNA, 409 bp, Homo sapiens
agcgaagagaaagagatcaggcaacagtgattctatagaaacgggatgcatgctcaggaagctgagaggctgaggacagaggctggaacctggtgagcaaactctgagcccaatgctctgtgcccctaaaagaagggaacaacgatgcacctatcacaacacggactccctgggccaataggagtcaaggctatgaagatttctatgcaggacccaacatgcagcaatgtacatctatcatggtgaccagcccggatagcgatactccatagccttaaaaccaaaaactcggactactccactacagaatattcctagaatcacagctgtgatcgaaggacagagctgtaaataactgcgagaggtgctgacctgaactccctagtgcgagtgcaggtcgctcatcaag

SEQ ID NO: 603057 - DNA, 117 bp, Homo sapiens
tccgaccaggtgacaggcggacgaggcccagtactgccagctggtgcgacagatgctggatgaccacaaggtatgtggtgaccctcttggacagagtggcctaacgtgagacgccgg

SEQ ID NO: 603058 - DNA, 339 bp, Homo sapiens
ctgtctcataggatcccatgtccagcgcaaagccagatccgatagtgtacatacagatgcacatgctatgcaggaccaaaacaacatggtcatgtgcggatcactggtcctttgtctgaaatcgataatgcagattcctgtaacctataggtgcgtatgtgaacaggtacagatatgcctaggcagctacttcaaagtccatgttcgtacagcgcaaaagccttatcagataggtgcagcgttacgctgtgacatgtgtgtctggtcagcatccatggtattcacgtctccgattcgcttgtcactaatctcatagccagcattatcaataaatgttcg

SEQ ID NO: 603059 - DNA, 561 bp, Homo sapiens
ctctagagtctcctaaccccgtgaatgctcacctgcaagcacaggggtgaatctgaggtgaggaaaagtgagtgtctacaggaaatgcacaattttttaatctcctccatcagtatccttttcatatatctcatgtgctctctctagaactctagcagatttagaaagttaaagaacccaggaccctctttaagtcttgcagatttagataagtctaaggcatgttgttaagtgagaaagtgagtgagtatatgagaaagtagacttcctttccagttttcaagcttaacacagaaaagatgaagaaatgccacctctacacttcacacccagcaaatcacaatgcgtgctctgagctttcacttctgaaacataaaaccaacccttcctgttgctaagattcagctgtaatgttttacccatgcaaaagaaggtcccagaaatgttgatctactccaagagttgatctgggaaagatgaagaagaaattcctgcttttatcgagggtaaaagtgtgtagaattcacatatagtactcagacaacagaggccacaggtgcg

SEQ ID NO: 603060 - DNA, 1185 bp, Homo sapiens
  misc_feature (101)..(101): n is a, c, g, or t
  misc_feature (923)..(923): n is a, c, g, or t
ggccctctggggctccgaggcccggcgggacgcatgttcaccagcagcggactccagtgggctctacaaggtggcctctggtcgaagagccttcgtgctgngtccccagatgaccctctcccatccggcatcgacccgtcctcgcaggcgcgtcaacgtggcgcagtgaaagtctcgtgttgtctgataatgaagccatatcagcgacgaggtgcgagagaaagcggagatatgccaggtatctcggggaggggttggactgagtgggtgggggcaaaggaaaaggtcatagtgtgtggcctgggactatatgaaacatgtatgacctatttgcatggcgagggtcaggtgcgtgtcgtctgagtgtgtagtacagtgtggtatgaagggatcaatttcgggaaaacggagaaggatagtggggcaacgccatggagacggaattgtgtgccaataactctttgtaaagatgcctagcgaggtttgcctgtggggtcccgtgggtcccaggcgctatcgattctagcgaacctgtttctaacacgttcaatggaaaaggcgtcatgggctaggtcaattctgctgtcgggcgcaattacagctaggtcccagacctaagcattacacttgtggtggcatctactgtgcgccaatctccacctagggcacgacgccttgaggggttaccatcgtgctaacctagcggtgtatagatcgaaccacaagtttaattgcaaactggggacttggcactattttaggccccaacagcgaaggattagcccataagaggtaggggcggaccgaataggagtttcccatatgggggggttacccctggtggtaaggttcaccgagttccgagcgataggacaagaaggggaacttggttttgggaattttgtgaatttcactggaatttngggaggggaacggtctggtctaaaggcctctaattgcacgacgaaaagcacgttacctaggggtggttacaccgccgttaaacgtaattccatgtggcgagaaatttatgggttgaaggcgcccaattccaaaggggttgggcggcaacctcttggatgtgggattaccgccgggggtgccttggattgcgcctcaactggtaaccatggccagccacgaactgggttccgccccaaggggctgggccccatttcaaagtgg

SEQ ID NO: 603061 - DNA, 318 bp, Homo sapiens
accccggggtgctgccactagtgggtccccttcacacaggcagctgggaccctgtattagtccattctcatactgctataaagaaatatccgagactgggtaatctataaaggaaagaggtttaattgactcacagttcagcatggctggggaggcctcaggaaacttacaatcatggtggaaggggaagcagcaccttcttcataaggcagcaggagagagaagtgcagagcaaacaaggaagagccccttataaaaccataagatctcctgagaactcactcactatcatgagaacaacatgggggaaactggccc

SEQ ID NO: 603062 - DNA, 285 bp, Homo sapiens
  misc_feature (10)..(10): n is a, c, g, or t
  misc_feature (72)..(72): n is a, c, g, or t
  misc_feature (138)..(138): n is a, c, g, or t
  misc_feature (180)..(180): n is a, c, g, or t
  misc_feature (237)..(237): n is a, c, g, or t
  misc_feature (281)..(281): n is a, c, g, or t
aattcgcggncgcgtcgacagaagacgacagaagggtgggcagggggacagagtctcgctctgtcacccagnctggagagcagtagcgcgatctcggctgactgcaacctccgactccccggttcaagcaattcttcngccccaccctcctgagtagctgggactacaggcgcccgctgncacgcccggctatttttttgtacttttttagcagagacggggtttcaccgtgttgcncaggctggcccgcccaccttgggctcccaggtaagattacaggnctcg

SEQ ID NO: 603063 - DNA, 211 bp, Homo sapiens
  misc_feature (126)..(126): n is a, c, g, or t
tgtacgccaataaaaagatgtgtacttgtatgttcattgcagcactattcacaatagcaaagacatgtaatcaaccaatgatgcccgttgacagtggactggattttttttaatatggtacatatnacacccatgggaatactaatgcaagccgataagaaaagagaatatactcatgttttttgcagcacatggatgcagctgcaggcat

SEQ ID NO: 603064 - DNA, 691 bp, Homo sapiens
gcatgaattcggcacgaggagagagagagtgagagagagagagagagagagagagagagtgagagagagagagagagagagagagagagatagagatggaaccgtttcgggcactgttgttgcggattaagcctgatctagttgacaacctcccaaatgctcccttacttcttgtcagatcccatgggtttgaagccagttttgagcctggctgtgattgttgtaatcctgtgcacgaatctggaggaaatgggttttgacatggcctatgttgtcctttgccagtttctggttcttaaggattaagacctcttccgtgaatggctgttagacacttgtggcgcctacgcctagcactcccgggacttcttttgatgccttctactgtggtgcgacccccttttttgatgctctcttggtagctctctattcccatgccttatcctagttttgagcccagttgggacttcttccctgtcctctactaaggcagatttctttttgtcgtacttaccctccacctacttctcgggtctttttggagtttttttccccttaccattttacctttttttttgattctctcttttgcctgccttccccgctcttttatcctttccctttccctggtgacagtttccatcttttcctgattgttttccgggccccttcttttactcctcctttcttt

SEQ ID NO: 603065 - DNA, 242 bp, Homo sapiens
gattggaaccggagtatcgatcacatatctgtgtcagaaatacaagtttaagatggcagatcactgcatcttttttctgaggggcaaatccagtaatctcattaacaaaataattaataacagatatttttttttggcaacagagtttctctttggtcgcccaggctgaagtgacaatggtgtgatctgggctcactgaaacctctgcctcctgggttcaagcacttctcctgcctcagcct

SEQ ID NO: 603066 - DNA, 377 bp, Homo sapiens
ctcaggactccccccgtgcctgaacttaggaagagaggtcatgaaatatcatcgactagatatttgctataatagagtcaatgtagctaatgattttagacctattggctcagggccctgagaattattggcatgtcacaataacctcatgaacgtgtggaatcgtcatgcccatggtacagaatcaggattcagagatggtgggtaactcacccagggttaccgagtttagcatcgtggggcccaagtagcaagagtatagaccgtggctcatagtaggtcatggaaagtgatctcttagctcagtatgcatcatagcaaatttggagagatggcagggtactgaaatgtgcacaaatctctctgcgcgctcggtg

SEQ ID NO: 603067 - DNA, 106 bp, Homo sapiens
cgggcgcgcgcggcattcgctggttgtctcgttctctccccctcttcgtccctccttcctctcgtttcgtcctgtggacgtcccacggtaccccctgttttacccc

SEQ ID NO: 603068 - DNA, 309 bp, Homo sapiens
cacatcacatcatctctgatagcaacactcagcctgggaggtatgttgctcatctaggcgaaaaacaaaacatctattctccaggaacagggaccagaaccctgaccctgctggacatcggtcctgggcatggtaaaggtgcccaggtatgtgtaccaggtggccctcgggctgcgcttctaggctcttggtcattgggtgatgggcgtcatcatcccctacaacacccatgtacctgtaaacccattatagacagaaccgcagccccactgaaccctaaagagtatcgcacgcagagctcgcaagtcc

SEQ ID NO: 603069 - DNA, 186 bp, Homo sapiens
tgtccagatacggattcgtggctcacaccgtgtaatttctagctactttgggaggctgtagatggtgtcggatcacttgagtgtcaggagtgcaagagtaggctagcccacatggtgaaaccccgtctctattaagaaatacaaaaactaggccggatgcagtgactcacgcctgtaatcccagca

SEQ ID NO: 603070 - DNA, 685 bp, Homo sapiens
cgcaaccacaccaggctttcgcttcccctgccgaggcctcgttcgccgcgcagttctccgacttacggtcaccgtgccaagattgcatcttaactgccttgcttgcagtttcttttcacagtataggagttgtcatcatgacttccagttaccttctgggaccggttgtcaaatgatgtggctagagacggaggctcactcagattgttgctgcaccacaatggaaatgccagtatgaagccgctgatgttaggaaggctccaggttgtgcaattccatagacaacaaatcaaatcatttccaaccatactggagtcgcgtatatacatattcaagacacctgtgcaggccgggcgcggtggctcaagcctgtaatcccagcactttgggaggccgaggcgagtggatcacgaggtcaggagatcgagaccatcctggctaacacggtgaaaccccgtctgtactaaaagtacaaaaaaattagccggacgtggtgcgggcgcctgtagtcccagctactcgggaggctgaggcaggagaatggcgtgaacccgggaggcggagcttgcagtgagtcgagatggcgccactgcactccagcctgggcgacagagcgagactctgtctcaaaataaaataaaataaaataaaaaataaaacaataaagaccaaaaaaaaagaaccc

SEQ ID NO: 603071 - DNA, 131 bp, Homo sapiens
tccattaaaaattattttattcaaattatgttttccaaaaaaaagggttctgggctaatcgtttttgaaagttttcataccatttcaaaaccccttttgccggaatgaacatttcaaatgggcttggggtc

SEQ ID NO: 603072 - DNA, 180 bp, Homo sapiens
acacaaatgaagactaccacaagtgagctaatgaaaaatgatactaggctattccactgcacttgactataatatttagataattagaacaaggaaaatgacctcatcttacataagtacagagccacaaccttctaggtaatttgacacattcctagctgtcaggtgtaagaagggaca

SEQ ID NO: 603073 - DNA, 114 bp, Homo sapiens
catggatttgctggtgcagtacaactaggcttaatagggactcgaattcgaggtaccgtcaagttgataagcataacaaattccacaatccatagtaaaatccttcaaaaaaaa

SEQ ID NO: 603074 - DNA, 180 bp, Homo sapiens
atttgaattgcaatacagccagagagacagggactacagctttctacgacggaaatagttgtggtgcgttatgtcaccactgcagttgccagtgtgattagtgcctaggggtctccactttacgcacgaaatggtaatgacagtgatataatgcctggaacctggttgggcgtacgggga

SEQ ID NO: 603075 - DNA, 83 bp, Homo sapiens
tcgatacgaccatcatcatcatgatcgaaagacatccctccgacctagtactacttctgtcgtcttataaacagcgcgtatag

SEQ ID NO: 603076 - DNA, 553 bp, Homo sapiens
  misc_feature (6)..(6): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (71)..(71): n is a, c, g, or t
  misc_feature (108)..(108): n is a, c, g, or t
  misc_feature (162)..(162): n is a, c, g, or t
ctccancgtggtctgggtccccaactaaaccancatctnctnagctatgacccaaaccatggatttacatngagaaaaacctttcaaacttgctgaaggcccatcatngaatataatgctggatgatatcaacaagcaattcctagacgatcccaaatatancattgatgagggatctcccctccaaactttcatatcatctccctgaaacaaatgctcaagaaacttggagtccccaagactcacctatacctaaagaaattaattggagaggtgtccattggcctccaggagacgttcatctaccctgactttctcaaaataatgctgggcaagagatctgccatcctaaaaatgatcctgatgtatgaccaaaaaccgagataaaaggaaaatccaacaggccccccaaccaataaagctatctctcacttgccctgatttaaagggaaaacgcatcatcctatttaacgcccttctaatcacccagatatcgaaacacaaaacaaaatttaacccatattcaacaaataaataaattcccccctcctcc

SEQ ID NO: 603077 - DNA, 911 bp, Homo sapiens
agcggggctctggcgtgcgtgcgtgtggttgctggtggcctggtgctgtcagcctggcctagagaggaggaaggagcctgcggcgtgcagtgtgagtgggctgggaccctggctgcctggctggtggtgtctagcttgggggatgtgtcgggccatgctgggtgggccagtggcgctggtggcttgctggtgtgcccgcttggtggtcacctgcctgcggtggttgctgctgcttgagcggtgcggtggtggcctggctgcacggctcggagggacatacgtgggtgtggcttgacggtgtgcttcggtcaaagtccggacgttggacgatcaagcgtacgtcggctcatcggagccaggtgcttagatattgcagttgattgtgacatcttgtacaagccagcatgaaaacaggcagcgggctcttgtgtctacagccttgagagaagaccgaaagcacgatgctttgcccaatggccacaacagacacggtggaaagactcatgatggcattttgggcatcttactggagttaagcacttcagtgtctaggtaagtgctcaagagattatcaagctgtacaacccaaggcagtgggacttttgaagataccagaacagacttgtgccccttaaataagtggttacctttagtggtcccgtttgtattgatacgggggggattgcatttctgagagattgacgcctcccctagaggtgaaagttttgaggcccgactaccgtggacgctccatgttggatggagtcagtgaacatcttgcaccaaaggtttgggagaccatcgacctttggtcttcacttgggtactctgttgaattggcacaggtgctccagccaaagggggcagacccctggtgtacctgcggaggagtccaggttgtgccttggaaa

SEQ ID NO: 603078 - DNA, 1428 bp, Homo sapiens
  misc_feature (193)..(193): n is a, c, g, or t
gtgtctgaaggagtccggttgattggtgaacgagaagcctgcacccgcgatgtcttggccaactgtgactcgagcgttcctcaatatgtcgtggcctagccgactggtactacgatttatcattgacaaggatagccgtaacttgataagatgtgcactagcctgggtgattggctaacccactggcttggangcactgtgatctggatcgtctagagtcggaggtcgcacgatgtccagttgcaactattagactcatagacttgtgttagcactaggttggccagcaacgagtgaccattactagttggccttgcccgaggagtcgaaacgagcgtcacgggtcgctcgatgatcgcatagagagggcccaaatactaggtattctttcaaaaggtcgtacatttagcaacgttaccccgcaaagcgaagacatgcatggctgagacatgtccgtctgagagcaaaaacgactcctagacttgggttttgacctccaactagggggcgggaaccaattggtgtagacagagatgggtattagctcaggaatttgagccatcctttggggaaaacacacttgtatatgcggaaagacgggcaagaatataaagggcccaccagttaggtttcataacacgccccttggggaccaccacatgtgcccttactcttgggcacgtatggtccccgcgccatgaaaacacaccggaacatttgcacctcatgatggtatttccttaatcattttggcccgaaaaccgggtggagcgtcaccgccgtgtggcttggtgtgcgttcccattagcgctgtttctagtgggagtccccccattctgcggtaacgttaaaataaggcgctccccgtttggcccaacggagggccgcgatttttatctccccttgcggggtattatggccccacacccttctcgggattgggtttcattccccttagggaaccgtttgggtgtccgttagggtacccgcattttctaaagctgggcgtcttcgccacttggcgcgcgcttggccccccactatatataccggcatgcaattgcggtcatttcgtatcggaaacaacggtgggggcgctcccagcgcccttttcgggcacttgccgtattaccgccagtttgggtcggcgcttaacgctacccgcttcttttcacgttggcgggacccgtctgttgtttcgtagctccatctccagtcacggcccgcttcacattcgccgcattccggtaccacccgcgacctctaccctgcgcgtttggagacgcgcccccatttttggcgcttaagaggagggggatgttccctctgggggggtgctcttggagcagtatcccccacctagttgcgtgatacacaccgtgggccgtttccccccgttggggccgcgcgctcccacctcatttgtgc

SEQ ID NO: 603079 - DNA, 764 bp, Homo sapiens
  misc_feature (373)..(373): n is a, c, g, or t
tgggttaaagtgctgatgccatttaattacaatggttctacaacatttaaccaggatgtgctacaaagaagatcttatttcaaaagcacgctgagtggttgggaaagtgagagaactacaggtgggtgaagagcaccagggaggcagcctctcagttgaaaaccaacatttgcgtgatgccctctcgtgagcccttctcagctcccagcagtgaagcccagcaacacgtggccctccccagcctgtgccgtgctgacaacgaccataggctttacttatattctaaaactcagaggtgctcaccagggtcgtgtacgcaagaaattaactcagactaaattgtcgagggacctatgagctcagtttaaaacanaaagacgaacagtgaaagcctattaggcaacgctatgtcgctggggctggttaactgtagcccctgctagggagggtgtcaggagcgcgctagaagtgagccttgggtctcgcaggcccagccctgctgcaaggacgccagggcacccaggaaacttcagcacacacacacacaggggaccctcccttcatgtcacttgtttggctgccctaaagggcttcttgcaccctaacccctgatcctggaaagaaggcagagaaactggcccgtacagagacctgcaatctctacgcaagcttaacacaactttgagacagacagaggggcacgcagaagaggtgggcaaaatgtggtccaacgggggggatgctggaatcctggatggtgtcca

SEQ ID NO: 603080 - DNA, 703 bp, Homo sapiens
tctgaatatgaaagaaaatatcagatgtgcactttaaatgagcttaattgcttgaagtggtgcctgagaatatcgaattgcctcctattgggtgtggctgtgttgaaatagatttgtactcgtcgctgtggtgaagatgatcagtatcagctgttcacagcaaatatattcccagcatgtcacttttccattaaagcagctaagttgtctttgaatgttccatcgttccgagtaagtattttacttgttttctcagtacatcagagagagcgtgatccccctacagctgtcacttccaaagtgttcctgtaggcataaatggtgttacagacactgaggtgcactcttggtttctgagcagagtcgtcatactggtttcctggtctctagggcactggggcagtgtacttcgaaatcaccgaacaggcttgcaattaagatcaataaggctgcagcaccatttcaatttacttgtccatcttacccagtagttatggtgtctggaaattcgttcgggtggttatgtttgcatgcttaagcacacatttgacaattaattatagctgtactaaccgatgttttgcctgggggatgatgggcttgtccatttttaaattctgatgcttgaattctatttctagtgatgttcacatctcccttaagtctagctgcagcaacttgagagagtactttgattaaatga

SEQ ID NO: 603081 - DNA, 3633 bp, Homo sapiens
  misc_feature (34)..(34): n is a, c, g, or t
  misc_feature (40)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (50)..(50): n is a, c, g, or t
  misc_feature (55)..(55): n is a, c, g, or t
cgagtattggcaggtgcatgagagcaatagcaanacaaanngnangnagnatccnagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacacctataacgataaaaaattcctaattgtttgtggtagtattttaattctagatgtgttatctctctgggaagtatagtttatagaaacacaaaatatttgatttcctgtgtcggttcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctgtatttttttcagttagtgggagagcagcagaaatagatagatgtgatgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggattttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatga

SEQ ID NO: 603082 - DNA, 1143 bp, Homo sapiens
  misc_feature (34)..(34): n is a, c, g, or t
  misc_feature (40)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (50)..(50): n is a, c, g, or t
  misc_feature (55)..(55): n is a, c, g, or t
cgagtattggcaggtgcatgagagcaatagcaanacaaanngnangnagnatccnagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacacctataacgataaaaaattcctaattgtt

SEQ ID NO: 603083 - DNA, 4341 bp, Homo sapiens
  misc_feature (34)..(34): n is a, c, g, or t
  misc_feature (40)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (50)..(50): n is a, c, g, or t
  misc_feature (55)..(55): n is a, c, g, or t
  misc_feature (3774)..(3774): n is a, c, g, or t
  misc_feature (3786)..(3786): n is a, c, g, or t
cgagtattggcaggtgcatgagagcaatagcaanacaaanngnangnagnatccnagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacacctataacgataaaaaattcctaattgtttgtggtagtattttaattctagatgtgttatctctctgggaagtatagtttatagaaacacaaaatatttgatttcctgtgtcggttcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctgtatttttttcagttagtgggagagcagcagaaatagatagatgtgatgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggattttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatgactgagatatttatttttgggaaagcaacgaggtaaaaattatgtttctcagatgcactgctactttggcgttattactgtgttctcagaaactcgttgtgcaccactaggaattagtagtagaaaaaaaaaaacaataacnaaaaaaaaaaancaactggaaatggatgtcttcacattaggggtggagtattaacaaccagaaagaaagtttggatattaccttttaactactagttaacatcatgcttgatcaacatttgctcctagttatcaccattaaattaagaccttaatggtaaactgaggttactgatgcatcatcacatttaagtaaaaataatttcatgttttccccaaagaaaaattaagcctcccaatcttaggatccaattgtgcagtagaattcagagacttctcattcaatcttgtatcctatgcagctacaaatattttttaaatgttagtaataaacattggaattttgtcttaaagagttcaaaaccttggaacccagttttctcactacgtctataaaggccattacagacccaaggctgttttgcagttttcatatgttgtttgctgaagtcattgtaattttttttgcctgctttgcctttttttctacaggagttttgagtgtgaaatgaaaattaaagtttggtacatatatttaaaaaggctagggaaaaaaaaaagaagagaa

SEQ ID NO: 603084 - DNA, 1033 bp, Homo sapiens
ttccgggagtgtggggaatgggaagatgagccccgtagagacgacagcagcattgtgttggcggtcttcgagccctctggacaatgcagcatgcggcagtcatcctaagtgggtcaggtggacaccctgctgaggaacttcctgccttgctacctgtgggcatgctggcagcgtcttgtccttgctggcatgatctctctgacgagctagggccctcatggatgcctgacctggaatgccatgttgctactgcaatgcaatatacagcttgcccctgatgtcctgtgatgcatcctgatggaccccttgatctccacatgctttcgtgtggccatcgctcatctccctgtgttgtgcaagcccgactcttcttgatggttcgttggcgttggggtgactgtgcctgccccttatggatgcttgggtctcatgcactaaccaaatgtcgatgcgcacattacttcgacacaccacctgtgtggcgtgcccatctttggcccttttggcgccttcaaaccaatgcccactttgaacaatgcgcattaactacctgccttcaccttggcatcttttcccccaatgtccggacggagattattccttcctggaccaatactttcttgcggatttgccttctaccttagcctcccttaggatcattcccgttctcgcgggaatcgaacccgaattaagctttccagggggaacactgaagggcccctttggaacccttccacctcgcatgttccccaatatcatttggggcggcgatacccacctctcggttattggggccaccgctttttgggcatcttgcgaaatgccgcccagtttattgactccgccccctctggggcgccctttcggtgttcttcgccctgtttgggcctgggcgcgctaatccgtccgcacccatttatacccctgtggtcccgggggaccataacgccctttcgtctgcgcttatttccgtttcttctgggtcaactggcgtccagtgcgccactggtggggaatctgcggccacccatcg

SEQ ID NO: 603085 - DNA, 157 bp, Homo sapiens
ccccaaagcgtccgaatagggtgccgacaataaacagacctgataccagaccggcttgtgcagtcgaagcccctagctcagccactgagtagccgacaatcacaatcaccagtaagtagaacaccagaaccagctggaaattcaccagactgatcag

SEQ ID NO: 603086 - DNA, 3004 bp, Homo sapiens
tctgagatgactgtgagcattgaagtgtggatttttgtctaaagaaataagcccaaatatcaattgtgtttccgaaggtaaagatgggctgaagcttacacagagcactgtttgccgctaacctctaccgttctctctccatccaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacacctataacgataaaaaattcctaattgtttgtggtagtattttaattctagatgtgttatctctctgggaagtatagtttatagaaacacaaaatatttgatttcctgtgtcggttcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctgtatttttttcagttagtgggagagcagcagaaatagatagatgtgatgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggattttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatga

SEQ ID NO: 603087 - DNA, 2901 bp, Homo sapiens
  misc_feature (6)..(6): n is a, c, g, or t
  misc_feature (13)..(14): n is a, c, g, or t
  misc_feature (37)..(37): n is a, c, g, or t
  misc_feature (39)..(39): n is a, c, g, or t
  misc_feature (45)..(45): n is a, c, g, or t
gttttnttcagtnnatctcaactgagacatagacttntntttttnttgtccaacatacacatagacatggaaactgagcactgagtggatggaaggccctgcatttggctccatagtacaaggcaagatcaaagtctcaagtctttgtccctaaagccaggcaagtgaaatgtacaattgcaatatagtatgaaaattgataatgattgcagtcatacagaatcctctagaagcccagaggaacagctcaccagcctgagggggtaggaaaacctgttggtcatttctgcgttggatttctttgatgtctgaaatgaaacccccttctccaaaggcaaaattcggagactttgatctttgctactggagtcctttaacaacacctataacgataaaaaattcctaattgtttgtggtagtattttaattctagatgtgttatctctctgggaagtatagtttatagaaacacaaaatatttgatttcctgtgtcggttcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctgtatttttttcagttagtgggagagcagcagaaatagatagatgtgatgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggattttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatga

SEQ ID NO: 603088 - DNA, 912 bp, Homo sapiens
ggcgagcgggctggtcgaggaggaggcggcggcgtggagcttgtcgtcctgttcggcggggcgggtctggcctatgccccgggcgcttgcggcgactgcctggatcctgtctccgacaggccggcatggctggatgcctcgaggaggctgactgagccccaggccatgggtcccctctcgcaggacgtggaacctggtgatgccacgaccctcgtctgccggcgcgcctgtggaggagatgaggccgaggaccccggaggcccgagactgggggaatgtgtctctgcccacgcacgacatgcacgcaagaacagagcacgggctcgtactgggacgaatatttcactagccacatgcaggacacctggggagcggttcgagaaaatcgtggtgcgtggatgcgatatgactgagtggtgcacacatgggcttggtcgctgtgaagtcagaagaggaagtatgtctagttttgtgccgagaggatgttactggttagaacagtagggccatttgacgggttctaggtagagcagatgtcagctttatgcggtggagaggtttggagtggcttgggggccgctgaggaaaatgagcctggcagtaacgagggggtagtccatatcgctggaggaaggtgaccaagttgctaggtaaacaacggcgttggaacatgggcatggaaacggtgtcgaattttatgcgccaagggagctggcaaagagtagaagtttgagagtcgcttggaagatgtctgagaatatgggacgcccttggtgagggagagggatcgctggacaagtttggttgggaaaatagcagatgcggaggaggatgtcatagggttgtgacacttggtgtgttgtgaatgggtcaatttgaggagcgaaaggatgcgagggaacgtgagcgaat

SEQ ID NO: 603089 - DNA, 200 bp, Homo sapiens
cacaaagctgcggatgaaggtgaacgagtcgagagaaccagagcagaggcagccacggggacaatcttcaccttcaggtcggcccgcctgaactctcagaggctagtgtcaacaggccctttctgatgttcattgtggcatacaacatcctcttccttggcacagtgaaccgcccctgaggtggggcttctcctgaactc

SEQ ID NO: 603090 - DNA, 768 bp, Homo sapiens
cccgctccctggtgcaaagcgttttggcgtcagcttcctttgtagaggagatgagtggaatattatgatgacaattttatcagaggaaagaaaacgagggctggatgcagtttataatagcaaggtcggactggtcatccatctggtcacagaatcgaacgttgtcttcgaaagtgtttttagcaagatgataagtaatagatgtataagcgtatagctccatcataaaataagacgatgcctgagatttggcaagaaggggcaaatatcgtgactattaatgattgataagcagcgcagtgagagaagttctaaccttttagcagtgttgcactagaaacgtggtataagcatgcgcttgcagtgatactaagcagatcatatgctcagtgggtgtttgagtgtgtgggcagttgaacaagaaagtgaatgttgctttagtaaaaatcggtcattccagccgtttctagtatagagatagctctttcttgcggtgataatgtggtgcacactatagccctcaacaagaccgtgttatgtccaagtgtacatctggcagtgtcgtaaagtaacagttgactgggttgggtcgttatttgcacagtatgtggcgtactatgttgcggtttctgtgcaatctgatttaactaggaataatttctcttgcccgcttatcactcggggatgtcacttgcaccccgatttatgtgtaggaggcactacaccattggtctccactactggccgcgataagatccaaactcgtgg

SEQ ID NO: 603091 - DNA, 284 bp, Homo sapiens
tgctaggattacaggcatgagcctctgcgctcggctgacaatttttacaattttttaaaaaaaattttttaattttttattttttattgaggcagaatctcgctctgtcaccgaggctggagtgcagaggcgtgatctcggatcactgcaaactccaactcccagtttcaagcaattctcctgcctcagcaccccgtgcagctgggattacaggcatgcaccaccacgcccaactaatttttgtatcttgagtagacggttttcaccatgttggcaggctggtc

SEQ ID NO: 603092 - DNA, 1034 bp, Homo sapiens
tttcggactaatgtgctaacgagctagcgtcttagatttcggcacgcaggctgggtcggatccacgaatgcgtagctttgccacagcatgcggcacagccgcataggcttgcccccccgtgccattcgggtgcgactactgaacacaaattgcacagccctaggacttgtcgtccgcgttgtgcgtcgctgccgaggctcacgagggcttgcttgcgctggaccaccctgctccgagaaatcttagccacgcgctaggtcggctacctccattcatcatcggttacttgatactggccgtcgttattacgaacgtgtcggttaggtcctctaacatatgctggtgttctgacaatgtgtgcatacgtgacgtcaacacagacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccaggtggacatcacccagctgtccactgccaaggagatcatccagcactttaagggctgccctgcggacctagtggtgtgtgacggggctcctgatgtaaccggtctccatgatgtggatgagtatatgcaggcccagctcctcctagctgctctgaacattgctacacatgtcctgaagccaggggctgcttgtgggccagatattccgaggccgggatgtgacgctccctcttcagccgcttgcggtcttcttctccagggtgctggttgccagcccggagcagcggactctagcttcgaggcctcgtgtctgtagggtatgacctcccagggcttatcccggcctgagaaccctgttgcccttctccatttacccttgttgtcccccgtattgccgtggacccggg

SEQ ID NO: 603093 - DNA, 691 bp, Homo sapiens
  misc_feature (49)..(49): n is a, c, g, or t
  misc_feature (87)..(87): n is a, c, g, or t
  misc_feature (153)..(153): n is a, c, g, or t
  misc_feature (156)..(156): n is a, c, g, or t
  misc_feature (173)..(173): n is a, c, g, or t
  misc_feature (184)..(185): n is a, c, g, or t
  misc_feature (191)..(191): n is a, c, g, or t
  misc_feature (195)..(196): n is a, c, g, or t
  misc_feature (200)..(201): n is a, c, g, or t
  misc_feature (208)..(208): n is a, c, g, or t
  misc_feature (244)..(244): n is a, c, g, or t
  misc_feature (248)..(249): n is a, c, g, or t
  misc_feature (251)..(251): n is a, c, g, or t
  misc_feature (260)..(261): n is a, c, g, or t
  misc_feature (263)..(263): n is a, c, g, or t
  misc_feature (269)..(269): n is a, c, g, or t
  misc_feature (275)..(275): n is a, c, g, or t
  misc_feature (280)..(280): n is a, c, g, or t
  misc_feature (282)..(282): n is a, c, g, or t
  misc_feature (292)..(292): n is a, c, g, or t
  misc_feature (297)..(297): n is a, c, g, or t
  misc_feature (299)..(300): n is a, c, g, or t
  misc_feature (304)..(304): n is a, c, g, or t
  misc_feature (330)..(330): n is a, c, g, or t
  misc_feature (349)..(349): n is a, c, g, or t
  misc_feature (359)..(359): n is a, c, g, or t
  misc_feature (367)..(367): n is a, c, g, or t
  misc_feature (369)..(369): n is a, c, g, or t
  misc_feature (375)..(376): n is a, c, g, or t
  misc_feature (380)..(380): n is a, c, g, or t
  misc_feature (386)..(386): n is a, c, g, or t
  misc_feature (392)..(393): n is a, c, g, or t
  misc_feature (404)..(405): n is a, c, g, or t
  misc_feature (407)..(407): n is a, c, g, or t
  misc_feature (411)..(411): n is a, c, g, or t
  misc_feature (416)..(416): n is a, c, g, or t
  misc_feature (420)..(420): n is a, c, g, or t
  misc_feature (422)..(423): n is a, c, g, or t
  misc_feature (433)..(434): n is a, c, g, or t
  misc_feature (449)..(449): n is a, c, g, or t
  misc_feature (476)..(477): n is a, c, g, or t
  misc_feature (482)..(482): n is a, c, g, or t
gagcgccgccgccatgtcctccggggctagcgcgagcgcctgagcgttngtagagcagctcaagtggaggctgcgtgagaggatcanggtctctcaggcagctgagacgtcaacagtactgtatgcagaatgcctgaaggatgccctgtgtgnggngttgtcccagctgaaantaacccccttnngggagnctannatcnngtgcttnactctgaagactcgagagaagttggctgaggaatgncttnnangcacaaggnngntgaatngactgncttcnangtctcaaagnaaaancnntttnccctaattttagagatattcaggccntttcctgtggcctggttcntatagcaaanatcacggntntcatgnngttnctactngagtgnngaaacctggtnnanggantagantttnannttagtaatanntgtggttttttgtgncaggtactttttataccttaggataannaaaantttaacaaccaagaatataacaaagaagtgcacccttctttcattagaggtgcagttacctacaggagtttctaatacactggaatatccattgtttgtgctgacatttactggcaattgtcacctttgaggacgggaaacctagttcctgtttaatttaaaccaactgaattctttattaagctgttgtcctgaaagtttatttttcc

SEQ ID NO: 603094 - DNA, 935 bp, Homo sapiens
  misc_feature (456)..(456): n is a, c, g, or t
  misc_feature (504)..(504): n is a, c, g, or t
gcggactacaagccccacaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctctatcatcctcacctgtacgcttggctatgtagacgctgctggaggaaacacctcangacacggcctacaacaccaagagaggtattgtggccagtattttggtnttcttatgttttggagtcacacaagctaaagacgggccattttccagacctcataccagcttactggaggtataggctctagcgtagagtagtggtctacgagctgtttctcatcttataatactacttccagactgtccaggacggccggcagtttctaaaagtatcgttgaccccaagctgggagtcccacttgccagagagagactacgggggaaactgcctcatctacgacccagacaatgagaactgacccctttacacaacatctgggacacagtggatggcttggtacccggcgcactattcattggctggtacctggaagaccctgatgatccgagacggggatgtgctgaacatcagcgaaatgtacggtacctggataacgccggagcacagtgccaattaagcgatgcgtggaccggccg

SEQ ID NO: 603095 - DNA, 322 bp, Homo sapiens
accaatgagcagtcagagggagaagtgcacagggcaagacccagaaggggcccaagcacgggagcttctgccctgaggagtcggggtgcacccccctcccagcacatggatgtggtcgccagctcagaagctctctgaaccccatttgttttttgttttggggtttttctgtctttttcctttttccagacccgcacccatggcatatggaagttcccaggctaggggtccaatcggagctgtagccacgggcctacacttcagccacagcaacgcgggatccgagccgcgtctgcgatctacaccacagctgacagcaatg

SEQ ID NO: 603096 - DNA, 169 bp, Homo sapiens
aagcagttactacagactcatatgaaactgagaatacaatgaagagagagaaaaggcaaggagacagagttaaagggacaaatggagaaagaaacagatccagagagatggagacaacttcaagtgtgcctaatgatcatatgtaatttgtaacttgatagaaagtgag

SEQ ID NO: 603097 - DNA, 404 bp, Homo sapiens
aggaccagacgttgctgtaggtcagagcctacctgtccgagttgtagccgaagctgcgtgcccggctgcaggagagttacgacaattccgcctcggacttcgtgaaggagaatgtcgccgcattcgtgaacatgacaccggaaaccttctctggcgtttatgcgaacgcgatcaaggaaacgcactggctgagctacacgaatttcggcgcgttagtgtccggctccaacttttcaaccgatgctctggcgaacggcgatacggacgtcttcataaacatcgacctcaagaccttggagacgcatgccggcctggcacgcgttgtgatcggctcgttcctcaacgctatctacaaccgcaatggtgctatgaagagccgaacattgttcctccttgatgaggcc

SEQ ID NO: 603098 - DNA, 896 bp, Homo sapiens
  misc_feature (228)..(228): n is a, c, g, or t
  misc_feature (303)..(303): n is a, c, g, or t
tagtggatgtcaggtgtttgtacgtgggtgtgtgtgtggatgtgtgtgtggatgtggatgtcagtgtgtgtgtggatgtgagtgtgtatgtggatgtcagtgtgtgtgtaggtgtgagcgtgtgtcaatgcggttgtgttggtgtgcgtggatgtgagtgtgtgtgtatgccctgacttggagcagacggggcagtggcagctcttgaagtggggcatatgccacagntgcccccacaggccttcagcctctccggctcaactggctccaagcagcattttaaacccacaggtgtccaccagnttctgctcccactgtctgagggacatggacagatctcgagggctcagcaggagaaggtctgaggtccaagggtggcagagggaccaggtggaggaccgccacttctccagccaatctcgggccactcagttccaggctgggcagccacagtgcccctcaggccagtgtcccagccaggcctgcaccccctcctcctgagggactccccgcctgcacggtctccactgcattgcatcccacggtccccaccaatgtctgtccgtggcagcgatgtcgggggtgaactcataggcagcagaggtgtacgcagcatccggtaggaccagcgaggagaggctgctatgagggagtcggggtgctgaggacaaagtgcctgcaggctgcacaccaaggcacagatgccgacctacctggcaggtccacgtatgggggatttataccttctacatacgtcactggacaactttcacatgttcgtaataaacatgcattacttttgtaacaagaaaaaacagcccgaatgacataaagatggtcagatgtcaggtcacaaccgaagaccaggatgtcgcaaagcccctgagaagcggccg

SEQ ID NO: 603099 - DNA, 471 bp, Homo sapiens
  misc_feature (433)..(433): n is a, c, g, or t
ccaggatgttgagagtttcattcattatcgcatgccccctaccccggccccacaatacctactgcgtgggatctgacacgtggcggctggtcaatgaatgaatgaatgaatggtcacaccatctgatgctctggactgactagccctgaaagctggaagcaccataattgacaagtcctacatttaggggcctttgttttacctatatgccaagacctaagcttaacaacactgatagggtggccaatacccaggacagcctgtgggaattacacataaagggagattcccagggactgggggcccaagctaaacactgaaaaatgcatctgtaggctcatagaggaaaagcccatgtctgtctgtattgcccaccactctctcccagcacccagaactgtcccaggacagagagcacttgacacacgttggntagattaatgaatgatttagagttcagtgcgccccaac

SEQ ID NO: 603100 - DNA, 203 bp, Homo sapiens
cgcggctgctggctgctgggctggccgtacctggctcgctaagagcggaccgacgattgctggcctgctgggcgcaacctacctggcagctctcggagcttctcacggattggcaaagaagaccggcgcctggccagcggtcatcaccgtgaccgccgctacctgcaccgcgtgccacttcctgtgcgacaccaaggcatgat

SEQ ID NO: 603101 - DNA, 638 bp, Homo sapiens
gggaaaattttctttcttgctcttagcagtatagagatgtgctctggtccttctcacttaacttctgctgcatccaaagaaggtaagaaaaaaagcagaacatataaaagcaactgaaagctttccctcaaattacctgggagcagtaacaagatattgtcagcggcggcagaaattactgaacaaggaggagagggcccgccagagcttttgacaccagctcacatgcagctgagggggcccactgttccacacacccccaggagcacctcttagtagaagtaaaaaaatcacagtgggttacagtgcaatattttggtcaatttctatgagaaagattattgacctgagaagttggtaacagataatgattactgaagaaaagtatttcattttataagcattgctgtctttaaaatccctctctccatttatatctatatgaatctgtagtgtagaattccagatccttggttgtgaaaggcgttatagagaggatctatttaaatccctttatatcatgtaaacaaggaaatggaggcccaacaagaggtggcttgcccaaggtcatggggccagtataagttgcaagccattcgtctgattcaactacaggtgctccaggcctcatctcacca

SEQ ID NO: 603102 - DNA, 301 bp, Homo sapiens
tcaaacaaagattaaaagtatgtatgtggcaaagcgtggtggctcctgccagcactttgggatgccgaggcagaaggtttacctgagcccaggactttgagaccagcctggacaacacacgaagactttgtctctacaaaaataaaaataaaaaaattattcatgcgtcacggtacatacctgtagtcgcagttgtttgggaggctgaggtgggaggatgacttgagagttcaaggctgcagtgagttaggattgcaccagtgcactccagcctgggcaacagagtaagacctgtccctta

SEQ ID NO: 603103 - DNA, 1294 bp, Homo sapiens
  misc_feature (158)..(159): n is a, c, g, or t
atgacactttgtctcgtctgctaggaatgcctcccagatcaattctcccaacccccgtctcctttggccagatgctgatgaatgtatttccctgttttttttttttatcctgatgcattatcatgaggacatggctacttcagttggtcttaactctnngcagtagcctggagatgggtgtgtggtttaagaaagggtaaaacttactgactggtagtatatatttgagaagagaaattgagcccagctctagccaaccaactttgaccttgtttgatcatagacttagccaagggattttacaccccatgcaacctgcccagcattcgtccagctttctggcttccattgaaccgtgatttctcagatctggagacgtgactgcaagtatttgagatccttggatacaatgtgtacgttatataaatcccaagtattgccattccttttcatgttaactgttccaagtgggatctcagaattagaccaaaacaagacggtggtaatatgataccttttattagaagacttttcactggggcgggggtggggggaggatggggaggggaaggaattgtagcagaaacagatgtatttttcttgtgatttttattttgaatcaaatattgtaaattgtgtataaatgaagatgctgaatagttctgtttccacttggcatttcaagtctgatatcaggtgtctgtacagggttttgatttctttcccttgtataactacacaacaatcctacagtgtaacatatggaatcattttgaatagacttgtgtgctataagctttcagcaggtcctctgtctctagaataagcatgttgtttattttcagataatcagaaataagtgtgctgacaagctggacacaatctgggtgtgcccagcttacctttctttctgatgtttaaattgaaggctgcagccaatggaatatgttcagctggttttccttggcttcctagattaaaaaaaaataataaagcatagttctttattaactttaggatattgttcataaaataaataaaggcccctgcactaacatgacaacatgcctcatggtcaccctctctatatgtacttactcattaaagtgtattttatttccttatgtggaaagcacttttataaaatcacccttttgaaaagaagtgggcacagagaaccccactcctgttcttttcctctagtgccattgtccatcatcaaaagggaaactcttagttaatcagatctgtacaaataaaattccaagtccatttgcttgttttgctatctaaa

SEQ ID NO: 603104 - DNA, 241 bp, Homo sapiens
aaacaaaagaccggcagctaggacgcgtgcgcgacaggaccacatatccgcggctcgggctgcgacgatggcggtcttgtagtcatcgctgacatacagcacccagtagtcgcccttggcaacgcccggcaacagtgatgtaaaccagttattgaattccacccacagcttgtcggtcttgcctggcacctgcggcgttgccgtgcctttggcctcttgccacttccagcgtccgtagcgg

SEQ ID NO: 603105 - DNA, 315 bp, Homo sapiens
ctacaggctaaacatagtactagaagacagaaggaatactcagagtaccaactagccagaatcccacagtcactataagcagacaataaatccaaataagcctagcctactacatacaaagagaagccataacagaagtcactagtagaccagcagcaatacagtaagactactactacctactagcaaaagccagcccaatatactaggtcacagaagtacatcatgagaaagacttaaaataaatactataacagaagaagaccaacagctaagcaagaaggaccagaaaaacaaggcaggtagaaatacccc

SEQ ID NO: 603106 - DNA, 252 bp, Homo sapiens
taagaaaaggaacgtttaaaaatgacactctcaccgtttctggaattatggaaaaagatcgaggtggtgcctgtggaaatcgagcccacagaggaggatctcaacttggatgtaggtccctccacagaagacagtccagaagaagtaactacacacgcattatcacactctcctgtagttggtgagattccacccagatggtgttgaagggggacattgaagcctgaaattaaatatctctgagcagttaca

SEQ ID NO: 603107 - DNA, 488 bp, Homo sapiens
  misc_feature (302)..(302): n is a, c, g, or t
cagcgccgggaggcagaggtggtagtgagccgagatcgcaccactgcagtccagccgggatgacagagtgagactcttgtctcaaaagaaaaacgtggaaattgtaaacagaggtatggcagacacatacagaacatccatactatatatttggttttccgtggattcagcacattaatatcgacgtattcaagtgcccaagagacatcctaagtttagtgctagcagcacatatgcaaacacaaagcaagtgtgttttctcatgctcttcatccagcatcacatataaccctcgttcccangttttatctcatattctagcaaaaatgttctcagtggcagcttacaaaaaaaaaaaatacaatttgggcctataaaagggagtggattcttttggtaacaccaccagctaaatgccatataccagctagggaagggatacgggtataatccaaactaaatggcaagacttttccttcaaaaagatt

SEQ ID NO: 603108 - DNA, 341 bp, Homo sapiens
aactaaattttcacctgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaaatacaaaaaaaatagccagacatggtagtgggggcctgtagtcccagctactcgggaggctgaggaaggagaatggcgtgaacccaggaggtggagcttacagtgagccgagatcgtgccactgcactccagcctgggcgacagagcgagactccttctcaaaaaaaaaaagtcgacgc

SEQ ID NO: 603109 - DNA, 570 bp, Homo sapiens
gaatcagctgatgggggaatatcttatggttgcctgtttctttttctttacttctcagaagactagggttctgtagtagtgtttctcagtagagtgctgtattagggttctcctcatacagtaccagtatgggatgtggcaagtggggttgtatatatgtttgtgtatagaaattgagaaagaggagatttttattgattggctcttggaatcgtggggactaacaagtccaaattccacatggtagaccagcaggctagtagttcaggcaagacttgctgctgcagtctttgagtctgaaccggcagtatgaaggcagaatccatttttccttgagagaccttagtctttaatcttaaggccttcaactgcactcggattcaacctatccatgtgtcaggggtaatctgctttactcagagtctgctggtttaaatggtaatcacatctaaaaatacttccagagcaacatctggcatgctgtccgaccagaccactagggcaacattctcctacgtcaagctcgacactccacgcatcacccagtccatggcctcgtcatccactccc

SEQ ID NO: 603110 - DNA, 259 bp, Homo sapiens
cactagatccctttgcgatgccaaaatctcaggctggaactttagccagcctcagctctgcttcctgaagaatggaagaccaccccgtaacaattttgtatttaccttaaagatgttacttgggggttacagactttgagactggccgccagactaaactaagtggcttaaccttgcccgggtcatctcctgtgatgcagcgtgaagcttgtaaacgggaaaagttcttcccacaagtctacagacagttgcagcgggt

SEQ ID NO: 603111 - DNA, 261 bp, Homo sapiens
  misc_feature (49)..(49): n is a, c, g, or t
  misc_feature (74)..(74): n is a, c, g, or t
  misc_feature (78)..(78): n is a, c, g, or t
  misc_feature (116)..(116): n is a, c, g, or t
  misc_feature (127)..(127): n is a, c, g, or t
tccgagagctgtctggggccaacgtgctggctgagtactactggctcanacgccgcctgctgggggcccctggnaatntaagtcctgccccgggctgtgccgccctcctccctganagccccctgcntcctgggcacagggaagcctccataggctagtagcatcacagtgccaggcccagagcttactggacttcccaaggtcctatgggactagggctgagggtacacatcctgcttttttccagaatataagttttgg

SEQ ID NO: 603112 - DNA, 337 bp, Homo sapiens
cgatgccttaacggtctgttaccgcaggtagccgtgggattggaatcaggaaggcgtcgtggccttgcggtgcatcgatctccaggtagcagacgtctttcttggcggccatcagggcatccaccagctcacgggagcgcgctggcgaaaagcgccagtcggtggtgaacgacattacgcagaacttggccgtggcgtgctcgaaggttttcgccaggtcgtcatcgtgattggcggccgggtcgaagtagtccagggccttggtcatcagcaggtaggtattggcgtcgaaacgccccgagaactccctgccctggtaacgcaggtagctttccac

SEQ ID NO: 603113 - DNA, 748 bp, Homo sapiens
agcggtcagacccatgaaacggccgggagggcaggagcgaatcgggccgccgccggcatggagctgagagtcgggaacaggtaccgactgggccggaagatcggcatcggctccttacgtgcacaacatctatctcgagtaacggacattgctgcaggaaaatgagtgttgccgatcaagcttgacatgtgtcaaaacctaaactaccctcagactccacgaattgaagagccgacaaatcttactaatgatgatcgcgagggatggagtgggtcgatctccacagccatcagatggtagcggggcagatgggggactacaatgtcatgtgtgatggagctgctggggccaacgcctggaggatctcttcaacttctgctccaggaaattcagcctcgatagcctgtcctgctgcttgctgacctaaatgatcatgtcgcagtctaatatcatttcattcacatacgatacttcatccatccgggattgtgaatgcctacgacatacttccttcatgtggcctggggatagaacgggcagaccatgggtagtacatcagtcggagcttcgaggcatggtgcgatggaatgtaccggggatgcatcgcacgctcgatgctaggagcatcccgctatattcggtgaaaaacacgtggaactgtgatgaggggaaggagctgctgataaggcctccattcgataacaggctaccttggggaatttgatgggtattcctccgtaaccactat

SEQ ID NO: 603114 - DNA, 242 bp, Homo sapiens
cagaaataaaagcgaggacatcaccatgtatcatacagataataaaagtattttagaagaatgttatatcaattaagatgagacgaagaaattaaatgaaagcaaaaaatcactaaaactgactgaaaaggaaattaaaggagagttccctgatggcctactggttatgacttagcactttcactgctgcggcccagattcaattcctgtctgggacctgagatcctacatcaagctgtggc

SEQ ID NO: 603115 - DNA, 1225 bp, Homo sapiens
  misc_feature (281)..(281): n is a, c, g, or t
  misc_feature (1225)..(1225): n is a, c, g, or t
ggtatcaaacgaagggagtacagtcgagagagctggtgtgtcatgactagcttccgtcgcgtcatccaactgatggaaccttacattgagatacaaagagcttagcgcgacgaagatgttgcgatccatcgtgaggcctctcctcagtaacttctctgtggccgcagtgccaagctgatgaacgactgaacgacccgcggccctaataggcttgcagtctatcgcgcttggcctgccatttggtacctacttgtctactctgacatcggcgaccttccatngttggacgactcctgacccgaggcgagcgatggcagtgtgacaaccgccattgacacctgtgtgctgaggagcaactcgactaactgcagcgacgagaggcacgcgagtatggcacgttcgcggaacgggacgtcaaccctacatgatgatatctccaggggagtcatgaatggacgcatgggacgagtgttactgctgggaccataggtcctccaaacggccaccacgaagctgcacgccactgcaaaacggcagtctatagaggattaccctcgatagctcgccttgggggctaacggagagcgaagcgtttatccgccgcgggacgggtagtaatccctttggggttacgaaacgggtagcaacgaggccaaactaggacccgacgtcatctatcggcccaatggagaggaatctcttccggaaagcacaacgcgagagttccatcagcagggcccgaacggaaacgaaggggttgggagccccctactcgcaaacggttccaaccgctagaaaggagacccctagcgacttccatttggcaatggaagaacttcccaacagaggagaacacccccaattgtatccgttcaaaacaaaggcagcactgtgacacactgttacccttccattttatccgaagaaacaccagccggaatccagcgcatacttgggcactataggctcaaattgggaacggttaccgggcgaaaactggcggcgggaggactgaagacactgggttcacatttccgacacgcgtgaactaccccgagggttaaaacggattggatggtttaccctcccatgacacgggacacccaggaagacccacggaggttaccataactgttgacggcgctgacagcaaattgtgggtggttctccgtcccccctgtgaaccttatcccttggcccacgtcgtgtaaacaataggaacacn

SEQ ID NO: 603116 - DNA, 920 bp, Homo sapiens
ggactagcgggccggccgggccaggacagcgggcgggggcggcgcggacctggccccgggatggctatgtccgcacctggtggcctcggtcaagagggagccgccgccgtccgtcggtcggcgacagcgggcttgaggctgcagttacaccttgcccaatctgccttggaggttctatcaccggcccgtggcccttcgggcagtttggggcccacaacgtctcgtggggggaagtggtctcaaagccctgccttggtggtttgcctcattcccccgtttgtgcccaatttgtgccctgccttgcctttttgaaccccaatagagggtggacagggcccaccccatgttgggatggacgggctcctcatcttagaaaagggcggccgtgtcgaaggttgcaaacaaaaagggtgtgccctcctggggcaaaatcatgagaggtgacaatttggggtctgtgcctgaaagggtccagggagcacgcatggccaatgggcccccatgttgcgtccccgggtgtgccccacattacgaggcttaatcccagagaaatatccccaaaggtcccatcatgagcgcgttgccgtatgggtgccgcacgtggacaggcggaagccgggaaagcacctgggggcaaagccacggaagagacccaaactgggggtggtgcccatctgtcgaatggcttggggtgacccagatacaggagaccaagttcctgcgctttgtcacgagacattccctagacccttcgtgacccagtttgcggaggcgtcaaggtgctggctgctctggactgaggaagcgacccctgcttgggtaggtccgcttgccgactggtggctacggggcagagctacgtaaggcgcgcccgtatagcagcggaagcgtccgagttatcgacacttggttttcgttct

SEQ ID NO: 603117 - DNA, 562 bp, Homo sapiens
  misc_feature (7)..(7): n is a, c, g, or t
  misc_feature (23)..(23): n is a, c, g, or t
  misc_feature (52)..(52): n is a, c, g, or t
  misc_feature (58)..(58): n is a, c, g, or t
  misc_feature (79)..(79): n is a, c, g, or t
  misc_feature (89)..(89): n is a, c, g, or t
  misc_feature (114)..(114): n is a, c, g, or t
  misc_feature (141)..(141): n is a, c, g, or t
  misc_feature (157)..(157): n is a, c, g, or t
  misc_feature (167)..(167): n is a, c, g, or t
aaaaatncttgccctcttaattnaatgtcctggttgttgttgtgtgtgtttnaaaaanaagtgaacttccccaaacccntctttagaanaaatagattgctggaaaaagccaanagcaagccaacaaccccaagccttcgnaaggtcctgaactggnaattggctcntgaagccccctctgcaagaggaaagcccgaagaaagggaacaagagggcaaaaccttcgggtaagaaagctccaagctcccggggccgtgtggggcctcgtgtagaaaatgaacccaagggtggctgacaccgtcgcccgcactggcttggggccaacttttagggagtcattttgcagctttatctcatttccctgctcctccaaaatgccagggcagcataagggccctccgcctcctgcgcccacacgcacctgtcttaaaaaacagagggagggccaggcaccatgctcatgcctgtaatcccagcactttgggaggctgaggcgggcagatcatgaggtcaagagatcgagaccatcctggccaacatggtgaaacccagtctctactaa

SEQ ID NO: 603118 - DNA, 502 bp, Homo sapiens
agccagtagccagggaagtacaagtgacagtctccccaggaaagagagggtggggtttgtctagaaaggaaatatttggcccaaatgtcatcctacatttcttatattttcaatgggtgctatgtcctgtgttcctcttatctgaaaatgtttccttttgtaatttatatgtagaattttagtaagtaggtttaaatgtaatccattgattctaggcaggaggaaacgctcaagaggcatctttggtgccaaggtaaacagctaaagctcaaatctttccctggccatggctagtagtttcaagttacaagaaaccaaaaacctctgaactctacaggaagagatgtctttgagtgcaaacatttctgaattcaaagtacacaacttagaggtaagctgactttatgttggaaacacctgtagttgtcttggtactggaaggctgatgcaactgggaggggagtatgaaatattgcagttagttaagagggagtctggagtt

SEQ ID NO: 603119 - DNA, 140 bp, Homo sapiens
cagacaggatgtcggacatacttcatgatgggcactgtgcggaaacttgacgatcgaaatcagtgacgctgcatgcacttgaaaggaatggcctgtatcctcacttgagagcaaggtccatcgaccacagccctgttctg

SEQ ID NO: 603120 - DNA, 303 bp, Homo sapiens
actttttatgtggcggcaggaaagagagcttgtgcagggacactcccatttataaaactgtcagatctcatgagacttattcactaccatgggaacagtatgggggatactgcccccatgattcaattatctccacactgccctgcccttgacacgtgggggttattacaattcaaggtgagatttgggtggggacacagccaaaatatatctggcttatgcaatctgatcaccccttccgtacttctctcttttaattgcaacattctgacagcatgtggaggcttggatggaaacccggta

SEQ ID NO: 603121 - DNA, 1333 bp, Homo sapiens
  misc_feature (1)..(1): n is a, c, g, or t
ntctccatgacgctcgtgctgcgtctgcttctgtatatttgtcgcgggctgtaattattttgcgcgagctactttggcccttcgcctttcttggccccctattcgctcatgggtcttcaagacgccgcggtggtcctcgcgtcggattctccccgggttttgttgcgcacacgcgcgcctttattatgggccccctgtgtggctctcttggctgggatattcccctcctgggggcaaccgccggttcgcgccgttgtcgcgcaccacctggtgtaactcttgtgtggtaatatgtatgggccacacaacggggttacacccctggtgcctttttaagaaaaacggcctggatttttggaggaaccacatagggaaaagtggttctgttttgttcccccgcgttgaaaaatggggggtcaaccctttggagaaacccccttttgccggggttcataatgttcctgcggtccttgaatggggaacggttgaggaaaactctctcggggatagggcccacacggcccgagagtccaaaagggggtccccccccgagagccccttcggggatatatctcataatagggggaaaaaaggtcgcaagagaggtgtaaaaaacggtgttctcaggccccgggccccccgtgtgtggccctgggttaaatatagaggctgggaagatttgttcccaacgagtttatacaaaaaatagatctactctctctacccaggggaaccccaaaaaagtggcacaccttggggcgcaaaataaattgggtgagacctgggaagatctttttccaagagcttaacatgtatagggtgggcgccccttaatacgttgttcctttgagattgcctgtgtgccacagggaaaaggtggtccccccgtttggttcactgctggttttgtgggggttgtggggggtaatttcgccaagaagtacctcacattttgagacactaatagggtccctcttgtcacgagaatcctctatccccacgagcacttaatatgctcgaggcacggaggccaccacatggagttgaattgtaatccacactcacccacattgagcgaatggccattgaggcgctatagctagccttaatttccactcacctaacgtgtttttgaggcttgctcttaacgttttaaagaggtggcccggggtacactttttgcacctgaaattctaaaaggtgtttttaaaaacacctctttcaccaccaaatagtcctttgtcacttacattatttactcatgtgtttgtacatttttgtatgttaatttatgaatgattttttcagttaaaaatacatattccaggaccca

SEQ ID NO: 603122 - DNA, 564 bp, Homo sapiens
gcctgtaatcccagctctcagggaggctaagaggcgggaggatagcttgagcccaggagttcgagacctgcctgggcaatatagcgagaccccgttcttcagaaaaaggaaaaaaaaaaacaaaaaaagacaaaaaaaaaataaggcggtaactttcccttcaaaagcaacaaccccttccccttccctttttggtataatttaataaaggaaagggtcgggttaaaaaaaaaaaaaaaaaaaaaaaaaaaaaatttggggcgcgggcctcgggcccccctggaaaaggtttttaaaaacaacttcgcgtgtggggcgcggcggcgggccccccacgagggctaagcgagcgaaagcggggcaccaaaggcgtggtctccacagaggagaaatgcggggtccaggacataggggggggggattctcccccaattaaaaaagagcgcgcggggggaaccgaggagcgggttgggaacacatccaagagggagcagtgcgggggccatagggggttcttacaaaggggggtccagagagaccgaatatcatagccccgcggggggc

SEQ ID NO: 603123 - DNA, 335 bp, Homo sapiens
  misc_feature (24)..(24): n is a, c, g, or t
  misc_feature (328)..(328): n is a, c, g, or t
caacaaaagcggacagcaacgcgngatccgagccgcgtctgcaacctacaccacagctcatggcaatgctggatcgttaacccactgagcaagggcagggaccaaaccccgcaagcttatggttcctagtcggattcattaaccactgcgccacgatgggaactcctcctctgggctttccatactcctcctctgatctatagttctgtttttgtgcctgtaccatactgtgttgataactatagctttgtagcatagcttaagactgtgagcctgatacctctcgttctgtttttcttttcaagattacccgcttttgtgttccggngatcctc

SEQ ID NO: 603124 - DNA, 1104 bp, Homo sapiens
  misc_feature (14)..(14): n is a, c, g, or t
  misc_feature (90)..(90): n is a, c, g, or t
  misc_feature (99)..(99): n is a, c, g, or t
  misc_feature (107)..(107): n is a, c, g, or t
  misc_feature (117)..(117): n is a, c, g, or t
  misc_feature (146)..(146): n is a, c, g, or t
  misc_feature (149)..(149): n is a, c, g, or t
  misc_feature (158)..(158): n is a, c, g, or t
  misc_feature (160)..(161): n is a, c, g, or t
  misc_feature (167)..(167): n is a, c, g, or t
  misc_feature (180)..(180): n is a, c, g, or t
  misc_feature (191)..(191): n is a, c, g, or t
  misc_feature (234)..(234): n is a, c, g, or t
  misc_feature (272)..(272): n is a, c, g, or t
  misc_feature (357)..(357): n is a, c, g, or t
  misc_feature (418)..(418): n is a, c, g, or t
  misc_feature (421)..(421): n is a, c, g, or t
  misc_feature (432)..(432): n is a, c, g, or t
  misc_feature (449)..(449): n is a, c, g, or t
  misc_feature (477)..(477): n is a, c, g, or t
  misc_feature (525)..(525): n is a, c, g, or t
ccccacagaacctntcccagccccttggacctgcaagttttactgagtagattggatttaagacaaaaaagcaagtccccccattgagtntcccacttntttgcccntgcccctctncagctttttgagacaaacacaaggagccnttnttttagttntnnttgatntgcttagatcttntgcctgtttantaggcatcgtctctccagccttgaggggaggcttggatttctngggttcctgttagtcaacatgggaggaaaaagcttttntttaaaaaattggacaatgttatgtgcgttgtgaagtgtgttgtgttagattttattagttttttggttagttggcgaggaaatnaaaaaaaaattccaatccttacaatctttcctcttaagcgactgcgctcttctcttcaccnccncctaaacacanagtttgacagaagaggngtttttatgttagcttgtcttatgaggnaatttggcctgtgtcttgggtgggtttattgggattgtggggcgatcnccttgggtttctttggagagcacgcttctttatgcttactcattagagatgggatttgacttttatttctttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccacccccttccccctggctccctagtgatgggacatatatgagagagaagtgtttttctatcatagacaccacaggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaaggaggaaatccggaattctggtttgttgaattaaggagtttaggcattgttaaa

SEQ ID NO: 603125 - DNA, 771 bp, Homo sapiens
cagtgggtcaagcatccctctgctcttggatctgctccaggctgtgtttagttccactggttggaaagctgtctctgtgcccggaccacagagcataaaaaactaccgctgtgtggtgagtcctggtgtctgggtggcagatcctccaccttggccttcttcaaaaacatcatggctattcttgggggcagtagagagaagtggatacaagcatagaccctgtcttaagacaagaaaaaaacagacaaaaaaaggcagcacccagggctcaggttcaagccgttagcccgctatttcccttaccacgtggcccctgcagttgcattcccggcctgagcttcgcctgagagccctcatttgcaacacggggtgatcagtgcccttctccacaaaacatggctggagaattaaatgaagtaatgattgcaaattacctgggcaaattcaccaacaaccagcggaacaccggtctgcacttttccttcccccgtggccacgacctgtgactttgggccagcattcagattgggcgtgggcagggactccattcgttgcagctggtgaattatgtgatgcgaccctgtgggtacaccagattgctgatccttgagcacgatggcctgtgatgcccagaacaagccgttcatggggctcacgttgcaagaaggctggctggaaaattcaatgccagagcattgctctgtgccaccagagacctctttgccgtgtctccaatgtgccccaaaagccccaaatctttggagcctccct

SEQ ID NO: 603126 - DNA, 131 bp, Homo sapiens
tgggatttcactgggatggtgatctcgttggactgcgtggctagcttgggcatgggggcctccacggtcagtgtcgtggttgggttggggtattcgtattcgaaagtgtccacacagtcaaagccagtgaa

SEQ ID NO: 603127 - DNA, 1037 bp, Homo sapiens
tatcatgttgtactgctaattgctgtccggacactctgaaagcgcgaacaccttccttccatgtggcataggccgtagactcgctaccttgcatcaatcatagcgtagcgtagggatgtcccttcaaagctaatcgcctgtggtgccaggggcacacactctaggtttacccctataggacacgaattggcttcgaatttcatggcatgctaaaagtcagatacttatgacagggaataaggtgattgtgttatcatataatcaagttagatagtgctcgaatggagagtcccgtggcgaagaagcgttagtgtgtgcgcaggctcaagttgcagactaatggtctcgccgatgtgagaacacccctgctttgagtgatctaaggtggtatatagtccttcccgagggaattatgtgggcccaggaggcgcctgtgctcgcaagatttgcatgggtgccatgtggagcctaagtcctagatggcgggtgcgccttcactcctggaacctttattaaccatgataccatggagaccgttactgggagactcacggattctttgtggtatagtgaccccaggtgtgaccatgcaagcctacgtacacggaggcactctatatgttagacgctaccttaccattgcggctgtgtaaccacagattctggctctgaactagtgtgggatggtcgcacatcccatgaaaacacacgaaggggaggcgtcagctccaccagggtgttctgagtagtgcggtgggattgcatgtcttcggggcagagctctggctgtcattgcggtgggcgaccgagtgctccgcgtgaaaaataacgcgattgaggacggtgcatgcctgtgtctgttaccttttaccagagggtcctggactgaagtctctgcctatatgaggcccagggtatggtgggccccgcgaaggcgtgcccccggaggcgtttcacgggggacctcggacgcccccggtgctgtttaactgttttccccaaggggttttggaccgggatgggggcccacgggccct

SEQ ID NO: 603128 - DNA, 374 bp, Homo sapiens
  misc_feature (76)..(76): n is a, c, g, or t
ccttttaggaacttccgtccccttccgggccccccccagccccccccccgggttcgggtccgggtccagctccagnttcggccccaaccttgggttcagcagcttcccaggaaagggcagagttttaggtgcctccccggccagccttccccaagggcccccggagttcccccggagacaactgccccagtgggggacatggctcggagggcccagcgcccggggcccgcccggcccccccttccgccccccccggtccttggggagcccccggaaggaaggggaggtttgcctgctcccccggggctgatttttttcttgcccccctgttttttgtaagggtgggtaattaatttttttgggccaaactggga

SEQ ID NO: 603129 - DNA, 273 bp, Homo sapiens
  misc_feature (26)..(26): n is a, c, g, or t
  misc_feature (48)..(49): n is a, c, g, or t
ggctggggttccctgtgcccaagggntaccacgcctcctctcaccccnnattcccaggtggcaaatactgcagcatctaggctactttctccaccgtcccgtccctcatgctcaaggccctacacactccctgacaaccggtagaaagacactattgcatagtgatgactgataacgcacacagctatgagtgaacagacaagtgccactaaaaacagacaagagaacacgcgttcaaatacaagcgccacatacgagggtaatatactaaag

SEQ ID NO: 603130 - DNA, 186 bp, Homo sapiens
aaaatttcccttttttttttttccccccccccccgttttggccggggggccttcccccccccggggggggggggggcttttttgggcccccccaaaaaagcccccttttccagggggggggggggtttttccccggcccccttttttcgtgggggggggttcctttaaggttttttttccccccga

SEQ ID NO: 603131 - DNA, 147 bp, Homo sapiens
gtaatccaatgtgggtttttttttccataattaattttgataccaaagggtgtgaaccaaaaataatttagtcacgtgaaaccttttttccagtcatagtatttttcattcattataataaaaggaactggcttttaaaaaaaaaaa

SEQ ID NO: 603132 - DNA, 359 bp, Homo sapiens
aaggaattaatttgatctaaattgaactttaaaatatctggtttttcttttttctttttttaagacggagctccccctgtcacccaggctggaatgcagtggcacaatctcagctcattgcaacctccacctcccgagttcaagcaattctcctgcctcagactcctgagtagctgagattacaggcatgcaccaggacacctggctattttttttttttctttttttagtagagatggggtttcacagttgatgaggctggtcttggactcctgacctcaagtgatccacccccctcagcctcccaaagtgctaggattacaggcatgagtcactgcgtcaggccaaaattctgtatt

SEQ ID NO: 603133 - DNA, 263 bp, Homo sapiens
tatctcattgtacggttgctgttgttctgctctaccagctctgtagaaactcccagacacttttcctatgtactaggcattttatttggattgacttacaaactcttcttactcattatcaatctcggattttttaagtggtgcagtgtaatgagaaataggtcaagtttctgcctctgattagccgcacagccttgaacaaatcacatttcatctttgaacttacctctactgttagactaggtgactcgtggaaatgtcca

SEQ ID NO: 603134 - DNA, 339 bp, Homo sapiens
  misc_feature (71)..(71): n is a, c, g, or t
  misc_feature (272)..(272): n is a, c, g, or t
  misc_feature (279)..(279): n is a, c, g, or t
  misc_feature (313)..(313): n is a, c, g, or t
  misc_feature (323)..(323): n is a, c, g, or t
ctgaggcaggaggattgcttgaggccaggagttcaataccaccctgggcaacataatgagacccccatctntacaaaaaataaaaaatttagctggacatgccagcgaatacgtggtcccagcaaatcaggaggctgaggtgggaggatcacttgagtcaaggaggttgaggttgcagtgagccacgatcatgccaatgcattccaacctgggcgtcagagcaagaccacgtctcaaaaacaaaacaaaacaaacttttatggttgaaagtnttttggnaaacatacttaaacttgaaattgtgaatctttgntggaaaggancatgttacctgtaaaa

SEQ ID NO: 603135 - DNA, 218 bp, Homo sapiens
ctttcagacacctatctctgctggcaaagagctttcttctcttgcttcttaaactttcactccaacctcacctttgtgtttacactccttaatctccttagaggtagaacaaagaactctggatgttatctcagactacgagagactgttacatcttggtgcactgctgagactatgacacttggtttctttgagtttgacttaaatattttacatga

SEQ ID NO: 603136 - DNA, 526 bp, Homo sapiens
  misc_feature (44)..(44): n is a, c, g, or t
  misc_feature (66)..(66): n is a, c, g, or t
  misc_feature (118)..(118): n is a, c, g, or t
  misc_feature (153)..(153): n is a, c, g, or t
  misc_feature (157)..(157): n is a, c, g, or t
  misc_feature (164)..(164): n is a, c, g, or t
  misc_feature (170)..(170): n is a, c, g, or t
  misc_feature (172)..(172): n is a, c, g, or t
  misc_feature (193)..(193): n is a, c, g, or t
  misc_feature (213)..(213): n is a, c, g, or t
  misc_feature (219)..(219): n is a, c, g, or t
  misc_feature (225)..(225): n is a, c, g, or t
  misc_feature (273)..(273): n is a, c, g, or t
  misc_feature (298)..(298): n is a, c, g, or t
ggggcctggaactgccggatgcctccaaggcctaaggtaagcgnccctcgtcactgcaactggctntcctggggatgagatgggatccctcatccaggctacagccggtggtggtgcnatccacactcccacaatctctgttgggaagaaggncacngagactntctaangntgccggatccctgtatcctcnggactctaatactctaacgntgtccntgttgntgattccagtggacgtatctctgtgaaaaacacaagccctttttgtantctatttgagcagttggaagtttantagctttccaaccaaccaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatccc

SEQ ID NO: 603137 - DNA, 209 bp, Homo sapiens
caactcgcgtgtccaatatgaaaactgggcacaaaccatgcaaagtgtggatttgtgtggagcacactttgaatgggccatggaaaaatcgagcagataagaatgtctttccagatcacacacagtatcatggaaatgagttccttctcacagtccgactatttgacttcatcagtattcggattggttccatcgcaactcaaacaatg

SEQ ID NO: 603138 - DNA, 1300 bp, Homo sapiens
taaagcaaaagactattttaatcccagaagttatctcaacagtgcattggtcttttcataaaaaaattacgtaaaaatccccccaggaaaacaaatactaaataagagtgaaatcatattttggaagcctctgaagtcatagccgagcaaatgaaccggcctccgggcctcgtggtggccaacagcgaagaatcaatcagcctggggtcaagggacaaacacttaggacgtgaacgtgaacccctccccatgaacacaagggtttaatccttatcctttaaaaacgagggtcggaaagtgaagaacgtggtcaactattcccataacttcacttaatactctatctctccaagtggttgggtacaaggtgccatggagtcaagtggttcaaacacattgaaagatcatagataggtgcaacgggtacactaactctcgactttttcacaaacagaatctactcttaagtggcccaatcttcagaaactacgagatagcttatacacacaaggcatacagaaacacaaattgtgcggcgacacaagactcttcaaaacaccacacccaggaaaaacgaggactacagtaagctataattagaggcgggatacaaccaaatacacacacccgtggacatctcggaccacacacacaaccacggccaccacacaacccctcagtggcatcaaccacccaacaagcgcacacatcacacacaaacgacatccgcccgacttacccccagtggctcaaaccactgcgggacaaaaacacatacccgcagtaaaagaactcgctcgagcagaccctcaccaccgccacagcgccagacacgacacacgacaacgaaagggggcctacccacacaacaagaataactagcaggttgcacccacgccacgaactatgcagggagagttacacccacacataggggggggggggaacatacaaaccggaaaacacatacagaccataggaaacaacggcaaccacaactgcgacattgcctcggcgagaacgtaaaccacatacggggggacattaaacaaaaagaatctacccgaggaccacaccaacaaaaaaacgaaagcaaaacaacgagaaacaaacaggacaagaacacacgcaacacacacaaacacaacacacaccagagaacaagaacaagccacacgagaccacaccaaaacaagagcagcaacagagaacaaccacgaaagaagactcatcaaaccgccgcaccacacacaacaaaagagaaacgctagagcacacacacaatcagcacaaacaaaac

SEQ ID NO: 603139 - DNA, 118 bp, Homo sapiens
cgtaacaactaactaatactaacatctcagacgctcaggaaatagaaagcgtctgaactatactgccggcatcatcctagtcctcatcagcctcccatacctacagtgtcctgggcca

SEQ ID NO: 603140 - DNA, 844 bp, Homo sapiens
gcaccatcagcatccaggatactggtatcgggatgacacaggaagagccgtggtgtccaagctggggacgatgcagatcggggtcaaaggcttcctggatgctctgcagaaccaggcgtgaggccagcagctaagatcatcggccagttgtggagtgggttctctactcagctttcatggtggctgacaagagtggaggtctattcccgctcggaaggcccggggagcctgggttaccaggtggctttcagatggttctggagtgtgttagaaatcgccgaagcttcgggagttagaaccgggacaaaaatcatcatccatctgaaatccgactgcataggagttgttccatgcgaggtccgtggtgcgagatgtggtaacagaagtacgagcaacttcgtcgagcttcgcccttgtactatgaatggaaggcggatgaacacctggcaggccatctggatgatggaccccagggatgttcgggagtggcaacatgaggagttctaccgttacagtcgtcgcatggctcaggacaagtccgccgtacaccctgtcgctataagacggacgcaccgctcaacatccgcagcatcttctacggtgcccgacatgaaaccgtccatgtttgatgtgagccgggagcttggggctcagcgttgcactgtacagcgcaagtcctcatccagaccaatgccacggacatcctgccaagtgggtggcttcatacgaggtgtggtgcaagctgaggacattccctgaacttcaagccggaattgtgaggaaacggcctctcagacctcgggaggttaacagaaggcggacaatctcttgaccggtaaaaaag

SEQ ID NO: 603141 - DNA, 1741 bp, Homo sapiens
ggtaagagcgtccctacggatgagcacggatgtaagaccgggccatctcacagtcttcctggggatatgaggctggagagtgattcacatgtctggtgcggtggaagtgtcgactcgagccgcgtactctcaaggctgatgcaaacgtacgagacgtggtggcagtgcttgggcatgcaacttgtatcagcacaaccaaccacatgggtagggttagctagggcacttggtggcgcatactgtgagaagagcacgattcgaaggagcgtacgcggtagccattcagaaaaccatagtacttatgctttgcacgtgactactctaggtgcagtgcatactgactaataaagcgtcgcttcgatactaaaagaacactcgggactggtacagactcttagaggatgggcaacggggccattaaacgcagagggataacgtgcttagggaagaatgtgggcaaggcgcattgaagggaagttgggcagaagtacacgtcgacgtcgtgagacgagagggaccgtttcatggcaccgcatctgaaccggaaagatagcatgccaaagggtcaatccctgcggtgcaatctggggcacagaagcgccatgtactggccgcccttgcattcaacttctttgaccgccctagcacagtgagagggcccccacaccctgtgacactggggcagcaatcgcgaggattgaaaaccgtgcaggggcgcacttgggtggtacctgaaagtaacagcctcgggagaagtagagagtgcgctgtcggacagaagggtggcttgggagcccaagaccaacgggtgtaccgcttgtgtgaacacaccaagagggtgcttgtgtgcggggccacggtggacctgggaagcatgtggacctccaggaggggaatccagatcaggggggagaatggaacacgacaaatgggagggcggagacacagtggtctataaccaaaagagggagggggctaccatcaccaaaactcaggatatgttacgaatgagcgccaaaagcaacagagcaatgaaccgcccttggaaaagaaacccaatcacggaaaggtgttccttgctcgccaacgggctgggaccgtgctaaattgagcgacggacaagtgaaggaggtacctagggcaacgggagtataagcggcatttcccacatggtgagagaacacgagaggccacgaggaagccagataaccaggggctacccaacaccaaccccggggcgatgtgtagcaacggacccaaggagagaaaatgcacaacatgaaaaagaacgacacggggggacacacacaacacaacgaggaacaaagagacaacgagtgataacaacgaaacacacaagaggacgccgaccaaggagacacagtgaaacaccaacattgagagaacgaagagcaatgaaaactcccacggagtggagagcaagactgcaccaacaagcgtgaaagcgagagacacaagacaagggaagaggaagagaaacagcggtgtgtggagtgtgaacaccacacgagagaggtgatccaccacgtaaacaggatgagaaaaaaaaaagaggtgaggaagagaaaaaaaaaaagccaaaacagagcaggaaccacgaaagaaatgacacaagaaacgaacaaagcagccgagacaagaatcaagaaaagacataagagtagtatagtaactaataggctgacaagaacaatgaacaagaaagacacaacaaaagatg

SEQ ID NO: 603142 - DNA, 1091 bp, Homo sapiens
  misc_feature (561)..(561): n is a, c, g, or t
ggatggcttaaggtgcggccccggtggggtatggaggtgacagacgacgacagtggaagagtcaggctccacattcagaggcatctagaaacgatactggcatcacacggcattacagtgatgactgcatgaatacatatgtgtctaagtagggtaacagacaacctcagatgcactgcacatgcattatgtatctgcaggataagcctcatgttcaccaggactaacagcatttagtttggcattctctgcatactttatgtcgcataccttaagatactaactagttatacatagaatgaactaagttaataatacatgagatcgagtggaaaaggaggggaatgggattgtgtagggagatggctgatctcatggatcaactggtggagcaacgatacgacgtatttcacacccatatggtcattgttgagacactatcagaggatcataattctctagtgctctggtcctttcagtacattatcatcaccattatctatgccacgtatgacatcgactactgtcctctttgtttcaaggaattctgctactaactanacattaaggcggccaagattatgagttacagttatcctgattaactagtaataatattcactagtatggacacactggtcagaggagaaatgactgagttatgcaataacaatctgcttgggcgcgatgaatctggaggaacacaggaggcttcacgccgcgagaagactaggtgctggctctatctcctggtacggcctaaaaatcgcaaaggaaggtcatgggcaataggtccacgcgcacagggggaagaacttcttgctcgcttgcttggcatgatccttcgggatgttggacacgacggctggcgagtagaagactcttccctttggaggaactcagaagggggttctacaaaagactattttgtgggcctacccgtaatatacggttgaatctataatttttttggaaggcttcttctgggggggaccaagtaatatgaggagaaggtttgagcttgcaattgaatttcatagatattagactagaggttcttgagccaattaaaaaagacagcaacaggaaga

SEQ ID NO: 603143 - DNA, 694 bp, Homo sapiens
aaaacgccaccatacccccccacttttgaacatcataaccctacaggttaaaagcaaaaatgcacataaaagccccagaaaaaaattgggctttatacaaaacccatacttctttcaaaagagccaattccttcatgcgttccgcgttaaaggattctcccactaaaaccccccaattaaattaaacgcaattaatctaatttccccctctctttagagaccccatcctcttcactccatacgtaaggtttaagacaaaaaatttctcgttagcgcatgccctttaagtcagaaacttcagtgtcctcaccttaaaaagctgtgcccttttctttaataaaaacctcgcaacgtttagtatcttaggggagtggtccccactactttgaggagtcccccggcgctacatgaattcgccaagacaccttattctcggcgttaaatgccactttacactttttttttccagagctttgttaacagtttttcacagtttttaataaaagccctgtacaagctattctgaaaaagcaccatacaagttaaaaactcgttctcctcccacccatcgtcataagtcgttgaaaaccgctaggtgaggtgtgacaaattttttccttgctgaggccccttaatgtttggcgactttaaatgaccaaaaaacaaaatacattaacccggcaataacctaaaa

SEQ ID NO: 603144 - DNA, 695 bp, Homo sapiens
ggggataaaaaagattagacgcaggcctggtggctcatgcctataatctcagcctcccaagtaggtgagactacaggcacatgtcagcatgctcggcaatttcttgtagtcttaaactttgctgtagagatagggtctcactttgttgccccggctggtctcaaacatctgggaggatcacttgagcccaggagtttgagactgcagtgagctgtgattacaccattgcactccatcccaggtgacagagtgagaccctgtctaaaaataataataatgaggctgggtgcagtggctcatgcctataatcccagtactttgggaggctgaggcgggcagatcacctgaggtcaggagttcaagaccagcctggccaacacggtgaaaccccatctgtactaaaaatacaaaaattagctgggcatggtggtgcatgcctgtaattccagctactcgggaggctgcaggcaggagaattgcttgaacccgggagacggaggtagcacgtgacccgagatcatgccagtgcactccagcctgggtgacagagtgagactctgtcgtcaaacaacataacgaaataaataatcagataataatcaatacatacaatacaactaccttgcaacaagccccctagatagactacgaagcctctgtctgcaacctgctgggggattcccaagatacccacc

SEQ ID NO: 603145 - DNA, 121 bp, Homo sapiens
cccacgcaacctctaacatttcacttgcactaaatctgagttcagctaccgtactgtatcctggaatcagagaagccctagtgttggggacaaaacaggggatgggccagtactggcatct

SEQ ID NO: 603146 - DNA, 346 bp, Homo sapiens
ccttgcctacattttaaaaacctaaagctgggcatgatggccccagcctgtaatcccagtgattcaggagactgaggtgggaggattgctaaaagccaggagttcgagaccagcctgggtaacatagctagaccccatttcttaaaataaaatagttaatttagccaggcatgatgatatatgcctgtagtcccaactacttggaaggctgaggtgtgaggatctttgagcccgggaggtcgaggctacagtaagctatgttctcccccctgtactccagcctgggtgacagagcgagacccagactcaaaaaataaaaataaaaaccctgaatattttcctttta

SEQ ID NO: 603147 - DNA, 251 bp, Homo sapiens
tctggcaagtggaagttcgtcaccagtgcatcgaccactttgtactggaagcccggatagataaagatttgggtatcgtcgaagaacggttcaatgagatcgtttttcgctgcctgagccgcgctttccagcgaacgtactgaagtggtgccaaccgcaatcacccggttaccgcgcgctttcgccgccagtaccgcgtctaccacatcctggggtacttcagcgtattccgagtgcatgatgtgatcttc

SEQ ID NO: 603148 - DNA, 260 bp, Homo sapiens
cccagctgtcgctcccgcttttcggcttcacgactcttttcccctggctgtggacctggctgcttggattggtctgatggagggcgatgaaaccttcccaccctctgtcagcgccagtggactcagcaccccatcctcagccaagtgcagcaggcctgtgctgatgacaggacccagatcacggacagcacggttgtagcgtattcttcaacacgcagcaggctgtcatcctctccaaaaagcaccttggagatgtggga

SEQ ID NO: 603149 - DNA, 1113 bp, Homo sapiens
gcagccatgatggaagtttgagagttgagccgctgtgaggcgaggccgggctcaggcgagggagatgatgatgactggcggctggcctgtggccctggagccccatctcatgctgcctgtgagcagccgctgggggcagctgccctcggggagcctggccggcctgctggctggcggcagctggctggcgtttctcgcctcctcttcgtcttttctaaccgtgcagcctcttcctcggcttctcctgaaagggaaggtggaagccgtgggctcgggcgggagccggctgacggcgcggccggcggcggcggcacctcccgctcctgcgagcggcggggcagaacctggctggcggctggccggccgctggccggctgcagctccagggcagggggtctgagtcgcctgtcaccattttccagggctgggaacgcctggagagttggtcatctccccttctactgcctccaacactggcggcggcggcggcgtgcacatccagggacccgggccggttttaaacctcccgtccgccgccgccgcaccccaccgtggccccgggcttccggaggccgccgcgcggagtgcagccgttccggaggattattcggtcttctccccatatccgctgccgacgttgccaggacctctggctgctgaggagaagcaggcccagtacgttgaatcatccagcagccgctgcaggacagccattaacctggctgcggtccagaagccatgcggcggacaagcagcgatgggcctcatgtaacggccgagtcacgagcatttcattctgcagaaagccccgcacagcagtctgcatcttctcctcttttcttcagcaaaggttccagagctagaggcgtcaccacacggatccttgcccgaaccacggcgcaaccccgcaggcctgcctcaccctaaccttgaccctattatcccgccactcctgccactgcatcccccgcagcccacggcgacagcccttgagcgccgcgcatctcacccccccacccgccccactcccgcggcaccacacgcaccgtcgccccctcgcccccccaccctccacgctctcgctcccccacccctgcccccctactttcctcc

SEQ ID NO: 603150 - DNA, 808 bp, Homo sapiens
ctttttccatatcagcaagaaagctgttttgcttccttatcatttgtgtgttcactagagtggtgcttttaatttcttttaagaatcttccctttgcatttacgccttggcttaactgtttggcacaagaggcctagctttcagcctgtctcagctttcaacataccttcctcactaaatgactaagcttatcatttctagccaaattaaagtgagagatgtgcaactcttccttctacttcaacaccatagtagggttattaattggcctaatttcaatagtgttgtgtctcaatgaatagagaagcccaaagagagggagagagacccaggaatggctggttggtagagcagtcagaacatacatacctttattaaacagtttgctgttttatatgggcttggtttatggctccccaaaacaattacagtagtaacatcaaagatcactgatcaccattaatggatatagtaataatttaaaagtttgaaatattgtgagaattaccaaaatatgatgcagataggaaatgaacatatgccattggcaaaaatagtgctgatagacttgcttaacacagggttgccacaaatcttcaatttgtaaacacatgcagtatctttgaagcacaataaagtgaagcataataagacaaggtatgcctgaataattacagcatcagcctaccttttagtcaggaaatatgttccctggagtggacactaaataaaacgtacgtgacagtgcagtttaactgtttttctatgtactaaaacaattacggattagataagaacggagggcttg

SEQ ID NO: 603151 - DNA, 127 bp, Homo sapiens
gcatctctgggtgcacacagagaagtacgagagcgagaggcgcctgggatctgagaggaggctgctgggccttcggggtgagcccccagagctagacctgagcaagcaggagacctgagcaagccag

SEQ ID NO: 603152 - DNA, 783 bp, Homo sapiens
ggaagatggctgaacgttgggctgcagtccaggcgagcgcggggactcggaccacagagcggcccctagctgcttgctcgggcagctgcaccacctgcacctgtgtgccctggagccacgtcgcgggaagctgcagccccgggtcaccgaggagctactggcgagtgctgtcctgagcacgctctaaacgccaaacccgactggacatgcttgtaccctactaccttgaactaacgcccagctggtgggcttgccgctgagccctgccagtggttgatgccggtgcacatacagccaccctctgagaactggcccaacttatcatacaaccgcgggactatggtagcgtgtacactagaccttgccacgcgccctgggacacacgacattacggcaatggcacaataagtgagcaatagcggtacataggcacggatgaccaggcccgggaaggggtactatacggctaacaccggacacatgtagaccccattggggcccccggtggcggacgctaataccacgcggagcatggaattatcaacccccccagaacacaggaacgatcacaggatatttgccgccataccagtcggcaggagcggcgatattggagtatgcgacaacggaaccgacgcagcagcgagtatcagcacactccagatttaggagaacagataacaacagcaaccgcacattggggctctgcgagacaccagaacgggaatccaacaaacggaggtgcgcaccagagcagttagagaccggcgacataggatcacg

SEQ ID NO: 603153 - DNA, 260 bp, Homo sapiens
cctccattgcattcctttcaattccattcgcattccattccattgcacttgattccactccattcccttccactgcattccattcgattccattccattgcattgcattccattccattggattgcattccattcgattccattccattcgaatcaattacatagcaatccattacattcgagtctattctattccgttccattcgatttcgttccaatccattcgatcccattgcattcgattccattccatgtcgacg

SEQ ID NO: 603154 - DNA, 228 bp, Homo sapiens
  misc_feature (76)..(76): n is a, c, g, or t
cgtccttcatcaactacccccagctgtctgaatccaaacttgttcattgtccatctcactgtcatgaacccttgtnagaaaaagacacagtgtctggggagcctggagatcttcacccaaatcaagctgtcactcattgtatgatgttgagcctgttaacatgtaatgggatgacctttcagttcctaccactctgatgtttatatttggtaggtatgatgaaggacg

SEQ ID NO: 603155 - DNA, 125 bp, Homo sapiens
gtgttacccacaccacagcccatggcaacaccggatccttaacccactgagcaaggccaggatcgaacctgcaacctcatagttactagtcggatttgttaaccactgagccacaacgggaactc

SEQ ID NO: 603156 - DNA, 138 bp, Homo sapiens
tctggtcgacctgaggatccccccggaaatgtagagaaagtatgacctctgttagaaagaatatgttcctcaagaccctttctaacagaggtcattactttctctacttttcctcatgtacaccacagttaatctaca

SEQ ID NO: 603157 - DNA, 102 bp, Homo sapiens
agactctagaagatcccccctcaaactgcgcccgggctggagtgcagtggcatgatctctgtctcactgcaggctccgtctctacttaaaatatgtgaagtg

SEQ ID NO: 603158 - DNA, 633 bp, Homo sapiens
  misc_feature (1)..(1): n is a, c, g, or t
  misc_feature (41)..(41): n is a, c, g, or t
  misc_feature (88)..(88): n is a, c, g, or t
natatttcaactcatatgaagttcagaacaggtaaatttancctttgatataaaagaatgagacaagtctgaagatgattctcgtgcngaattcggcacgagatttgacccagaattctcattgctgggtatatacccaaaggaatatacatcattctattataaagacacatgcacctgtatgttcattacctcactattcacaatagcaaagacatggaatcaatctaaatgtccattggtgatagactagataaagaaaatgtgctacatgtataccacggaatactatgaagccattaaaaagaaggagatcgtgtcctttgcaggaagatgggtggagctggaggccattatccttagcaaattaatgcgggaagagaaaaccaaataccaaatgttctcacttaaaagtaggagcttaattatgagaacacatggacacgtagagggcaataacatacactggggcctatctgagggtggagggtaagaggaggaagaggatcaggaaaaataactaataagtactaggcttaatatctgggtgatgaaataatcttccaacaaatccccatgacacaagtttacctatataacaaacctgcacatgtaaccatgaatttaatagct

SEQ ID NO: 603159 - DNA, 880 bp, Homo sapiens
gcggagatctcgcgggcttgacgtgcaactcggatgtgagaagcatcccccggtatcctctcctagtgtcgacagagatcgccacgtggctagaagttcaccatgtctattgctctcagatccatgccagggagatctttgactctcgtcgggaatcccaatgttgaggttgcatctcgttgcagcctcaagataggtctacttcagagtcgtgctgtgcccagctgggtgcattcaactggtatctatggaggccctaggagctccgggacaatgataagactcgtttatatggggaagggtgtctcaagacggctgttgacgtcatcaatcaataagagagctactggcgcctgccctgggttcgcaagaaactgaatcgtcagaggaaacaagagaaggatcgagcaaacctgatgacatcgatgatggactggaaccatgaaaactaaactctaagttacggtagcgaacgggcatatctagggggtagtccctttgcacgtctgcacaagctggtgccgtctgagaagggggtcacccctgtaccgtcacatcgctgacttgggctgggcaactctgaatgtcatcctggccaagtcccggccgtacaagtgtcatcaagttgcgcgtgtgtctcaatgctgcgcgaacaacggctgggccactgccagggagatatcatgatccctacccaggtagggtagcagcaatgacttcagcggaaagaacccattgccgccattgggaggccacaggttatacccataaaacctgtaagaccttgttcagtccacgggacgaacctatgggaaaaggatggcagccaatgtgccgcgattgaaagccgggattggatccaacattcctgaagaactaa

SEQ ID NO: 603160 - DNA, 808 bp, Homo sapiens
gaacgcccgcgcggggagccatggtgcgccctgaccccgccgccgccgcagctggcgcgcagcccccgacgcgccctgtggggacccggaccagtgagggaccctgccccgggaaaaggctgtggacgacctgggctcctgaccccgagttcatccccgctagcacccccgatcgccccgtgccgaacctggtctcgcgctcgggaagcccgtatccctgcccctctgtgtcacgccctggcagcttgtccacgaagtcgctgggcagttggttggttgaccattgcttgcagagacattggttgccaggtggactagagaggagtcaactgcattgcatgagggccttgctcattcctttgtgtgcaatacccagagaaggacctgtgcatcgactgcctgacattctcaaagaggttcccatctgaaggcttagccacttgtagagccatatagggaacacattataccatgtagcttaggcagcaacacgtgttttcagatgaacggacgcgctaaacttgccacacgtctaggccccttgagctcgcaagctcgaacccgcggaaatgtccaaacttattgctttaggatccaccacgggtcaaactcaccctggacaacatgtgagcgccccgttggaaaccggtggctcgtattgttgcgcccagttagcatacacggcagaaggcaagtttccttcggctcctcggcgtcagcgttgcttccacctatcccgggatggccacatcacgggcgcacgattggtggacgacgcgttggccctgtgcgcccttggcgtgtggcc

SEQ ID NO: 603161 - DNA, 216 bp, Homo sapiens
taaatgaaacaggaccctataatgtgaaatacgggaccgatatggtggcgatcgcattgacccatatcaccctgaatgtcctctatggatccagagcctccccagtaatttacctcttcattcaccgtattacctgttcaggatgaagtcctcatacgttgtctctgttctagtgtgacgtctaatcccatccggacactagtattctttggtaca

SEQ ID NO: 603162 - DNA, 490 bp, Homo sapiens
tgcctcgtggctgggacacctgcggcttccgaggctctccccgatttgcatgtcatagttctaactaaagtactagacccaatttgcttaattctttttctatgtttctttttttcctagagatggagtctcactctgtcacccaggctgcagtgcactggtgtgatcttggctcactgcaacctccacctaccaggttcaagtgattctcttacctcagcctccgtgtagctggcgttacaggcgcactgccaccacgcccggctgactgaaatctattaattgaaaagggttatcattttcacaggactgccactaatccatataatggtgtttatgcaaaataggagcagagagtgacccccttctagcatgatacttaatttggatctgccaggatagaacggtggcttacctgcgatataattcatatctggtaattaccagtgtacaatttttccccagcagccagacagttgcagcgtagaag

SEQ ID NO: 603163 - DNA, 1321 bp, Homo sapiens
  misc_feature (391)..(391): n is a, c, g, or t
  misc_feature (477)..(477): n is a, c, g, or t
  misc_feature (674)..(674): n is a, c, g, or t
  misc_feature (680)..(680): n is a, c, g, or t
  misc_feature (870)..(870): n is a, c, g, or t
  misc_feature (1104)..(1104): n is a, c, g, or t
cttaacctacaaaaaaaaaaaaaaaagtgctgcaatgatgaacaaagaattatacaaaacctactttggtatcttaatttgggaatttctggtcctattataaatatggaagtatccctatttcagaaagaacattattttggttaaaaattgaattggtacattattttaaattattgttatttttggcacaggttcttttttttctgatatccgtgttttgggtacaattgtgagaactcatcatagtatttaattttttaagttaattaaaagttaaattacctttttatataatttgtgaagtgtggttctcacttgccaaggccaattagttctctagaaacctgtgcctccttttatacaggtttaaaggggaatgcctctgtgnttccgggtgaaaaagctcttggtccctttttagagtgtcctcggggaggtgggattatcatacagattgaaaggtgggccattggncttctcttctccggtggttgtgccgtggtttctcccgaaatagaacttacattgttaacttaagtgtgaacacacgtgcttttactcttattgggtaagctatttaaagtggtgcgtgggacagctatgtgaacgtgcgtatatgtctgttgttgcctgtgtttgcagtgtgtgtgtgtgtgtgtatattactctcnaagacnactatgtgtctattgttctaccataggtgttgaacgtggtggttcttaaaaaactataagtggggcacacaaaaaccgtgcacaagtttgccgtgaaaaactatagttttaaaaggcttataggaacagaaatccctctttttaacacacagcgcatctttgcaactttgtttcccagtttgtgagaacncttctctggggggcagatttgagtcatatatttctccccacctcttaaaaaactttatctgctcttcctcaacaaaattcttcaaagggggggcccggaaagtctttcggaaaaaaacccaaccccaaaattggccgtgcggtcaaacatttctcaatcaaaagggggttaatttcttaacaccatcttattaagagaacgcctgtctgatgggggtatccactatagactacngtttttcacacattgtgggtcgagaacatgcggacatctggccccctgtggtggtggggcccccccaaaggggggtttaccacacggcactacatttattgtgggtacccaggcccaacgcaaactctttttaaaccccggaaatgtgtgtatccccgatgtaggggttactttacccctccatttgtgagttttccgagtttttaacaccatagtt

SEQ ID NO: 603164 - DNA, 264 bp, Homo sapiens
acactgctgaccacctcgctagattctcttgtctttattctggcatagcagcccaaggcgatctgttgctgcatcttagcgtttagagcttatgtttcctcctacctcaaaggtcagtttgtatgtgtgattcatgggtatctaattggcctagagtgttcacccatatcacgtataatattatgtccagtaatcgtaagtcggccattaagcatcagcttaacaccactgtcacagctcataaaggtggtatgactgtatgag

SEQ ID NO: 603165 - DNA, 126 bp, Homo sapiens
gttaaaaggtcaaggcccattcgggaaacttaccctaataaggttttgggctcaagggcctgaaaggctaaaatggacccttaaggagcccccctttaaaacttagggagcccgtaacctggcggg

SEQ ID NO: 603166 - DNA, 791 bp, Homo sapiens
  misc_feature (607)..(607): n is a, c, g, or t
ggcctatcaggtgtgggtcggtgcatccgagcgggtttgacggaaggagcggtggcgcacggagagaggaggatggaggcgggtggtgttcgtcttctctactcctacctaagttgttgcgcgctcatcttcctctccggtactacttcactatacttacattagtctggatttatcaatgtgattaggcacttaagtgcctagatcgatgttggctcaaaattaaacaagagtggcgtgaattccaggaattgtagttgggctcgataccactggtccctgtagttactgctcattgtcattcgcactggttcatcttccttctcaactatacctgtttgccacatttggaatattatatctgatacattggatggtgccgcgacgtaggtatacatcgggagtcgtttgatccagctatgaagaatactacaaatctggatggtggcatgctagaacgtcacacatgacaattgaagccattgatctaagcttggtttccacttgctctgcttcttcatgttatctttatagtatgatcttcgtctttgataagtgactgaagccgtggagaagccgatgggttcgaacgtctagccctagactnacagtgcgcagttgatggatgccacgagaacttcttaaatccatccttaagaaccgtgacctatatgcagtatatattttttcctcttgggaacaaaaaaatctatttttgctgttatttttaccatatacaggtttttaaaaacccattgacttgagtttctgtagattcctaggtgccttaa

SEQ ID NO: 603167 - DNA, 301 bp, Homo sapiens
  misc_feature (5)..(5): n is a, c, g, or t
acacnataccccgaatacaggctagcgtatatttctgcgtcgctacgatgtctggtgatgaatattgcttatgatcctttagtgagtagaaggacagagaagtaagccgagcgcctatttgattgtgtagtagggttggaaggtgattttatcagtcatgtgacgttattcctaaggcgttgtttgatcccgtttcgtgctcgaataggcccgtggagtgctgctagtggctgtctctccttaagtggtattatgcactgttctcgtccagactcgtgtgagggtcggactgtctattgcg

SEQ ID NO: 603168 - DNA, 337 bp, Homo sapiens
agcttaaacataaatatcagaagtgatgattatcatatgatacctcagtgattttaaaagccatagaagaaacttgactatgcctggtcaccttcttggatctgctgtctaaatgatatatatatgatgtatatgtgatatatgtatatcatatatatgtgatatatatatatatatcacatatatatgatatatatatgatatatgtgtatcacatatatatgatatatatatgatatatatgtatcacatatatatgatatatatatcatatatatgatatatattttttttaatgcaggaaagtatactttgtaaggagcagatttttttgttc

SEQ ID NO: 603169 - DNA, 189 bp, Homo sapiens
  misc_feature (162)..(162): n is a, c, g, or t
agtcacaatcccgtgctctacactgagctacgcccaccatattgcgtgaccaaataagcccgtctacagtggctattctgttgagcctcactgacgaccatccggccttcacgaaactttatttcggtgcgagatgatagagactcgaatctcttacacctngacgcgcgctggcatcctaaactccag

SEQ ID NO: 603170 - DNA, 249 bp, Homo sapiens
ttcctgcggtttacttacgccattctcctgcctctacaaaaaatttacaaattagctggggccaggcacccatagcattccttgaaatcagcctgggcaaacgtggcgaaacagtctctacaaaaaatcaaaaatcagctggatgtggtggcaggcacctgcagtgccagctaagtggggaggctgaggtgggagaaacacctgagcacgaaggtggcggatgcaattgagctgagatcacgccaccgt

SEQ ID NO: 603171 - DNA, 175 bp, Homo sapiens
gcaacactgtaagactcataggtcctaagattaggtagtagattgctataactaagggagctacaatactactttctagggaatgtctgttgcactgtgattgcctataagggcattcataggtcagggactacctcatggctgccaagctttctaatttgtactgtggatgacc

SEQ ID NO: 603172 - DNA, 360 bp, Homo sapiens
tgcatagactgtttaatgatcaatcagggtatttggaatatccatcaccttgcgtatttataatttccatgtgttgggaactgatatggtctggctctatgtccccacccaaatctcatcttgagttgtaatctgaattgtaatccccatgtgtccgaggagggacctcatgggaggtgattcgatcatggggtcggttcctccatgctgttcttgtgatagtgagtgagttcccatgagatctgatggttttataaggggctcttcccccttcactctgcacttctctctccagctgcattgtgaagacggacatgtttgcttgcccttccaacatgattgttaagtttcttgaggcct

SEQ ID NO: 603173 - DNA, 120 bp, Homo sapiens
gctcggtaccccaatgaaacgggaaatcgtaggctaaggcgcgaagttttcgtggctatctattccatgcagcgaatcgatcagcgggcagctaaccgtcccgtggctcgcgcaacagtc

SEQ ID NO: 603174 - DNA, 816 bp, Homo sapiens
taacttaattatatatgatcgtattaactcatgtagttctcaaaataggcagctgcttctgaagccagtaaaataaaattcagttagttattaaaaactaaattcctattagtaaggtaacacccatgattatcgtgtgcatcatactgctcttttgcagcatcccatcagttcatccagtccatctcctcacatatctcaattgcagtcccctaagaatcattttacaacccttttcaacacacatcacatcaacatcatccactctccatcgccctccatcaacttctcaatcatcatttcaatcacatccagtcaaacatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttctcagtactagggatgctttccaaaatatcactctttaacgtttactttttctagtgtgtgtctggaatccaaaggacatgaataagccactcataatttaatttcgagaagatttatcaactgtctatgtttctcactgcaaaagcttaattttggcaaggcaccaatgtctaactcacctatggttaaccatggctactttaccataggcctaagaatctggccg

SEQ ID NO: 603175 - DNA, 345 bp, Homo sapiens
  misc_feature (144)..(144): n is a, c, g, or t
  misc_feature (158)..(158): n is a, c, g, or t
  misc_feature (231)..(231): n is a, c, g, or t
  misc_feature (245)..(245): n is a, c, g, or t
ggccgggcctgtgcctgagagcagcctggggtcgggctgagagtccgcccagggtgggggaccaggaggggcatggcagagcctgaccctgaaggatcacttgcttcccatttgcagcagaagaaggtgggaccccagcaaggnaaagtcggcgggcntggaagtagagcggccagaaaggcccctcgaggcagagaccctccgccctcttgcacaccagggccgctcgtnggactccacatctnagcccccaaatctgtcaggggctcctcaagttctgggttgaaaggcatccgggctccccgcttgttccttgtgcttatcctgggctgtgaataagtgaga

SEQ ID NO: 603176 - DNA, 182 bp, Homo sapiens
aacatagagacctggctaggaagggaatattcatggtaacgagcaacaggggcgcgactgaagcatccttaggtgttcagctcttgggagctaggctatatgctcaacaaacgacagagctgaggctgatagagagtcaatgagcatcccaagagtacttattgcgtgaggtgagtcctgcg

SEQ ID NO: 603177 - DNA, 1189 bp, Homo sapiens
  misc_feature (6)..(6): n is a, c, g, or t
  misc_feature (806)..(806): n is a, c, g, or t
tgtttntttgtgtgtgatggtgagtactatgagggagagtcgagatagatgagaacaataagaaaatgcaatatagacgaggtacaaacgtcgtgtactacgtgtaccctaatatttgttaggagcggtgttattaacacggggtgtaacactctctcccggctttttctgtcacagcgcccccttgttgttgtcgcccccgtgacccccatggggtggcgctctcccccccgggtgttttggtgcgcgcccccggctaaattaggggggctttttcggagtatgtttcttcagaaccggggtctgtggggcccccctcccccccagggggtttcttccagggactctctttcgtggtgtatataaccggccgcggtgctgttttatttttccccccggggggcatatttatcacgccgccaccaggttgttggttgtttccgcccactagaggcgcccaccgttgctaaaattggccaaaaaggggtgtcccccttgggggcacacccacacaccgcgtgagggggcaccaaaataggtggtggcgtcctcgtgggagagaaaacaccttcggtgggagaccctgtggcaacaaagtgtgtctcccgcgtccacattgagggaattattgatccccccgttgtagtatttcccccctcccctcggggtgcccacaataagtaatcccgtggtgatgattcttgcctctcttgcgcttcctccacaagaggttgtgttgttttttctgccccacccggaggatggtggtgtgtgtggtgtgtgtggtgtgtgtgggagggtgggcncgccgtgtgtggccacaccgtctgttgttgtgatagagaggtgtggcgggcgggcggataccacccacaaaagaaggagccacaaagaggagaacttgttggcccaccgaggagcacgggtgtggggccacaagaaagactcgtcgggagagaacatcatcttgtggggaggagggcgcagacacacaaccaccactctgcgccacagctcccccccaatcccccaccgaagaagagccctcttggtggccccaccaatgggggttttttgtgtgtccccccccactgtggatagttttccggggaccccaacttgttcccgagaaaaaaaaaaatttttgttggggcgccccccaaaaaatttgtgtgttttttaaccccca

SEQ ID NO: 603178 - DNA, 270 bp, Homo sapiens
tctagaggattccctgtgtgcagcgctgcggagctgtttccatgaggaagcagagaaggccctaacactcaccgtgtgccgggagaagaggctgaggaacatgggaactgagagggggctgatgcgcttgaccaggaaggagctcagtgctgtcgagcacacccgggtcaccagattcaagtccaagcagctggcagcctgcgggcccgagggcatgtggctgggggcagcgccagctttctgcttctgctgtgtctcatgcacgcagcc

SEQ ID NO: 603179 - DNA, 386 bp, Homo sapiens
  misc_feature (216)..(216): n is a, c, g, or t
  misc_feature (298)..(298): n is a, c, g, or t
atacgctaacttggtttaacttggcttaatattttgattatttacctgtaattaagatttggttattcagtttgtccttttgctatcttctgagagaatggctttttatttacagtttattttatgtatcacaataaagttcatgagtaagtttaagggaggacattgtttttttaattggttaaagcatttcgtggatatgttaaagtatattgntgtagcaggtgcagtcagaaggatagttgaagctagaggggtgactcatatatgaacttacagatcatatttaggattttgnttttatcacattgggaaagtttggattgtgacacaataccactttttttttttttagtaagatgatgtcaattactacattgagtcct

SEQ ID NO: 603180 - DNA, 110 bp, Homo sapiens
gcggccgcctactactactactactactactgctcgaattcaagcttctaacgatgtacggggacatgtcctctttcaagttaaaagaataaaagacttccagccaaaaa

SEQ ID NO: 603181 - DNA, 146 bp, Homo sapiens
cggctggtactggtcccgaagtcctttggatcgggaacccctggcggaggcgatactcgcataagtttgcacggcgctctcaactcggcggccgggcgggcgtcggatcgctgcgctgcgttgccggccgtccatgacttactcgc

SEQ ID NO: 603182 - DNA, 147 bp, Homo sapiens
gctccttggcaaaactttgggctggtacattcgatgcattctgacgctgtatgtcctcttgagttacagtgagtgatgaggccacaatcgcagggtggatgatgtgctttttttgggctactaggtgtacaggaggcatgctgtcct

SEQ ID NO: 603183 - DNA, 106 bp, Homo sapiens
tccatctggatagttgtactcagaaacgagtgcagccatcttccagctgcattgcctgcaaaggatgatgcctctgcgtggtcgtccgacgcgtgaccggcatacc

SEQ ID NO: 603184 - DNA, 768 bp, Homo sapiens
gggacgcagttgcgtgaggggtttgtactatcctcggtgctgtggtgcagagctagttcctctccagctcagccgcgtaggtttggacatatttgagtcttttccccccgaggttgaagttgaccaagagcaagtaggtgatgggagaagccgtagtcccctgctggtcgggcgggaatttgtgagacagtattgacacgactgcgtgaaccgaggccccgagacgatgcttggctagtagcattttatcggaaacgaactcgttgcttatgtccatggggggaattggattcaacatgggaaaggccagcagatgcaggtctacggcacagacacgacatagtccactggtaaagtgatgtgcacaagaagttcagccaaatggtcacagccaaggattcgccatagttgatgctcgatgccacagctgaaatagatggtgtggtagtccaggtgatggaggcttctcatctaatcaacagagcaggcttggaggagattcatggcaaacgtgttgtctcttgctcctgaggaggtcctgttgcaagataaattctatgattcatcaatgatattcttcagataccacagatgaggtctgtaggtgcggtgttgtccactgagccctcaggcaggagtcctgaagaaagaagttagagggaagcctgaagaagagacagctaaacaccgtgaggtgcgtaccttgaatgattcctgggaaccttgctattgatccaggcagtttgtcaagtaatgagcttggaagaa

SEQ ID NO: 603185 - DNA, 954 bp, Homo sapiens
  misc_feature (822)..(822): n is a, c, g, or t
ggacctgtctgcttcaagggaagaaccactcttatccccaaactacagaataatgtgtgtacatacactgctgatacatagttctctatcaggaaaactagaatcgactgtatttatctccgcaggctattcgttcagagatggcctttggtttaaatataaatgttgaaatataaatgtcgtctggattgtgcctataacaatgtactctgtcagggattacggcttattaatgaagatcacagggttcgtatgctcctactaaacgatatcaaagcgcttaatgttgctgtagatgaggggtgactgtcacagtacaacgcaagactgggaccttagacatcatggtagaaactcaggtttgggacagaacaataccagtgtctctaaggcccaaatttatacttgcttaaaggacagttgtattatcttagtctgcaagagacatctagttttaatctcgtaatagctgttatcaagattctgtagtatgtggtacactaagaacttatgtctagttcaattgggaaagtgtacagagaaaatatgaatcaagctcgtgtactgagtcacaagtactctaggctggggccaatagaagactaatgttccttgaatgttgtccaggaaaacccctggcttgtttggctgacgctattgaggggcatgtcccctttcggaagcccgtgaaggaagccacgtgagatggcctagaatgtgcctaggtgctgcggccggagggtggtggcctgacccttcacctctggtctttgctggccccgaggtctaggttgtcgcggcccccaagctatgagctaggtnagggcgggttggtgaaacaaagacccttgggtaatccacggtccagggctgaaagggggtcttgttaaggggaacccgccgcgggggcccttgtgtgtggggcccttctactttgttcccttttggcgagtt

SEQ ID NO: 603186 - DNA, 715 bp, Homo sapiens
cattactgctctctatgcttgagaccgggaggatcacggctcagataacgtgagctctgggcgcatgagaggtgtacggtccagcaaggtgtgtggcgtgaactgtacagatcaagtcagagctaggacagtctggcagcagtgacctcagtgagggaaccatgtccgtcgtacccgtctcgacgcgtctagtgacacctccccctaccagaccctgcctcttcctcgctcctcctcctcctgtgggaggtggtcagtgggacttagggatctttcagcctgctgtgccccagtagttctgatcgtctgcttgtggagcagccgttaatatgttcatccctgtttactgaaggacgcaaatacgtgggtctgtggtcagacaagcttgccagtgtcttgctcttgctacctccgctaggttaggtgggaaattcggagtaagggaactgtaggcgcccagcatctctggcaggtatgactgtcattggccacagaataactgtctctaagctatccatggtccagtgggtccctgccatgtctgtagacttcagagagcacttctctcttgatggggttcgtgggaacaggcgtgggcgtgacttgcttggtggcctcattccatgtgtgcctgtgcctggggcatggacttggttaagcagagtcagccagtgaggtcctcattctccaggcagctctctgcctggagaatctg

SEQ ID NO: 603187 - DNA, 453 bp, Homo sapiens
  misc_feature (268)..(268): n is a, c, g, or t
  misc_feature (344)..(344): n is a, c, g, or t
  misc_feature (347)..(348): n is a, c, g, or t
  misc_feature (401)..(401): n is a, c, g, or t
tcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgnccgagacactcacagctttgtcatcagggcacaggcttcctcggagccaggatgatctgtgccacgcttgcacctnggnnccatctgggctcatgctctctctcctgctattgaattagtacctagctgcacncagtatgtagttaccaaaagaataaacggcaataattgagtcctcaaaaaaa

SEQ ID NO: 603188 - DNA, 113 bp, Homo sapiens
tcgatgttggaccagccagcggcggcccaggacgtcgtcggcggggcacagctcctcggcgaaggtcaggtcgaggtcggccatctccttcatcgctcgcgcggactccgagg

SEQ ID NO: 603189 - DNA, 313 bp, Homo sapiens
aaacaggacatggattagagatatggccagaagaaaaattaactttaaaattaattaagaagtacttcacggtaaaatatggggaagtattaataccatctatacggaaaacagttgtctgtgctcaagaactacattggctctagataccagttgtgaattttatctctgggcaaggtttggtaattagcagtaaagaagtagcgtgaacacaaattgagactataacttttggtatttttagatacagatcggggtttcaccagtgttagccaggctggtctcgaactcctaaccttagatgatccacccg

SEQ ID NO: 603190 - DNA, 1009 bp, Homo sapiens
  misc_feature (998)..(998): n is a, c, g, or t
ggcggggggaggcggagtgtcgctcgctcgctcgctcggtcgctgactcgccggagcgcttctgtggccggtcggcggcaggtcggtcgcgagagcgggctctgtggaatgggggcgatggctatgtctgcggtggcatgcccggatgggccggcagggccgggagtaactgggacgtcgccgcggagcttcttcccccaggatacagtgctggccctgagctggagggcctgtgtgctgcctgccctcctgatcttgaagagccctgcagctagcgcgggagccctgcccccggcttgcagcacctgggcacctgacagcgggagctgacaagcccaagccagacccgggcctgggctgcgtgcttgatctaaccacagccaggcagggcgaatacttagccacctcttggagcacggagctccttccccaaaaggacatgaagctattgggagaactcgaagctttgaaagccaatcaactcacagcttgactgtggggagaccgggaggattgcccacatcattggcagcgatttgaagagcctactcatgtaaagatggcagggagaaagacaaacaacatgttcaagcaagttctgccagggaagggccaagccccaacgttgctggaggcactttctccacccccaagaacttcaggactgagcccccagcagatcagcaaaagccaaggcggtgaggaaggatggcccctcagtgacaaggtggagccgcaagaaccttcttctaaccttgagttgcagcgctcaatgagtcctcaggcctgataatacttaagacaggccgaggcataagtaggcgggacacaagccttagcttggttgtgaatgagcactgaggctgtccaagtgtcgcgagagctaggttgaaccagttggaaccggtggaaaagaaatgctgatagatgagataaagtaaccaaaaggaacacttcggagagagacgcgtctacaagtttcacaagggcgagaggcncttaagcaaaa

SEQ ID NO: 603191 - DNA, 270 bp, Homo sapiens
gccccggaactaaaatagcgagcgtgttgagcgaggattcagcagctgggcaattatctaatgaggattcaggaaattttttctttgagattgccaagagagagcctcagaaagcaacttctgatatacattatgccactccataaatactaggatatatacatttaactaccacacaacctacaaaaacaaaacattttataaggatatctgttatctaaggagcatcgtactggtctctagagttcgcacagtcagtcagatttattc

SEQ ID NO: 603192 - DNA, 139 bp, Homo sapiens
gaatacagcgtccatcagagctggtctgcacactcacattatcttgctatcactgtacaccaactaagtgccaacagaacggtttcgtaatagaattatagctgtatctaaaaaaaaaaaaggggggatcctcttagag

SEQ ID NO: 603193 - DNA, 112 bp, Homo sapiens
tactcaaaacaaataatatcaatacacaacactaaaggacagaaactaatctactaatacaagtatccttaatcatattatattagccacaaaactaacactcctacggact

SEQ ID NO: 603194 - DNA, 263 bp, Homo sapiens
ggggggggggggggggccccccttttcggggataagccccttttttcccccccccgtggggggcccggggggggcccctttttatttttaattttttttggggggcccccccgggtccccttggggatcttttgtttgggagaaaaacggggccccgggggtccttttttcccccccccctaaaaaggggggggttttggggggaaccggttttttgcccttttcccagggggggttttaaggggtgggggttctttttttta

SEQ ID NO: 603195 - DNA, 142 bp, Homo sapiens
tcagaggattacgaggtttgaacccataacctcatctcactgatgaggaaattgagacctgggaaaatgttgatttttcccagttaaaacacagctagttaggaataatccagtttcgaagccccctgtgtatattctcatc

SEQ ID NO: 603196 - DNA, 1168 bp, Homo sapiens
taaggtttagagggggaatgctggaaatggtaaggggtatggaacacaatatcatataagttaagtgctaggggtgcaggtggctcggaagtttatttaacatagaggagggtgttatgacagtgggctcgctcagcggaaatcgggggctatgcgtgtccgaaattccataagacacaccgggagaggctcacacacaagcctacgggcacatggggagaacaaaaaaatagagctgcgagagtataacagctcaccaggggcacaagagagcagacacacatagtggagaggtccccaacagcgaccacaacgcgccaacgcgagcgaaagcacagagggtagtgctacacacaactacataacaaacacaacacagtgccacaaggggtgcgcaacaatacccagccgccccatacacaaacacaccacacacaccaacacagcgcgaccacacagaggcgggcaccaccaggaacgagaacgaaaaacatcaccgaacaagcacacgcaaaaaacacaaaaaaaaaaccaaaaaaaataacagaaaaacaaaaccaaccacaaataagaaaaaccaaacgagagaacaaacaaagaggagggagaaacacccagggaaagaaggggaacacaatccacagacacaaaaacagtagagagaagaaaaaacaataaacaaaaaccaacaaacaacaaaaatggagaacacacaagaggaagaacaaaacaacaaaccacacaaaacacaaagtcaacgctaccacacacataccaaaagaaaaaaaaacttgtcataaaacaaaaatagcagagcacaagataacatacgaaacatacactaggagagagcacaaggagaaacaagagaagaagctactctaccaacagaacgacggacaacaaacaaaacacacaaactagaaaaacttaactacaagacaaacaagaagcacataaagcaacacatagatatgacaaaaacagacaacaagtaaagaaagaagaaggaaaataagctacagaagagacaacaacacaagaaatcataacaaacagacaagacgcacaacaaacaaaagcactcaaaggggagcaagctaaaaactaacgtgcgaaaccataaaagaaacagaaaacgaaacgcaaccaacacacacaccacaca

SEQ ID NO: 603197 - DNA, 349 bp, Homo sapiens
cgatcccccctggctgctcaggttctgttgatcacggatgagcaccttaatgtaagtttctttttgtgcaagcctgaatcactttatattttcgtcatattatgcatacctcttcttgacgaatgtgagccttcccttttaaagtctattctgtcatttaatgtgttgaattctgagaattcaggaagataggatttctgcttcttgtacataattgttctacaggaggagtggtactttgtagtgtatgggtgtcagggcatccacgtatttttacttttggggtagctgtatcaacatttattccagttagcctcactttaatcctaagacctgagcaagccaggga

SEQ ID NO: 603198 - DNA, 1882 bp, Homo sapiens
  misc_feature (389)..(389): n is a, c, g, or t
cagagcgagaacgaacccaccgtgtactgatccaagtctggtggctgtccgtgtgacgagtctccgcagatacgagacgatacgtaacgtttcgctgactgcacaggtcttacagggcagcccagcgcaatgtccacgacatgagcaaagggacatgagaggaggagaattcatacatgagagccataaacatccacaaggggatggaagggaacagatatcagccataagaggcgaatacctccgcaaggtaggtcagtgactagggcattgcgtgcgctacctatagacactagttgtccactagtacacctaacatatataggtctgccttgcctaagaagaatggtgtcacgaggataagtgctagcacccaaatcagtggacangcatggcgtagataagctgtgtatgtagcgtcgtacagacagatggtggatagctagacctccatgactcggagaaaaaatggcacgcatttggtctcaatataaccacaatgatcacagagggccagcgatgtaggaagaggctgttaacttgccgtgctagaggaagtaatgtgggatatgtttgtaaagttcgatgttgggcctaatcatggtcagaaataagaccatggattgtttaaccatgttcttggggatgaaacattgatgaacaagctttattggaataaataaagttagtgtgttattgagatcctaaatcgagtctttgtgatagaggcatacgtggtgaggaccactgtctatcgatgaaagaaggttattttaaacagggttaaaggtcttaaagatgatcgacgtataaggttgagattgggggacatatccatgggaacaacgtacattgtaaactgagggaaaggggggtaagcgtgaggcaaaatgaagggcggatttcaataagttagcaaacgtgatagatgacgagattcaatggatacaaaacattagtagaatggccgtgggtaagtaattaactctgggggagaagcaaatatctaataaacgttaatataagccattctgtgacaaaacgcggttttttataggacataggcgcagttttatattcggttccgaatgtgtggcttccccccaatggaagaaaggacgtattggagagaattgaccaacgtggagggaagtatggaaacaaaacgagtttaattgtggcgaattactttaggcagacaacattaatgggacacgcttgcgttggggggcatctttacaacgacaataacccagggtttcgaggcgttccatttaagggttggccactctacaggggggacgcatatatacgccgctacagtacttacagcagcaaatagagcataaagacggaccccgctgtttatagcgcgaccaaaacctaatcgagatgatgagacacacaccctggaacacccaaataagagacagatatggcgactaaccacacaagaggtgctggcataagaagcacaggcttggatcagacattgtacagagggtatgcccccatgtaacaacttggtgaccgtggacacgaccaaaagggcagggagtgaacacaccacccgagaagactgggtgggccacctaaggacaacacgacgcagtcacgactacgccgtcacacggcttcatcacaaacagaggagccggcagctagaacaaatgatcacaacaagcaacaacgaagagggaccgcagaagacaaaccgtagtacggacacacagccaagcggagtcaaggacgcgacacgcacaccagacgaacagtaagcaacgacacgaacagtaaacagaagaagcaaccgacgagcagaagggcacgaccaaatatgttaaattagtattacattcagatactacatccagaagcgcgc

SEQ ID NO: 603199 - DNA, 498 bp, Homo sapiens
  misc_feature (2)..(2): n is a, c, g, or t
  misc_feature (31)..(31): n is a, c, g, or t
  misc_feature (40)..(40): n is a, c, g, or t
  misc_feature (476)..(476): n is a, c, g, or t
  misc_feature (498)..(498): n is a, c, g, or t
anctttggtagctcagcacgtgtgtgtactnacatttgtnctcaatacatacaattcaaaaatggttctgccctaatataatgccaaagatttcaccccacaacttaaaactttttcaaaaacctctttccccacagttacatcctgtaattgtatctagacctaaatctagtatttctctgtgtgtatattaatttcagtagatctgggccgggctcggtggctcacacctgtaatcccagcactttgggaggccaaggcgggcggatcacgaggtcaggagttcgagaccagtctggccaacatagtgaaaccctgtctctactaaaaatacaaaaaatactagccgggcatggtggtgtgtgcctgtaatcccagctactggggaggctgaggcaggagaattgcttgaacccaggaggcagaggttgcagtgagccgagattcggccactgcactccagtctgggtgacagnaaacgaatccgtctatatggtn

SEQ ID NO: 603200 - DNA, 740 bp, Homo sapiens
gagcgggttcttgacaatcagtggacggcgcccatggtccgtggcccggaaagtgctcgacctaataggtggagaacgaggagtagaggagccgaaggccagagtctgtgagcagatccagaccatacagagtaaaaaacaattagtttaactcgtagtctggagatttacatccggcgttatgactttgagggccttcatcacacttctgaacgaatgcgcttctgatattggcagcagcttgggatttgcgaatgaccatctacttcgtgacacaatgacaagactaagactggtgtggacaagaatgtcagtcaaagtgcggacacaggagcacgtaagttcccggactgtaccaggagagcatcttacaacgtgccaacgggacacacggtgggacgacaaccggacgtatacagttgcgaagacgaagaagaggagtgtctgagacacactgggtggcactcaagcgacatacacagagacaacaggcactaccaatagagtttcagaaacgccttgagtacacattcgaaggccacgacattttaccgatgccgtttccactgtatcgcctttatccattccttggtacagcttggacacacttgtggacacagtgattgcgagtggttcttacaaaccaaatcaaggcgcagacgcaattagaccaacggggatcccacagaaagaattggacgaacggcgatttgccaggggtccaattcaacgacaccaac

SEQ ID NO: 603201 - DNA, 861 bp, Homo sapiens
ggggtgaccaaaaagagagaacaggagaaggcgagtataaattttttatttgttctaattacaaacaacataatttatccataatagaaggctggttgattacatttaacacaggtcaatgaaagataacgaaagtccttccttggaacatacctcaaaataacaagagccatttacaacaaacccacagccaatatcatacggaatgagaaaaagctggaagaattcctcttgaaaaccagcacaagacaaggatgtcctctctcaccattcctattcaacatagtattgaaaactctggccacagcaatcaggcaagagaaaaaaaaacaaagggtattcgaataggaagacaggaagtcaaatcgtctttgcagatgacataatcctatatctagaaaacctaatcatctcagctcaaaagcttattaagctgacaagcaacttcagtaatgtttcaggatacaaaatcaatgtgcaaaaatcactagcattcctatacactaacaacagacaagcagagagccaaatcaagaatgaactcccatttacaactgctataaaaagaataaaatacctaggaatacagctaacaagggaagtgaaggacctcttcaaggagaactacaaaccactgctcaaggaaatcagagaggacacaaacaagtggaaaaacgttccatgctcacagataggaagaatcaatatcgtgaaaatggcaataccacccaaagtgacctaaagattcaatgctattcccatcaaactaccattaacattcttcacagaatcagaaaaaaaaactatttcaaaattcatatggaaccaaaaaagagcccgtatagccaagacaatccttag

SEQ ID NO: 603202 - DNA, 248 bp, Homo sapiens
ctccgccttacgtttagtgagggagagattggtatatgattgagatgggggctagtttatagtcatgtgagaagaagcaggccggatgtcagaaggggtgccttgagataacttctggtgactcatgcagtgcaaagggggctattcgctagtttaattagctatagcacattatgcattattaatgcatgagtattgatatggtagtattggtatatggttcattgtccgcgaaagtatattgtaag

SEQ ID NO: 603203 - DNA, 559 bp, Homo sapiens
ttgaaaaacaaagtttttatttttatttttaatgggtttagtttttaacggggggccaacttttacatccccagcaaatcatggggccatgggattttttcccttatgttcatcccccttatatcagggccctcagattttttttttttccctctttttcaggttaaaaagttttttgtctgggacctttttttttcttttctttttcttttttttttggctttaaaacaagggtgatgccatatcaagtccatgttattttttcccagggtactttataaaaggggtgggggtttgtttggtcaggatgttaaaaagtgttgataagtagcatgaccagggtatgcgaaaaggtttttaggaagtatggcaaaaatgttgtattggctatgagggggccatgaaaaagtcagctcccttttaagaggttttatttgttcagtgttaagtgatttaaaaaaataataccctgttttttgactagtttaaaaagggatttgaaaagggttttgaatgcaattaggttatgttatttggccaataaactccccttgcccta

SEQ ID NO: 603204 - DNA, 147 bp, Homo sapiens
aaggaattggggtttttgcaaaattggccaagggtgggtttcgaacctcctggcctaaggtgatccttctcccttggcctcccaaaattcttaagtttttagggatgacccgccattcctagccagcttgtctttttgttactacca

SEQ ID NO: 603205 - DNA, 447 bp, Homo sapiens
acgggggtctagactattaacttggcttgtggggcaccgacacagaaacacggcccccgcccccaccgcgaaacgcccagaaattagcagaaaacggagaatgacacaggggccgtaaagacaagacactaacacgatactactagcgagcattgagggctgcgaattcaggttaggaactgaacgtggttattgttgggccgggacgactgtaagtgatgcgatgttgtactcagaaggcggtgggcttagagggggaactgaagcgggtgctgagctatatacaaaatagggaagaaaatgatagtcttcaatgtgaataatcgcttaactggccggggatattaaggaaaattagcatgaaagtgacgtagaagggagagtacgactcgtggggggggatgtctattaaagtatgtacaacttaaatgtgtgataaagttaaca

SEQ ID NO: 603206 - DNA, 405 bp, Homo sapiens
ggtaaatgaagaaggcagtgaagcagttgcaggtcccgttgttgtgattgctggccgttcgttaaaccccaacagggggactttcagggccaacaggcctttcctggttttaataagagaagttcctttgaccactataatcttaatggccagagtagccaacccttgggttaagtaaaaggttctaattctttgcaccttttcctattttgggttggtgaccagaagtaaaattaattccaaactacttccatttaacattaaaaaaaaaaaaaaaaaaaaaaaaaaaaaccttgtcggccgcttgggcccagtcaattttagactcgaccaggcttatgcatgcggccgaatttcgggctaattggcccaattcgccttatagggagtcgatttacaattaat

SEQ ID NO: 603207 - DNA, 411 bp, Homo sapiens
aggatcccctcagctggccccacgttgctgtgtcacccagcccgtctaaggaagctgtccttcctgcctaccccacgtactcagtgcttctgaagatgtggtacaggctttcatcagtgagattggaattgaggcatcggccctgtccagtctgctggagcagtttgagaaatcagaagccacaaaggagtgtcctcctccggctcctgctgacagcttggctgtcggacactcaggcggtgttgacattccccaggagaagacggccctagagcggttacaagccccagacactggccaacgtggcagggctcacccctccagctacccctccccaacagttatggaagcccctggctgctgtctcactgcttggcaaagccaaatctcctaagtccaacgcccaggcgg

SEQ ID NO: 603208 - DNA, 171 bp, Homo sapiens
agtctcgtccaactttattgctctggagaacaggagggcaagccagcgcggggcggtagtgcccaggcatccctctccccgaggccgccggcccggccgtgccgtcggggaggaccccgcacccgccgcgagcgcgcacacaccctcggtgacaaataaatacggcggccg

SEQ ID NO: 603209 - DNA, 355 bp, Homo sapiens
cagtggctgcgggtagtgatctagaggatccctgggagtctctctaccggcggaccctgtcgggtctatcggacctcacacgtcctccccaataagcaggggctctttaaccctagttctattcccggggccccaggacacagaccatccaatctctccatcaactttactcccttaccccatagaccacttcattacttccaatacgccccctcacctcccagcagatcgggcggccggctcctcccggagcacccctagcagggctaggtcttacattggctttggtctcagccggaagtgtcctttctcggtatctccatgcagataaatcctagccccatctcgggggtac

SEQ ID NO: 603210 - DNA, 672 bp, Homo sapiens
gacaccccattctatatcaacacatactgattttgcggtcaccctgaagtatatattcttatcctaccaggcttcggaataatctcccatattgtaacttactactccggaaaaaaagaaccatttggatacttaggtctggtctgagctatgatctcacttggcttcctaggggtttatcgtgtgagcacaccatatatttacagtaggaatagacgtagacacacgagcaatatttcacctccgctaccatattcatcgctatccccaccggcgtcaagagtatttaactgaatacgccacaatcatctcacggaagccatatgacattgatctgctgcactgctctgagccctaggattcatctttctttacaccgtaggtggcctgactggcattgtattggcaatactcatcactagacgtcgtactacacgacacgtactacgtagtagctcacttccactatgtcctatcaataggagcttgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgcccgacgttctcggactacccgattgctaca

SEQ ID NO: 603211 - DNA, 400 bp, Homo sapiens
  misc_feature (8)..(8): n is a, c, g, or t
  misc_feature (117)..(117): n is a, c, g, or t
  misc_feature (183)..(183): n is a, c, g, or t
  misc_feature (230)..(230): n is a, c, g, or t
ccttttcnaacaggccccctcccttcaagggggtaaaaaaattatccccctacacccccagcctcttgagggttccatgttaaaggttcccattttcagttccctcctgcccaggantgcattgttttttagccccaaggtggtggcaggggccctccctcccagggttttgggagccacgcntatgccctgcccttcttaagggcccctggggtttttgccccttttgncctttccccaaaggatggtccccccccagccctttatacctttttggttcccaggaaagtttttccagtaggggccccaaagtcccaggcccctggagtttttttcggcagggcccttttttttccctgcttttggtcaggggggcatgaataaaggctccaggttccca

SEQ ID NO: 603212 - DNA, 84 bp, Homo sapiens
gcctcggacaccgccatgtattactgtgcgagaagatacgtcccgtccggtggtatgattatctttgatatctggggccaaggg

SEQ ID NO: 603213 - DNA, 782 bp, Homo sapiens
  misc_feature (272)..(272): n is a, c, g, or t
ccaagcgtccgcgggactggcccatcgactggctcctggagcattattcgtgtgggtgaaagtctgcggatcgccgagaaggatgcgaaggcactgtgaccggcagaaagccaaccttgcggatccgcttcatataccgtccctcttccagtcacgtgtgcactcactgcctcgcctggctggcaatgatccgagaaacatgaatatggacaaaggacgtctgggaaaggaaggcgctgtggtgaacggcagcaatgtgaaccgctgacagncaaaggtgagcgacgatgccatgaagaccaataccatgcacgattcagcccttggatgaacgccgtaccttgctgcgtagggacttctttcctggtgccgttccgacccccctgtccgctgcggggatcttcattcctgcctatccgtttttcttcacatagccctctagatgtatttggtatcgcggttctgtcgttccgtcaggttgggaccggtcggagcacgcctggatggacaaagcttctttcagacggactgtcttgctggacggtgctgccctttcgacaaaccctcgagtcagagcaaggaggccctgcaggagggccgtccgcgtcacctctccggtaccctcggataccctcgagggtctaccttcctagattcggggtccttctacaagggagctggctggagggagaggtggacccttgtgttcggcctctggcacgtcgatgcgcctctcgattccgtgcggtacttgcctttgtgggtgatcttgcgtcgaagat

SEQ ID NO: 603214 - DNA, 435 bp, Homo sapiens
  misc_feature (55)..(55): n is a, c, g, or t
  misc_feature (186)..(186): n is a, c, g, or t
  misc_feature (213)..(213): n is a, c, g, or t
  misc_feature (225)..(225): n is a, c, g, or t
agagcgtggagtgactcagtcatgatacaggcgcatgaggcagccggtggaagtngtgcatgtagcggtcccagagggcctggtgtcggaagccatcgagggagtggacagacgctgaatactgattcaggaagaaccgcacgtcgctgatgtggccatgtggtccggagctggcaggtgttccancgaaacttctccacgatggtccacaanacagtgtctctngacactctttatttgtgtggtcatgcttggctggccactgttcaccatgcccccggtgacaggttcttgagagttggcttccatctcagagaagacgcccagctttccccggagagcagtgcacaccaggctcttgtgcaggtccagaaggtccttgtcagccactagcaccttgagctccttcaagtcctggagaaattccttgtctaa

SEQ ID NO: 603215 - DNA, 439 bp, Homo sapiens
cggcacgagggcgacctggggcagcacccactcaccctccaggctgtgtctgagcagcgggctgagtttggggacaggagcgtgggtggaagcatcccctgacttgtatgcaaatgccttgcaagccagcgtcctgccctggaggctgctgaccctgcttccccacctccacccgccaggttactgcaacctgaactttgaccccgccaccgccggcgacgagctgttccagctctaggagacccgctgggtgctgaacctggggatcctcctggagcccctgacagggggcggccccttcccgggcttcaagcagtgaccgcagatgctgtgctcgcgcggcctgtccgagggccgccactaggacgggaggtggaggtgtccaactcgtggtgtgcctgggcgtcacctacccccgcagctccccgctcggcggccg

SEQ ID NO: 603216 - DNA, 165 bp, Homo sapiens
gccattactgggggcttcagtggaggaagtaatgctgagcctgcgaggcctgacatcacttaccaggggccttagggaacccagccagcacagcagcagcagcctttcctctttttagatcaaacagtttcttggggtgttcccccgacccaccggggacaaaaa

SEQ ID NO: 603217 - DNA, 167 bp, Homo sapiens
tatactcatgcatgcagatccttacccactgatcgaggcggggattgaacctgaaacctcatggatcctagtcagttcgttaactgctgagccaggaagggaatcctgttttctctttcttgatttagatctttttcacatcctttaatccccttggacctgaattc

SEQ ID NO: 603218 - DNA, 1155 bp, Homo sapiens
tgtgtggccgtgtgtgtgggcttgttcttgtggttgtttgttttggtgggtgcgttgttgtttgtcgtgtgtggtttgttggtttgtgttgtttggtggggggtggggtgtttgggttggttgggggggggggggtgtgtgtggggtgggtgtggtggtgtgggtggtgtgggggggtgttggtggggtggggctcttaacacgccttgggtcaaccaccagccgtgttgggcgcccctagagcctcgagtctccccagtgtccaaaaaccaggcttgtgactcgccgccccgtacctgtgccggtccttaagttatctagctctttgtggtgcgaatttcgccactgaagtgtgtcgtctcggggagtcctgctgttgcttctcctgtccccgccggtctatgcctccaatcgggtctgcccctttgcgactgtggcccccgtttcagctcaaggtccgccgtgtgcccacgagggatttgaaccccggcgtgtggcccgagctctatcttgccaaggaggtcttcgagaagacccagcgagctcctgttcctcggggcccacggcctacctgggccaccgtgtgggattataggctttgctgtcgttcacctgcccgaggtcccccaagcctggccctacacgggccccgatgggcttcaccctgggcacgatgctgattggaaccacgacggccgctctgatcaggaggccttgggcacaggcctccgaagctgagcccactttggggtatgcgtcccttgcctggttcctcaatgcgtgcgaaccctggatgggaaggcggttcttcggtcacgtgtgaggcgaggccctgtgcgggcacatgtgtgcgcaccctcgctggggcttgcggcttccgtggcctgtaccctgtgtggccttcgtggactgcacgtgaacatgtacgaagaaaagtgctgtgcacccacagctgtgccaatgttcgagacctgaggctggctcaaaccggctgccttcacaccgggagagccacccccgtgcactggcaagccttccctggaacgagcgctcggtgttcaccctgaactttggggtcgacgggaggggtgccttttacatgttttattttgtatcctaatgaccagaatgaataaaccctgtttaataatttgc

SEQ ID NO: 603219 - DNA, 108 bp, Homo sapiens
  misc_feature (9)..(9): n is a, c, g, or t
  misc_feature (47)..(47): n is a, c, g, or t
ttgggcctnacaagtcgcagggcagtgggaatgaagccgagccactnggaaagggcaacagcgccacgaacacagaagacagccgcacaacgctatccggcccaaaaa

SEQ ID NO: 603220 - DNA, 862 bp, Homo sapiens
tgtgactgttcgataaactccaaagctggtcccatcatacccgtaatgctttcttttttcctttatggccaatctttgaactcattcaactccaggacatggaagaggcctctctctgcccttttgactgcaaaggtcaagtttcaattctggtgtcattggggaaggttgtctaaatctggtcaatgtgggtaaactctgagtttaattcaatgcttccctacattagactagagggctaaggattctgtcttgctgctttgtttcttctaagtaggcattcagatcattcctgtaggcttcctattttcactttactgctctaatgctgctagtcatagtctttagcacactaggtggtatgcctttattagcataaaacaaagaaaaattttaacaggatcttttacatatactggatggggggtggttcggagatgggtgggcagctgctgaacccttagggcattccctctgtaatgtggcgctttacaactgtactgctgcagctttaagtaccttaaagcttctcctgtgaacttcttagggaaaatgttaggtcagaactaaggtgttggcggggtctgtgagaggggaggggtaaaactgggtggcctctgatataatcttaggagccttgtcaactggcgtcgtacaggcatttattacaggactttgattggccggtttctctaatgggcctgcggggtgtttcatatggtttaaaggcggttgtatccattatttggcaggacattggtctaaccacatgttctggtagcctaccttggaatctcaactggggtccacggttaactacggtgtagtgtttccaaaccccaatctttaggagaaccatagt

SEQ ID NO: 603221 - DNA, 463 bp, Homo sapiens
tgctgggattacaggtgtgagccaccgcaccggccctaaagttttatttttgtgtgtttgtttgtttgtttgttgagatggagtcttgctctgtctcccaggctggagtgcagtggtgcaatcttggctcactgcaaccttcacctgctgggttgaagcaattctcctgcctcaggctcccaagtagctggggctacagtcgtgtgccaccatggccggctaatttgttgtatttttaggtagagacggggttacaccatgctgcgcaggctggtttcagactcctgacctctgtgacttctgcacgccttcggcctcgcaaagctgcaggtgttacaatgtacgagccagacgccgaccgagcccagatgataaagagtatagggagtggcggctaagtgtatgttgcccgctcgctaaaaatatatgtcttcactccatttcttactaataaatattattg

SEQ ID NO: 603222 - DNA, 889 bp, Homo sapiens
  misc_feature (2)..(2): n is a, c, g, or t
  misc_feature (874)..(874): n is a, c, g, or t
tntgctggaaagagcacgtactttaggctttctgcggtgtgtccctttgacactgggtttctgtcctagacagtttttatgattaagtcgtcctcactaccttactgctgaagtctttcatcccggacacgttttgtttttctattgctctgatatcactgcagccaagagaagctaactcaacccaagcacgggtgcagcttaggagagggcttgggtgtacgccagtcaatggagtgatggagcatgggtgggtgggtgggtaaatgcctcagcctcactggccttccatgagataattcggaggcacattccctacgattgttaaacgtgagggaacactggctgtccacatcaacactctcccttccatctgggtctttaaaagaaaataagacaatgagaaagaaatgtcttcattctaattgttgtgtatggcctagggaggagggagcaatgaaaagttgttctttggatctagaaagttctcttaggatctggaaagatgaggagccacatggcagaggcagtcctgaacaaactattagcgagttaattctaagttaatcttcctctgaaggcggaaaatttgttggcttgcacgcatcctctcactgtgggttggacctgcgtgcaccctcccattgtgggttggacctgcgtgcaccctcccattgtgggttggacctgcgtgcaccctctcattgtgggttggacctgcatgcaccctcccattgtggggcgggcccgtacatttcataaatgctttcccttttttctcattccctcttaaatgtccgtgttaaagggatgattatccaaatgaaccatgaaggtggctggagcgaaacaaaaagatgttcaaatggttgangtgctcccgaagagc

SEQ ID NO: 603223 - DNA, 314 bp, Homo sapiens
ttccggggttttttttccccccggggcccctggggggggccccccccccgggtttgggggggggggccccccccccccccggccttttggggcccccccccttggggggggggttccttgggttttggggggcgggcccccgggccccccttagttttccccccaacccccggggggttggtggggggtccggggggggccctttttttccccccggggcccccggccgggccccccgggtttgtggggggttttttggggcggggccttttttccccccttgttttttttttttttttttcccccccggggga

SEQ ID NO: 603224 - DNA, 414 bp, Homo sapiens
  misc_feature (383)..(383): n is a, c, g, or t
aagcgaggccatgtcaagaagccaactgtgggctgccggtcgtcctgctgctgctcctgcagagtgcacagggtgtctacatcaagtaccatggcttccaagtccagctggaatcagtgaagaagctgaatgagttggaggagaaggagatgtccaatccccagccatcggagaagtggcctcctccctgctgtgtgccataacccagccttgccctttggacctccagcctgtttgtgcctcccaggaagctgccagcaccttcaaggccttgaggaccatcgccaccgacgaatgtgaactgtgtataaatgttgcctgtacaggctgctgatgaaatgactctgggtcttaagaccactccggacactttccccacagcncaacctgtccatacttaggcaccattgaagt

SEQ ID NO: 603225 - DNA, 369 bp, Homo sapiens
ctggtaccagaggatcccgtgcattgtgcagcatgagggttctccccaagccctcacctgagatgggagcgtcttccagccaccatccccatcgtgggcatcattgctggcctggttctctttggaacttgggttcgctggagctgtggtcgctgctgtgaggtggaggaggaagagctcagataagaaaaggagggagctactctcaggctgcaagcagtgacaagtgccagggctctgatatgtctctcacagcttgtaaaagtgtgagacagctgccttgtgtgggactgagaggcaagatttgttcctgcccttccctttgtgacttgaagtaccctgactttgtttccaccatggcacgtggat

SEQ ID NO: 603226 - DNA, 550 bp, Homo sapiens
  misc_feature (391)..(391): n is a, c, g, or t
ctgcacttcagattgctcatccaggaagcgagggtgaagaggttaattgggcaagttgatgaggagtccttagttagaagcctggcagggctggtggctcacacctgtaatctcaggactttgggaggccgaggcaggtggatcacttgaggtcaggagttcgagaccagcctggccaacatgttgaaaccccgtctgtactaaaaatacaaaaaaaaccggctgggcatggtgacgcacgcctgtaatctcagctacttgggaggctgaggcaggagaaattgctcgaacccaagagctgaaattgcaccactgcactccagcctgggcgacagagtgagactccatctcaaaacaaacaaacaaacaaaattggttcttcttctgtggngcactggggagccatggtaggcctttgagcaggggagtggcagggtcagagctgagcttggggtatgcagtaaagggatggcttgttggtggcgccggggtcagagaggagaggggccattgcccttgaaggacagctcaatacccaggctaggaatta

SEQ ID NO: 603227 - DNA, 142 bp, Homo sapiens
tgttcattggctccaagaaaaaacttgggccagaattgtccgggggcctttatattatcaaggtagccacccaaggccaagccccagcgcctatattaaggcaccatttgaataaattctattacccagtaaaaaaaaaaaa

SEQ ID NO: 603228 - DNA, 246 bp, Homo sapiens
ggctccgactagcgacggagaactgggtgtgggagatagtggaggaggtggggtgaatcacttcagaagcggcatggattaaaaggggcctgagccagccgggcgcagtggctcatgcctgtatcccagcaccttgggaggttgaggtaggtggatcatgaggtcaggagatcgagaccatccttgcagtgagctgagatcgcgccactgcactccagcctgattgacagaacaagactcgttctc

SEQ ID NO: 603229 - DNA, 221 bp, Homo sapiens
ggaagcattttaatcagatggtcggggatggtaacactgcacagggagaactcacagctccaagagcttcctccaaattatgatgaagttcctgtaaataactagatttctacagcctggtctctgcccatgggaagaggaaatatgtaaagcatgtcgtctgcctctgtcatcatagagtctgagcacagctcgtgtactacagtctcagaacacagcga

SEQ ID NO: 603230 - DNA, 942 bp, Homo sapiens
atcagtgatgtgcgggacccaggtgcactccatctgcagagatgagacgggaatagaacgaattgaaaaaggacagagagaagatggggctaaaagaaacagaatggatgaacatgaaagccgtgtcttggccatccgccttctctctagtgctgggccagccgcctttgccatcgcgagagcaagggacagggcagatccgtaccagtatgtggtctgaaggaccccgacggcatgggcactcagacacaagtccacaccacagcactaccgtcccatccgtgctcatgaatgtttaatatcgaaaaagcaggaacaactactcttagaactttttttatgtctcaagtaccaatggctgagcattgccagagaaaaaaaaccccaagtccccaccatttattttttacaaaaccatccttttcgatgttctttgggtgaccgcgggctgcctctcttgttccttttcagacatcacttctctggcctctgtgttgtctcttctgggctgtcttgtcctggcaatgacctaaatgtacgaagggcgctgtctcgcgctgtgccattctatactgggtgagactgacgctgcgcgtggttggaatagtctggacgcccggtggggatgctggaaaggcaggaggcgtgaacttccaggtggccaggaggcaatgttgaattccgggggaataaagactcaccgagtatggtgcttccgcttgaggctaggattggcgggtcaaagggccctggagccggggcttacacccaagggacagggtgccgaaaccgaacaatgcctcctgggtcacgggggggggggacacgtggggcggccggaaacaaagcctttatcacagcgaaaccggttgagagggaaaccagaccgttatagagacaccgagggagaggcctcaccccctaaaagatgggcacacactg

SEQ ID NO: 603231 - DNA, 148 bp, Homo sapiens
cctccttggcctcccacagtgctgggattacaggcgtgaagccaccgcacccagcctacattaccttctttatcctatcacaactctcctgttttacacagaaagaaatgaccttcagagaggtcacggagcttgcccaaagtctcac

SEQ ID NO: 603232 - DNA, 223 bp, Homo sapiens
acgatcccttattttgataggaggagaatggcggatagtatatgaacatgagggtgttctcgtgtgatgagggtttatgttgttaatgtattgggtgagtgagccccattgtgttgtggtaaatatgtagagggagtatagggctgtgactagtatgttgagtcctgtaagtaggagagtgctattttgatccagggagaaacggttgcctatcaaaagacga

SEQ ID NO: 603233 - DNA, 297 bp, Homo sapiens
ccaattgctggtggagaagagccccaaaaaggaacgaagatatgaggccaaggtgggcagatcacctgaggtcaggagttcaagaccagcctggccaacatggtgaaattctgtctctattaaaaatacaaaaattaactgggcatgatggcacatgcctgtaatcccagctacttaggaggctgaggcaggagaattgtttgaacccaggaggtggaggttgcaatgagccaagatcacgccactgcactctagcctgggcaacagagcaagcctccttcttttccatcttaaaag

SEQ ID NO: 603234 - DNA, 102 bp, Homo sapiens
cacgcgatcgctgttttacgagtgtagggggtaagaattaacggaagaacgactgatgaattgctttatttattaccaggatggatatgcccgccgcattgg

SEQ ID NO: 603235 - DNA, 876 bp, Homo sapiens
aaagttaaccttgtgggctaagaatacgcgcccggcgcctcctataagcctgtgccccgcccccccccttaggtgtcaaaaagcacaaaatcaagggtctccagactatgggacctcccgcgcacatgcgggccccggccctcttgttccccggacgaggggaccaccctcttgggcccaagggcccaaccaacccctcgggtcatcggggctgtctcctaggcaacccgggaagcaaaagcatgccgcttccgtcggagttttaatcctgtccacaggggcccccaattcctcatttcgccgtgaacaacgatgtgcccgccctcccccctgcgccgtccgccgcattgtttcttcatggcgccccaacaggttaggcgaggccgtatcagcgtgccccgcgtggtccccccagcggcgtaacattgcgcttctaccagcgggcgcccccgtcgtctttgccctcagaccgcagtcttgtggtccgccgataaccccccaatgagtcctcatacatagggttttcccgccccagggccccgcgtgtctctgattctgcgaccgtcttcttcttggaggtacccttctgctttccgccccactgtggttgttatgttgtcatagcgtgttccaaatgttattgccacccctattgctatttccaaatgactggtgacaaccccgtatacaccaatcccctcataattctgccgatctcatgtgctcaccatagtaatcggaccatatcccccccacaatgattttgcgcttgacaagccaccccgctattttaaaggcaccctctttattcgccccacgcatcttctagaagatcccaccacccccccaaatattgtaggtccacacatgtaacga

SEQ ID NO: 603236 - DNA, 625 bp, Homo sapiens
acgcggctctctagaaccgggtgattgaacctaaaccttcgccgcaccgagtttgcagtacggccgtcacccgcacgactgctgttgcggtggagaaatcaaggccctaccgggcctccgtactcacctctctatagtgggcgtggccgaggccgggggtgaccctgcccgtgaagcctcccgtgccagcgacatgtccacggtcacatttcaagaggtcccgtgggcgccaggcaagcctgcagctagcttccacgctatccaaggtcttatgcagccacctcaaacaaggactcaacctcccaaaaatccccgtgaagggttcgcacgcacgctctccactccactccagttctcctgagggtcactcgctcgctactgtggctggcgagcacaggcagcacagcttggacagacgaggccctttcacacagcaccggacccatcagtgagagcacaaatacaccgcaaacctggatggtcacgggaacacggcaaatccccaaacacataaggcacacacagatgcagccggttcggtaccaatgggggggatcaaaccaggctatgaactacttcccaaatatgccactcctgacatgcatccaacgacttcgggacacgc

SEQ ID NO: 603237 - DNA, 469 bp, Homo sapiens
ccgcagtatggggcttgggatagagtggattgcaactagtctaattgtaggatatgtaataggaactctaacgaagctacccctaggaccctgctatacagtggtcgagagacaatataccccaatgcatcccttgctgatcctagaactgtcacccatgaatgacacaggattctataccctacaagtcataaagtcagatcttgttaatgaatacgcaaccggacagttccatgcttttcccggagtctgctccagccctccatctccagcaatcaactccgaccccgtgggggactaggctgctgtggccttcaccttgttcaccctaaggttcagatctctacctacctttggtgtgtcagttgtcagagcctcccggtctgtccccggctgcatctgtcctatggcaacatgatcctcagtctactcagcgtcggatgtaactatgcctgatcctatgaatgtg

SEQ ID NO: 603238 - DNA, 1053 bp, Homo sapiens
  misc_feature (497)..(497): n is a, c, g, or t
ggtctcccgccacacaaccagtctgtcccactcgcatggagaagatcctgatcctccgtgcttgtcgccctctctgtggcctatgcagctcctggcccccggggggatcattatcaaactggagaaacggtgagctctgcattgaatagtgcccagtgtaagagcaattggctgcagcatttcaatttgcgctgggccttggccctgttgcaacattccatggccagcgagaacagcgagtgctctgtcaagaacgctctattggcgatttactacaagttgtcccttgtgagcgttgcctgacctgtgaggggagacaaagaccatcggtggggctccatcaaccaagaccagtttgtgcatctgcatgacggctggaccgtccaagcagtgagatgcccacccattccaagacttagaccagaatgctggtaggccactaggccgcagggggcatctctcccttagtcagcgcatctccgtgttgccaaccttcntttgaccaagccatattctggtgtcttgatggcgctccttcacaatttagaggggcctcctgaaacgtataaaaaaacacacaaaccacaaacacaccaatgttgcggcactggcccgagaaaactttaaaccatggtggggcggcgcgccccatagttagtgacctggcaagggttccacagaaccggcgcggagcgcggtcgtccccaaaaaacgcggggccgacggttcaaacaccgggccggcactgggtacaggccgcataacaccccgcaggcgggacacaaacacacgaacgaacaacaaacaagcagcagagcaaagaagagagcgtcgaaccgatcgacgcgtcctccatgcaacggacccggagaggcaacacagcgagaacgacacagccccagaacagagagacagcgcgagacgacgccgcacggcaacctgaggccgcgcaggagggcgacgacgacaggagagcgacgaagaccaatagacggacgcggacgccaaagcgacaggaacccacaaccaagacgggcggagacgcgcgaacca

SEQ ID NO: 603239 - DNA, 296 bp, Homo sapiens
  misc_feature (256)..(256): n is a, c, g, or t
cctccaaggtatcaagcaattctccggcctcagcctcccgagtagctgggattatagacgcacaccaccatgcccagataattttggtacttttagtagagatggggtttcgccatgttggccaggctggtgtcgaacctctgaccgcaggtgatccgcccacctcggcctctcaaagtgctgggattacaggcatgagccaccaggcccagccctacaagaagacacattaagtaaatgggccagtctggactgnagaagaattggggcgtgatcaaacgacggtaagggagatg

SEQ ID NO: 603240 - DNA, 359 bp, Homo sapiens
tattctaaccactaactaggtagtgtatgccccttcagaacatgcagagtgtatctttcctacaatctctccttccgtttctcaagtatcgcgcagatttgttcaactctgcaaatatggacatcactttcttcttcttcgagaaaacacttgcatcagctctgtggtgtctccagggagacagctgtctgcatcccctgcagaaacccagcaacgattatgcacgtcgagacatgcgcttctactttcctatgtaagatatctcatttctgtacattatagcagaaaccacaaagctagggaaacacatcctctttacaccatcatctcacccactgttcttaaagcactcgtcaaca

SEQ ID NO: 603241 - DNA, 230 bp, Homo sapiens
tggctggccccactcccctccagccacaggtgtcggcgccccgcgcgcgtccggacccgccagcggccacagccagctgcgagccgttgaggcaggcgttgaccgtaaagaagacggagcagagctgcagccacggggccatggccgtgcgctcgcccagccaggccgttctctgcgccccggccgcccgccgctgcccaccgccgcattcccgtggagcccggcggccg

SEQ ID NO: 603242 - DNA, 101 bp, Homo sapiens
ccgtagttctgagcagtgcgtcatggttgtgcgcagtttgtgtccaacttgctgtaggtctgcttgaggatctgcccagcccggcccggcccccagcccgg

SEQ ID NO: 603243 - DNA, 121 bp, Homo sapiens
gctcgcgcggggtcgcaggtacccttcttatcagcggtataaatgcatttccccgctttgatttacccgataaccacagtaccgcttgaacctctttatttctgtccatctgacccatctt

SEQ ID NO: 603244 - DNA, 366 bp, Homo sapiens
cacgccggcatggtgcgcacccgccaactcaacggcaaactggcgcgagcgctgcaaaagcatgagcggaccgggagccgacacctgcggttgccccatctgcaaagccggatccgattggcggagttcatgctgcacagcgacatggagcccgacctcgacgtgatcaccgaagccgcgcgggacgcgctggcgatgtcgaacgtgcagctgggcgaggaactcgcgaggttcgcactcgatcgtggtggtggcctgccggccgcgttggtcctcgccgaggcggtgagttggcagggccgtggcgaggaagccggtttcgtgctggcccacgccgaacccgacggcgacgacgactggctgatc

SEQ ID NO: 603245 - DNA, 179 bp, Homo sapiens
tctgtgtcaggcttcagggtacacacctaatgtcttatatcgaagtatagtcatagttattgggcattcacattgtagtagtcactgtcgtatacacctaggatctctcctagaacatcatacgatggtcgcaacaacagatgattctcggccacatgttctcgcacatagcacgcaag

SEQ ID NO: 603246 - DNA, 418 bp, Homo sapiens
ccggtggggggggcgggcttaaaacccttccttttttcggggacccggggcccctttccccccctttgggttccccccccccacaagtgtttttcatgggggaaaccctggggccccccttgggccctccccccatgggcctgggggggggtttttaaaccccctgggttttcccgggctggggttttttttttccccgggggggtgggccccttcttggggggggggccccccccccccccaaaacccaaaaccccccttttgggggttttttttccccccctttttttggccggggaaggggggggtttttagggttataaaacctttttccgggggggccccttaaaaaaaaaacccttaaatttggggaaggcccccccaccccttttttttttttttttttttttttttttta

SEQ ID NO: 603247 - DNA, 217 bp, Homo sapiens
tttttttttttaaattttctttccgggaagagaagctctttgtccataaagaaaccttgaaaaattaattgtatgaggtatgaaaagacagagtcccccagtttggtatcttgttgaaggacgcccatgagttcccccaaaaaccccctttattttggtttttgtgccattttaaaggggggccaaaagtgagcaaataaagtggggaagaaattta

SEQ ID NO: 603248 - DNA, 127 bp, Homo sapiens
acgtcttacccccaaactaatcatctcttttttttcttcccacagcgttgtgccaattgatggggcaatgatctcttttttcagccacctccactgactcctaactccaaagtttatactattcaga

SEQ ID NO: 603249 - DNA, 270 bp, Homo sapiens
tgcaaagacctgtacgtacacagtgctgtctggcggacacaccatgtaccctggaattgccgacaggatgcagaaggagatcacatgccctggcaccacagcacaatgaagatcaagatcattgctcctcctgagcgcaagtactccgatgtggatcgagcggctccatccataggactcagcagtccaccattccagacagcatgtggatccagcacagcagagacgtatgaccgacgtccggccccgtccatacgtccacgctccata

SEQ ID NO: 603250 - DNA, 260 bp, Homo sapiens
aaacccccggggggggggggcccccccggaaaaccttttttttgggccgggggggggttttttttaatgggttttttttgggggggggaaaaaaaccggggtttttttcccccggggggtttaggggggggattccccccccccctttttttccccccccggggccccgggggggggggtttgggggggggggtttttttttcaaggggttccgggggtttccccctcccccctttaaaatttttttttttttttcccca

SEQ ID NO: 603251 - DNA, 412 bp, Homo sapiens
  misc_feature (36)..(36): n is a, c, g, or t
  misc_feature (92)..(92): n is a, c, g, or t
  misc_feature (101)..(101): n is a, c, g, or t
  misc_feature (144)..(144): n is a, c, g, or t
  misc_feature (155)..(155): n is a, c, g, or t
  misc_feature (240)..(240): n is a, c, g, or t
  misc_feature (368)..(368): n is a, c, g, or t
  misc_feature (370)..(370): n is a, c, g, or t
  misc_feature (398)..(398): n is a, c, g, or t
acccttcaaagaagttgcaattccgaaaagattccnaagattccgaagaagtttggggaaaaaggcttacgaaggaccttgcttaacccagnttgggggcnaaaccaagagttgggaaagattcgaaacaccgaacctcgtccngggccccttgnaagtccgggatactcaggccaagaagtgcggctgggatccggcggccacctgcacctgcgtatctctcgggccgcccttccgagnggctccccgagcctcccgccttcaccgggctctgttccggctgtccccgacggcgtcaaggtcgtgggacgtgacacgacgctgcggcgtcagctcagccttgcaagaccccagggcccgcgctgcancntcgactgtcgccgccgccgtcgcagtcnggaccaactgctgg

SEQ ID NO: 603252 - DNA, 1546 bp, Homo sapiens
taatctttaaacccccccggctttggtcacaacttataagcaaaaggggacccgagccctatactattttccatctccaaaaagacgggggccgggaggtatatttttggaccccatctcacgcctatactctcatttcaaccaatatacgccctgggcgcggtacgcccataaccggtataacattaacgggcggggcccaccaatctctctgtgtgccccctctaatgtgtggagaggcggcccctccttatcgcaatatatctcacaccccatatataccctctctccctctcataacattatatattacatctctctctcacacaatctctctatatatctctctactatctgtagagactatatctctctactagaaaaatctgcggcgtggctcgccctctatatatctcccacgacgccctatagcgtgttctctcacacctctcttctctagatatagacgcccctctctcttacgcgcgggcgcgacgcaaacacaaacacactatataatatgtggacccccacaccgccatatctcacaccgatgttgccctatatcttctatatatatatgatataaaaacacccgcgaggccccccctgagtggcacaccctctatagagcagaggggggggccctctctctctcgagcagccctctcctctctcatagatatgacacactctcgcggggagccgcaataagcccacgaggtgggtggatatctctcgactctctctcaccacactctccacaatataaaggcgctgctctctccttctctatataatctatgaggggcgccctattatcttattaaacccacacaacaccacactactatataaaacacaccattatattatttctcaccacgaggtgagaggtggggggggccgacgagaatgagtgtgttcaccctccgcgcggagaaacaaaaaaaagcagccccaccccatattatccgcccagagggggcgccccccacccacaacacacaacaaacaccaacgtcgcggttggggcttcccccacacaagaaggcggggcgcccccctatgccgaaacaaaacacaggcggcgggggcaaaaataataatctccccaataatactatatataaatatcatcatcccctccttccgtaagaaagaaagaaggtcgttgatattaataattaaataacatcttctgcggcgacgcaagggggaaatctatttctttgctggtgggtggagggcgcccctatttaatatgtaaccaaccaaaccacttccaccaagaggcgctagtaataagtatggcgccccctcatatataaagcccccccccacggatgatttatcaggacgaagaagggggggcgcggcaaccgatcgttgggggggcgcccccacaaaaagacgcaggggcaggcaagcattcaacaacccccgccgcagggtagtagaaacaagccccccccccgcaataaaaaacaagagatgtagcccaccaaacctacacccctgcaaataacagcacacacgtaccttt

SEQ ID NO: 603253 - DNA, 449 bp, Homo sapiens
  misc_feature (183)..(183): n is a, c, g, or t
atccttccttgtcttgtactgttttgcaactctagaaagaaaagttaaatatgtagaagcctgacagtgatacaaatgatccctgttcatattaatacaaatgcaaattgtttgcctggtagagatacaattgattttctctctgtagaaaaaaggatgatcccagccaggcgtggtggctcnacctgcggttccagcactttgggaggccgagacgggcggatcacagggtcgggagttcgaagccagcctggccaatatggtgaaaccctgtctctgctggggatgcgggaattagccgggcgtggtggtgggcgcctgtggtcccggctgctctggagggtgaggcgggagagttgcttgaatctggggggcggagtttgcggtgagctgagtcctcgccattgcattccagcttgggcgacagagtgagattacatctcaaaaaa

SEQ ID NO: 603254 - DNA, 358 bp, Homo sapiens
catgctgggtgagcagggtttccggattcagagtgtgaagacagagtcagaggagctgtttggggagaccatggagatgatggtcaggatgaaagatattgagttggatctgctgcgcggcactaggccatcatgttgcgctcggcggtcctgataggactggtagaatcgtgtggagcagatccgtgatcatatcaatgtgcgcgtgctctactatgctacctgtaagtgttgctacagctttcatcccgttgccccactcatctgccgcttttgcttttgtgttgggggtagattgggtttgaattctttccatctccatgagactttcatgcagcctaaagtacagcctggacca

SEQ ID NO: 603255 - DNA, 675 bp, Homo sapiens
  misc_feature (48)..(48): n is a, c, g, or t
  misc_feature (57)..(59): n is a, c, g, or t
gatgtcctgcgaatgagcaggagaaaaaagaaggagggagtgagaganagggaaacnnngagaaatagtttgagcagtgcacctggccataaaacaccagggcggggctgggggtgtctttgcaaatggtcacgtcacaccaggcctagctgcaccccagtacaccaggccaccagtacagctgtggcacccgctcagtcgtcttcctttgcggagcacctgctgtcagggtttattgcagaaggagccaagatcacacctttatgtaggcaacaaaataaatccttacaaaacatgaaaggatttttacagccaccctatgaaatgggaactgagtacccccattacagagaaggaaacggttacatagtctatctaaggccatgtgaaatgaaggactggactggaactagaatgcagacctagctcatacaaaagcctggaatgagtcttgcatatccactgcccaagtgaaaaaggaaactattggccgggcactgtggctcatgcctgtaatcccagcactttgggaggccaagacaggcagatcacttgaggtcaggagttcaagaccctctggccaacatggtgaaaccccgactctactaaaaaatataaaaaattagccagatgtggtgttgcacacctgtaatcccagctactcaggaggctgag

SEQ ID NO: 603256 - DNA, 410 bp, Homo sapiens
  misc_feature (14)..(14): n is a, c, g, or t
  misc_feature (164)..(164): n is a, c, g, or t
gtgatctagaggantcttttgggtgctttcttattctggatcagggtgttacatttaacattgatcaggtaaagaggagaggctgtgctaaggtctgagaaaaggttgctctaagcaagtgtggtgaggacaggatgactagggaatggcagagaacaggctgngctactgtcagttcaagcaaccaggtgagcagcagcagtctaaaaatgcccaaaagaacactccatggattcagggaagggtgaggcactgctttctagtatgtggcaaaaaaaacataatctgaattggggcccaggggactttgagtttgtaatggggagggaaaaggagtgagcagttctcctcccctccccaaaggcttaggccaacacaaaaaaaaccacacaaacacacccaccacaaag

SEQ ID NO: 603257 - DNA, 184 bp, Homo sapiens
tcccccccggtcgggcccctgagggaccagttcccccgcggcaattttgggttccaggtgcatcctagcccgcccgaggccccttccaccccccatgggggtttgggcccggccttgccttcccttctgggccagtcaccccttccccaggccacccaaataaagggttatttaactgtctgga

SEQ ID NO: 603258 - DNA, 94 bp, Homo sapiens
  misc_feature (29)..(30): n is a, c, g, or t
gactgtgctctatggggcgttagccacanngttaatttaccccacagtttctattcaaacgtcctggacacataattacaggattaaggtcgta

SEQ ID NO: 603259 - DNA, 148 bp, Homo sapiens
taggacacagttaaaaaaaagaggtaggaagtactactgaaacagatctactagttacaaatcgagtatgagttccccagtgaccggttacaaattagttactgggcagaccctcgtgtgcaaaccctaacagcagaggggtgtaccg

SEQ ID NO: 603260 - DNA, 215 bp, Homo sapiens
cgatgtgtcaattgtcccgtcaggccgaatcaaaagatagaccggcaccagcttttcgagtggcagtaaagatgcgagaccggaggccagaccaagatttgccgccatggacacgcccaagccgaccagcaggccgcgcgagacatacaccgcgagcctcgacctcagccgttgaaatgaagaaacttcagcaaaatgctcttcgagctgtggag

SEQ ID NO: 603261 - DNA, 134 bp, Homo sapiens
gagctcggtaccccccacacacgccagattctttcctgaggctggcgtgtgtggggtgggaccacaagggtcttgtggcctggctgcctgcaggagtctctgaagcagccacattcctgatgcttcggggatcc

SEQ ID NO: 603262 - DNA, 846 bp, Homo sapiens
ggactttgccactgagttgattttagcagagaaacgtggtgacctgacagagagagaatgtgaacctagtgcagtattggaaatgctgatcagcagcatcctgagaccgatgtcttgtcatctttgttctgtcatgctactttctcatttgcaaatgcagcgctaagtgtcagcaagaggcacataataaaggaatagtccatgacgtgtctattaggtggagcagagtacatacaagattgcatgagtatacacaaaagttaacaaggtgagtggaagaatgttcatttctatcgagatcgcacgcgtgtagccagcactagtcgatggacgttggatcatgcggcaacagccgttgagaagagtgatgtcaatcgatggtctacctcagtgtcaaacaggggacaaacagtcatcctagaatattggagaggatgcacagacgtcgagtgataaccccaaatcccaatgaagtatactcttgaaaatttggcagagaatgttgccttatacggtactttcagccatttggcttcgggccccgtggctgtgcaggaaagtacatcgccgatggtgatgatgaaagccatcctcgttacacttctgagacgattccacgtgacagacaattgcaaggacagtggtgtagacgagcatacagacagatacacggacttgtccttggcacccaagatgcagcactaggaaaccatgctggcacatgatccttcaaccccaaggaaactcagaccggtgtctgggaaccatagagcaaggctggcaagtacttactctggaggcagttctcatcagtaaggtcacatacaaatcatccatccttgacaa

SEQ ID NO: 603263 - DNA, 834 bp, Homo sapiens
gcgctgcgagctcgttgctggctggtgtgtcgctgctgtagctgcgtctgctgctgctagtcgtgcgttgcgtcgtcgctgcgcgcgccgtagcccgagtcggcgtggcttgcgtcgcggtctgctcgatgtccgtgtgctgccctcacacgctggggaccccccccgcgtgggctcccccccgctgttttttacccccattatgggggtgttctccccctagacagcagtgccccgcagattctttttttgtgggaggcccccccctagtttttgtgtgttggccacccacttatggtgtgtattctttttgccccgctggacaatatatcccccgggtgtttgcccccactcctcgcggtggtggtctctttgatcatacccgcgtgggggggtgtacccaccacattattctttggggggcggccccaccaccatggttgctcgtctagtagtccatttctgactccagccccgtgtttgtcctcgccacacacaaaaatcatcgtcttctaagcaaaaaacatctggtcctcccttctttcctgtatatcccccctcttctccctgggggtctttttcttcagtacacctcttggtagtacacccccttcaaggaaccacaaaattttctgcgccccccccaactttttcccccccccggagtctacaaaaatcaacaccccccccccctttatcgtataccccaccgagcaccactcactcctctacaaacctaatgttcccaaacactttttaattgttcgttatacacaccctgttctaccccatcaaaaaaaatcacataacagatataataaaacatacaaccaa

SEQ ID NO: 603264 - DNA, 465 bp, Homo sapiens
tttctgtgtgcaagcaaagttcgaggcgcaccaggatgagcggtgagtgtcactcacaaggtaaagccggcagcggtgtctggatggccttctcctctggctcttccatccgcctctttcacacggagactctggagcaccttcaggagatcaacatcgccaccaggaccaccttcctcctgccaggtgaggctgcgcacctagtttgagatgaggggacagacactcatgggtgccaacagggggctgtgtagtgggcatcccagctcattaactgccagggcagccttgaaaaccatggtggacaggaagtggcgggactgggatttatacccaagcctgtcctatcaacgctccgattcctgaccctctatgttccctatgccatctgagcaggtgtggtcctcaggaggtgggctccaggccaggtgggctttcctgtgccaggagctggtacctcggccg

SEQ ID NO: 603265 - DNA, 125 bp, Homo sapiens
cgacgtctgttacctgaggaggggaaagtggaccaggaaatcatggaacagtaaggctcggggggagaacggcattcagacacggacagtgtacaggagggaagatgatctgattccctgctaca

SEQ ID NO: 603266 - DNA, 250 bp, Homo sapiens
ttcgtaacttcaatgcattctttggcggccctggacggcttccgtctttgaagtgtaggtgggcctgctgttcttggtgagttcccctatcacaagccactcacactctttgcctcttagagctgtctctttggcgagtcacgaggggcccactgagcggcgagcagctgatgttctctactctacgcagtgcgacatctgatccacgtcggactgtaagcgtaagcgactgtaagacatggtaaggttc

SEQ ID NO: 603267 - DNA, 189 bp, Homo sapiens
ttatgcatgattagcgggggaaactccgcgcagctctttagacacaagagtactttacttttcttgaagaactccagagttttgtctaggaggcagtaaagcagacagatactgaaagggataagtttcataggcatggctttggcccagtgaacaacatccgtactctagaagctaagacatagtagc

SEQ ID NO: 603268 - DNA, 104 bp, Homo sapiens
gccacccagctgccgactttcattagccagttctcgcgtgcatgacaggtcagggcaaaggtcaaaccctccaaaatttgattcccaggtaagggggccccttt

SEQ ID NO: 603269 - DNA, 169 bp, Homo sapiens
  misc_feature (40)..(40): n is a, c, g, or t
gtgtggacacttgcaaggctctggcccctgagtatgccanagccgctgggaagctgaaggccgaaggttccgagatcaggttggccaaggtggacgccacggaggagtctgaactgggccagcagtacggggtgcgcgagtatcccaccaataagttcttcaggaatgg

SEQ ID NO: 603270 - DNA, 345 bp, Homo sapiens
acttagggaaaggcattgcaatgttgtgttagtggtcatgtggctggaaaccagacttgtaccacacaggctcacaaacatgccttttagagggcttgctggataaagaaggaggggacagggtagtgcgaaagactgcagaagatgtttgcgtgaatccccaactatcgagatgaccttaattcacaaatgctaaaatttggacttctacatgttcatttaaagataaataaccagacattgttttgacctgctattcaggtgaaatactgtatttgggactgtaatctgggaagggtattttaatgaaaaatattaccatttgctttgcataaaataaaaggc

SEQ ID NO: 603271 - DNA, 449 bp, Homo sapiens
gtgagccgagatcgcgccatttccagcctggcaacaagagggaactccgtctcaaaaaaaaaaaaaaaaaagaagagaaaagaaaacataagtttcagccaggcatggtgggtcacacctgtaatcccaacactttgggaggccagggtgggagaactgcttgagcccaggagttcataccagtctaggggcaacatggtgagaagttgtctctactaaaagtaaaaagaattagctgggcatggtggcatgcacctgaggtcaggtcccagcgacttgggaggttgagaggttggaggattgcttgagcccaggagatgaggctgcaatagcatgatcacgacgctgcacttcagcctgggtgacagagcgagagcctgcctcaaaaaacaaatatgtttcaacttttttataataaatatgttcattttgcaactagcaaaaaaaaa

SEQ ID NO: 603272 - DNA, 103 bp, Homo sapiens
tagtaagtttctatattttattatgaattcatcttttttacatgaagacaaaataaacaattatcaaatcaatcaaatcatctcttgtactttctctgctaaa

SEQ ID NO: 603273 - DNA, 229 bp, Homo sapiens
ccacatttgtttatgcatctcagtggatggacacttgagtggcttccacctttagctatggtgaatatggctgccgtaaacatgggtgtgcaaatatctgagtctctgctttcaatcatatggcaatcctatgtttaatttcttagggcactgccataagtgttttacacggtggctgcaccattttacattcccacggaaggttccagtttggccacatccgtacggg

SEQ ID NO: 603274 - DNA, 388 bp, Homo sapiens
taccatatcaacacacagaaaccaagcagcacagcatactcagcagcagtctactagagctctttcagctgcatgtacttcaaagacaaagaccctgacaacgaggagcgtatcatatctgacggagttaattattcaattagaacaaatggtgtgctactatttcataccaaggtaatttataccaggtgctgcttatctaaaaaataaagatggttcagtcatctcatgtggaccagatagctgtactgaatggaaaccagcacccttcaacgattccaaaataaaattacctctactacaacagatggggaatctgtaacgatccatttgtaagaccatgtaaccgtaagaatatccataaaggcctcacgttgacattctgata

SEQ ID NO: 603275 - DNA, 929 bp, Homo sapiens
gttatcaaagagcacttgagactgtctgaagcccaaagcctgaggacagaaagaccctgatgcaggtcagcccatggcaggcagatgcccttgtctgggcctggtggttttccaagccctcaggctggtcctgatccagtgatggatgcacagcttcttcaccttgtctcactgagactcactgatcatgagagcattctgagacacgctgtaataatcctgcacaggcttgctgtatgacccctggccacagccttccctctgtcattgacctggaggggagaggtcagccgttgagctaatgaggtagctatagttgcagccctcatggacaagttcgagagatccaggatcagctttgaaggctggattctatctaccataagtccgtttcgacattaccacacacgggccgatgcagcggagcgtaccgatcctagcattgtagcgactttaagctcgagtgcatgggcaactagaacacgctaatgagacagcagattacgcagtgtatttgagaatgcatgagggacaacctagtaaggcccttaactatcacctatgtgcatcacatctgcacactctcttctccattccctagcaggaacttctagtctcatttaacagataaagaaactgaggcccacggtttcagcatagacaatgatttggccaggcctagtaaccaaggccctgtctctggctactccctggaccacgaggctgattcctctcatttccagcttctcagtttcttgccttgggcaatggccaggggcccaggagttggggagagttggtgatggagggcgagaggggtcacacccatccacttgctgggtctaggctgctgtacaccaaggccctgcatctgtctgctctgcatatatgtctctttggagtgggaattccatttatggtcaaaacat

SEQ ID NO: 603276 - DNA, 404 bp, Homo sapiens
  misc_feature (21)..(21): n is a, c, g, or t
  misc_feature (28)..(28): n is a, c, g, or t
  misc_feature (100)..(100): n is a, c, g, or t
  misc_feature (118)..(118): n is a, c, g, or t
  misc_feature (120)..(120): n is a, c, g, or t
  misc_feature (143)..(143): n is a, c, g, or t
  misc_feature (279)..(279): n is a, c, g, or t
tggcggtgacggcggcggganaagcgcngccctcgcagacagccttggggtcgccggccgctcgcagcgttgtggaggggcgggccggacgctgagcganagcttgcgccacgggtgnanttgtgtgtcccagagtgccggancgagtcccagaagagaggcgaggctaagccagagcgctgggttgcttcacagggaagactcccttccccctgcttcaggctgctgagcactgagcagcgctagaaatggaagccatcgccaaatatgacttcaaangctacttcagacgacgagcttgagctttcaaaaggggggacatccctcaaggttttgaacgaagaattgtgatcagaacttggtacaaaggcagagcttaattgaaaagacggcttcattcccaa

SEQ ID NO: 603277 - DNA, 184 bp, Homo sapiens
ctctatttatcttgttggctcacatggctcagcaatcttgactggtttttccttcactagcttacctgactcagcgtatcttctatccctatgaacacatagccttatctctgaggatcagaagctaggtccatcgaccctctgaccatcctcctgagacacatcatgcaggatcaggaactag

SEQ ID NO: 603278 - DNA, 1014 bp, Homo sapiens
  misc_feature (23)..(23): n is a, c, g, or t
  misc_feature (63)..(63): n is a, c, g, or t
  misc_feature (190)..(190): n is a, c, g, or t
  misc_feature (207)..(207): n is a, c, g, or t
  misc_feature (357)..(357): n is a, c, g, or t
  misc_feature (368)..(368): n is a, c, g, or t
  misc_feature (386)..(386): n is a, c, g, or t
  misc_feature (401)..(401): n is a, c, g, or t
  misc_feature (417)..(417): n is a, c, g, or t
  misc_feature (490)..(490): n is a, c, g, or t
  misc_feature (541)..(541): n is a, c, g, or t
  misc_feature (554)..(554): n is a, c, g, or t
  misc_feature (588)..(588): n is a, c, g, or t
  misc_feature (602)..(602): n is a, c, g, or t
  misc_feature (651)..(651): n is a, c, g, or t
  misc_feature (675)..(675): n is a, c, g, or t
  misc_feature (688)..(688): n is a, c, g, or t
  misc_feature (690)..(690): n is a, c, g, or t
  misc_feature (737)..(737): n is a, c, g, or t
  misc_feature (798)..(798): n is a, c, g, or t
  misc_feature (802)..(802): n is a, c, g, or t
  misc_feature (823)..(823): n is a, c, g, or t
  misc_feature (827)..(827): n is a, c, g, or t
  misc_feature (833)..(833): n is a, c, g, or t
  misc_feature (875)..(875): n is a, c, g, or t
  misc_feature (877)..(877): n is a, c, g, or t
  misc_feature (905)..(905): n is a, c, g, or t
  misc_feature (909)..(909): n is a, c, g, or t
  misc_feature (919)..(919): n is a, c, g, or t
  misc_feature (976)..(976): n is a, c, g, or t
agggtagtaagtcaggggattcncctccaagtctaccacacaaaggaaagtgtcaagcctctnttcacccctactcaatccccacaaaatagggggttgttcaatattgttttcaatgaaaaaaactttgtggttaaaggtttctccttaggactagcgacaaagttaggcttatacttttaatgaagancataaacgaagccagangggctttaggaagccagagttcttgggggaaaattcttagcgtactataccccagcctcttaccttagggttaaatctaggtctaaccaagccgtacaggtcaactaagagggaatgatgaaaccacagagtttcatggagaaaccatgnaaaaaaaaaanagctgaaaagcagtaaanaaactgacccaagcntggagggaaaccattnccccctccgtcctatgagacccctttcttgctccagtcaaacagtgggccacagcatggcaggcctccctgtngggtgcctgacaataccctagatgcctctctaaaatcagaagccgcatgcngccccacccagtnacagccaaagggaaaacataaataaaaggctgcngcctcaggcttgtngttatggaaagagcctggaattgacaggagaagaagcactgccaaagtnagggtcttatttatccttcttgtnttccccatctganantgtggtgggggttgaagccacaagctgcccctcagggatattgtttncagcctttgatagtttcttggcccgccggtatagctcatttaagttaaattctcggatcanattntcctcagagaaggtccatganaaancccgtnctttcttgttaatttgtgggcgccgcattgcctccttgccancntgggacaggatcagggtagggagttgcntggngaggggtgangttctccctttgtaccgcgttccaacatcagtttagcgttcaaaaaccaccttcccnaaatttagccctgttcagttgttttttaagggagaggg

SEQ ID NO: 603279 - DNA, 433 bp, Homo sapiens
aaagacccatgacttggtggagcagtaagccagagactatgtgagttcaagctaagacaactcttgagcctagacaagggaggtcactgaaagcccagataggtcttcctggtggatccttccccgataagtgtcctacttgcttctcatccaccaaggaatgagctctcttatacagcagtagaagcttacatgagacactgggaatgctggtgaaccgcacgcggttctaggacaaccgtggagggttttaattgtctagtgttgtcatttttgtttccttgggtctacttttatacattcaggtttgagttttgctttcacattatggtacactcctggtgtaatttttccagtttttgcccaagtctgtgtaagtttccagttctgtctcctggacctgggtgtttctgactctgggacgtcatacgtg

SEQ ID NO: 603280 - DNA, 740 bp, Homo sapiens
  misc_feature (201)..(201): n is a, c, g, or t
  misc_feature (321)..(321): n is a, c, g, or t
  misc_feature (328)..(328): n is a, c, g, or t
  misc_feature (336)..(336): n is a, c, g, or t
  misc_feature (342)..(342): n is a, c, g, or t
  misc_feature (347)..(347): n is a, c, g, or t
  misc_feature (353)..(353): n is a, c, g, or t
  misc_feature (379)..(379): n is a, c, g, or t
  misc_feature (387)..(387): n is a, c, g, or t
  misc_feature (389)..(389): n is a, c, g, or t
  misc_feature (394)..(394): n is a, c, g, or t
  misc_feature (397)..(397): n is a, c, g, or t
  misc_feature (406)..(407): n is a, c, g, or t
  misc_feature (422)..(422): n is a, c, g, or t
  misc_feature (438)..(438): n is a, c, g, or t
  misc_feature (442)..(442): n is a, c, g, or t
  misc_feature (450)..(451): n is a, c, g, or t
  misc_feature (461)..(461): n is a, c, g, or t
  misc_feature (511)..(511): n is a, c, g, or t
  misc_feature (516)..(516): n is a, c, g, or t
  misc_feature (520)..(520): n is a, c, g, or t
  misc_feature (527)..(528): n is a, c, g, or t
  misc_feature (530)..(530): n is a, c, g, or t
  misc_feature (538)..(538): n is a, c, g, or t
  misc_feature (559)..(559): n is a, c, g, or t
  misc_feature (561)..(561): n is a, c, g, or t
  misc_feature (583)..(584): n is a, c, g, or t
  misc_feature (592)..(593): n is a, c, g, or t
  misc_feature (673)..(673): n is a, c, g, or t
  misc_feature (725)..(725): n is a, c, g, or t
cccgacgacgcgggagccgcacgcgccggacgaggctcgctgcgctccctgttgcccagcgcgggcccgttgaggcggagcctcagttcccggccaggacacggtctgggccgcgaatctccggccgaagagcggcggcggcagcggcgggaaaaaaatgaagaatgaaattgctgccgttgtcttctttttcacaaggcnagttcgaaaacatgataagttgaaaaaagaggcagttgagaggtttgctgagaaattgaccctaatacttcaagaaaaatataaaaatcactggtatccagaaaaaccatcgaaaggagnaggcgcnagcgaganggatgncgggngcaagnaagagtttcagagagtggatgcgcgngatgtccngnaagcntgngaaaacagnnggcgatgcgttggtntagggagcctggggcntgcnaaaggagnncgactgctcnggggggacgccatgtgaggtgtgcgggcgggagggggagaaaaacaaggnagggngggntgccagnntngaaaatanagatgagaacaaggatgagancnccaggaaagttaccagggcccnngagaaggnnacctctgattatcattcaggatcctcttcttcagatgaagaaacaagtaaggaaatggaagtgaaacccagttcggtgantgcagccgcaagtcctgtgtaccagatttcagaacttatatttccacctctnccaatgtggcaccct

SEQ ID NO: 603281 - DNA, 863 bp, Homo sapiens
  misc_feature (197)..(197): n is a, c, g, or t
  misc_feature (324)..(324): n is a, c, g, or t
  misc_feature (444)..(444): n is a, c, g, or t
  misc_feature (451)..(451): n is a, c, g, or t
  misc_feature (459)..(459): n is a, c, g, or t
  misc_feature (465)..(465): n is a, c, g, or t
  misc_feature (470)..(470): n is a, c, g, or t
  misc_feature (476)..(476): n is a, c, g, or t
  misc_feature (502)..(502): n is a, c, g, or t
  misc_feature (510)..(510): n is a, c, g, or t
  misc_feature (512)..(512): n is a, c, g, or t
  misc_feature (517)..(517): n is a, c, g, or t
  misc_feature (520)..(520): n is a, c, g, or t
  misc_feature (529)..(530): n is a, c, g, or t
  misc_feature (545)..(545): n is a, c, g, or t
  misc_feature (561)..(561): n is a, c, g, or t
  misc_feature (565)..(565): n is a, c, g, or t
  misc_feature (573)..(574): n is a, c, g, or t
  misc_feature (584)..(584): n is a, c, g, or t
  misc_feature (634)..(634): n is a, c, g, or t
  misc_feature (639)..(639): n is a, c, g, or t
  misc_feature (643)..(643): n is a, c, g, or t
  misc_feature (650)..(651): n is a, c, g, or t
  misc_feature (653)..(653): n is a, c, g, or t
  misc_feature (661)..(661): n is a, c, g, or t
  misc_feature (682)..(682): n is a, c, g, or t
  misc_feature (684)..(684): n is a, c, g, or t
  misc_feature (706)..(707): n is a, c, g, or t
  misc_feature (715)..(716): n is a, c, g, or t
  misc_feature (796)..(796): n is a, c, g, or t
  misc_feature (848)..(848): n is a, c, g, or t
ggctgcttttggcccctgtcccctgaaccgaccgctggtgagccctgtcactgctgcccctgtgaacccggaacgggtctttctgtccttggccgcatttccccattgttttgcccccaaaggacctggccccggggggggggccccccccccgggttttgaaggccgcgaaggcccccccctttttcccaaagggnttttttccccccctgggccccaggacacggtctgggccgcgaatctccggccgaagagcggcggcggcagcggcgggaaaaaaatgaagaatgaaattgctgccgttgtcttctttttcacaaggcnagttcgaaaacatgataagttgaaaaaagaggcagttgagaggtttgctgagaaattgaccctaatacttcaagaaaaatataaaaatcactggtatccagaaaaaccatcgaaaggagnaggcgcnagcgaganggatgncgggngcaagnaagagtttcagagagtggatgcgcgngatgtccngnaagcntgngaaaacagnnggcgatgcgttggtntagggagcctggggcntgcnaaaggagnncgactgctcnggggggacgccatgtgaggtgtgcgggcgggagggggagaaaaacaaggnagggngggntgccagnntngaaaatanagatgagaacaaggatgagancnccaggaaagttaccagggcccnngagaaggnnacctctgattatcattcaggatcctcttcttcagatgaagaaacaagtaaggaaatggaagtgaaacccagttcggtgantgcagccgcaagtcctgtgtaccagatttcagaacttatatttccacctctnccaatgtggcaccct

SEQ ID NO: 603282 - DNA, 111 bp, Homo sapiens
ctgatccgtgtgtgtgctgctgccgaccacaactaccagagctacatccttagagcgctcggccagctgatgctcttatgtggatggaatgctgggaggtggtggcccaca

SEQ ID NO: 603283 - DNA, 414 bp, Homo sapiens
  misc_feature (326)..(326): n is a, c, g, or t
  misc_feature (346)..(346): n is a, c, g, or t
  misc_feature (373)..(373): n is a, c, g, or t
tttgaacttgggtcagaccaaacgagtttcagtgcttggtttagaaatgaatatgtacccgaagctgagcatgtgagaatccacccataagaatttggccgacccttttggggaaaaggagcctctgtaagctagggtcactaaattggtacagtgaaagcctgtagcccccactttggaaaagcctgcctaagactaacaaccccctgcaaggaagagttgaaaaatggaaaaagactggttttcatcatcatttgcccactcaagttcagctcccttggtcatacaacccgttaaatttatccccacgccctaccaagttattnttgtaaaattatgtcacttntttatttttattatatgaaaaaatttntttgacgcctggggctacaagaacgagatcttttgttctca

SEQ ID NO: 603284 - DNA, 347 bp, Homo sapiens
ggttgcatcctaatgacattttaattggtaagctgtctgtaataatgtttttgtgttgtagtaaaatagtatttattttaactagggtttataagattatgcaaatcccaataaagaactgacacgttccataggccattgagtggaaaatcttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatc

SEQ ID NO: 603285 - DNA, 182 bp, Homo sapiens
  misc_feature (115)..(115): n is a, c, g, or t
cgcacggtttctcatcttgtcgcatgcattcttcaaacccagtcacagcaggttcatttgcccatccattgtcaggccaggggccatcacaggcacacatggtggccaggcactntccgtccctcaaccacagcacaggcacagtcagttcaacagcacacacatatcacaggcaagcacat

SEQ ID NO: 603286 - DNA, 978 bp, Homo sapiens
ggagagagagaactagtctcgagttttttctttttttcttgggttgaccacagggtacttaataggatggtcacatgacaaggtgcggctccttaggcccctcccctcttcaaggggtctacatggcaactgtgaggaggggcaaattccagtgtggctgggaggactagacgtgtcggccagggaaatccccagcaagtcgaggagtctctactaactaacctacttgtagctctatgaccaggcagagcatcagaggaccacgggagctctaactcctttgaggagcgccattttggcgccatagacggtcaacacaccctggtaagagctggaaacgccaacaaattcggggggaacacaacacacagggacaatagacgctgagaacaaccaggggaccggtcaagcaggcgaaaatgggccaaagcccccagggcgctacaaaggtgtgggacggagacaggggagtgctcggcatagataacgaacgtccacgaggggacccaacccacccgagggagagacaatccaacggataccacccacaagagaagagaccccaattgaaagggcggagcccacctccgcgaaacaaacgcgcgacataaacaacccacaccagtaaacatgggaagacgactccaacacacaaatatgaggagcaaggcgacatacaaacaaaaacaccaggaagagcgaaaacaggggacaccaaacccacgaaaggcaaccaagagtctagagggcacaaaagcgacgccaaaacagagacaacaagtgcaccaaagaaccccacggagtagaaacccgataatcccaccagatacacagcgacacaccacgggaggaacctgaaaccgtgggccccccccacgaacgcccccaaggggacagcagccgccccagacacaacaagagacaacagcacagatgaacataggtacaacaggagcaacagaagcccctcgcgagaga

SEQ ID NO: 603287 - DNA, 517 bp, Homo sapiens
tctgactctggcataacattacgtgacaaaaagaaagtcaaaatattttaccccaaaacatgtttctttgccctattttgcaatttcttccataaaggacagcattttcccccaaaagctatcctttgtggggtaaaatgtgcatctgtaaagaacatctattaacatagctagatgtttttcttccaggccctcccaatcctaaacggattaactaaaagtctaacaccttttgaagatctgaataggaaacatttgtcatctattatctctaagagcagccaccataagacttcaaaagaaccttagtctccactatcttttatcttaacctgaacacttcctttctatcaatcccaggtcttcagacaaactcaaccaattgtcaactagaaaatatttaaatttacctatagcctggaagcccccacgatcacccctttgcgttgtcccgccttcctggaccaaaccaatgtatttaatgtatttgactgatgtctcatgccaacctaaaaca

SEQ ID NO: 603288 - DNA, 205 bp, Homo sapiens
gtaattgtgcacaatatatttgaaacgcactctaatcaactcctccttgtggtacagaatataccagccatttcatctggctacgttcaccatctacaagtgcattaccatatggggattttcgataacaaggagttgaccacaattatatctgcatattattgcctttcccttttgtcaatttttctcccactaattgctggca

SEQ ID NO: 603289 - DNA, 446 bp, Homo sapiens
tcttagtcacggtcataagctgttccctgctgtgacaacccgtggtcggtcgtgacggggcatgccttgtagcgcctgcaggcgttacttccttaatcctagagtgggtcaacaatcttgtgacgaataagcaccctctggaggacagccccgtgaagaccttgtacagaatgtgttaaattacttgtacaaaattgttatatttgcctttatctttgtttgtaacttatctgtaacaggtttctccctactgtcaacaaaatatgcatgtatagtaataaggacttcattcctccatgtattctatcccttatcttactgtcattgtcctaaaaccttattttccaaacttgctcacgtaacatgttgcatgtggcttactctggatatatctcagcccttctgcacatctaagcttcgatggcgtcggtcaaatgagggaacat

SEQ ID NO: 603290 - DNA, 355 bp, Homo sapiens
gctggtaaagttggaagaataaagttaaccaagcaggccaggcacggtggctcacgctattaatcccagcacttagggaggccaaggcgggcagatccctgaggtcaatagttcgagaccagcctggccaacaaggtgaaaccccatttttactaaaaatacaaaaaattagccaggtgtggtggtgtgcacctgtagtcccagctatttgggaggctgaggtgggagaatcacttgaacctgggaggcggaggttgcagtgagctgaaatcgcgtacccccctccagcctgggtgacagagcgagactgtgtttcaaagaaaaaaaaaaacaagcagccttttgcttggttgga

SEQ ID NO: 603291 - DNA, 326 bp, Homo sapiens
cccttttcccctttggccctttttggggcccccttaaaaccagttttgtccaaaaaaccggggggggccgggccgggatttcccgggattttttccccccccgggccccggggggggggggggtttttttaacccccccattttttttttttttaagggggtttttaaaaaaaaagggggcccccagggtcccccctaatttttttttccttttttggggccttttggaaaaaaaaaaaaggggggcccccctttttttttgggccccgggttttttcccccgttttttttaaaaaaaaaaataaaggccgggggttcgggggtta

SEQ ID NO: 603292 - DNA, 107 bp, Homo sapiens
ccatagcagactgtacatgtgtgtgtgtgtcatattattcagtagactaagctttgatccttagttatgacagtaatgaattctgaatgtcacagttaatcagattt

SEQ ID NO: 603293 - DNA, 124 bp, Homo sapiens
cactgtgcgatatctctagtagctgaacgtgagactggacatgtgagttgttatcatgtacgtgcatcagcgaagcttctcgtaactgtctttgagcacactacacatgaaattctaaggtcgg

SEQ ID NO: 603294 - DNA, 433 bp, Homo sapiens
tcagaataggacttgtagaaaggcgctggagacggggtcgctctccagcttctacaagacctcccggaaattgctgttgatattcatcaggctctggaaggtgcgttcctgataggacatgaaagtctggaaggatgataatattgaaaataccatcattgttatagaaaaagccatgaaagttatcaagccccaagcaatacattcctgctggagaaaactgcccagatgttgtgcatgacttcacaggatttacgacaaagctaaccaaggaaatcatgaaagagattgtgaatacggcaaaaaaaaaaaaaaaagggggaggccggaggtttcccaggatggggtttccaaaaaaaatttaaggggctaaaagaccccacacaaaaagatttacgagaggatgcttggatggagattgagtgttaccgga

SEQ ID NO: 603295 - DNA, 231 bp, Homo sapiens
  misc_feature (134)..(135): n is a, c, g, or t
agaaaacaatgagattacaagttccaaactcagccaggaatgtggctcacacctgtaatcccagcactttgggacacctaggtgggagcatcgcttgaagccaggagttcaagaccagcttgggcaacgtagtnngtacccctatctctacaaaaaataaaaaaattagctgggtgtgatggcacacaccttttgtcccagctactcaagaagctgagatgggaggttcct

SEQ ID NO: 603296 - DNA, 273 bp, Homo sapiens
  misc_feature (262)..(262): n is a, c, g, or t
agagaaagtgatccagcaaatgtggggcatcagtgatttaagactcttgctatgcagtctactgtaccccgctcccattccacagtgaatgagtggatgacacctctgtccctcgggaagatggttttgatttgttgttgcattctttgaggcagagggagaacccagcaggtgacaggggtcccttgtctggggatgagtctttagggatgggaaagggtgggggatagaatgggccctggggattttgaggactcatggnagggccaagtg

SEQ ID NO: 603297 - DNA, 911 bp, Homo sapiens
gacacagagggtttcccattatgtcggccaaacaagacaggtggtccctccccctggagaattgagacccgccccccaggggtttctttagagagcgcaaatacacgcacaatgtggagcaaagagtgtttggcacaccacgccacaaaattggccttaggtgtgcccgcgcaaataaaatgcggtcgggaaccacaccgcacatggggaacgctttaaaaaaaaatggttggccgcaaagttgtattgtctgaagattccgcgaaaaggcgtggaaaggttttcttctaagatatgacgcccttcttccgcccgtgatattgacctctcccccgttggtttataaaatttgtcttaaaagccgactctcccttaataagacacgtccttctgtttggaaaacacttccagtggttcaacaccatctttaatatagtttgttacctaccaaatttaccccctgaataatttaaaaaggtagattattatatgcgacaagagacacgagaacttttaaattataaagggtttttttctctcttaaaataaaatttgtaatttaccgcttttattataacctcaaatttctggaatagggatatagaataatagagatgggatacaaacacgaggtgtttctctctttagaccggaagccgcctcctcaaaataattgttagccgtttcgcggcccccacacacctctgccccgcgggctcttccgccatattgtcccagcgcccaacattttatgacggcccccctcggctctgccctcgtgttttcagcagggatggaataaccgctggggtctctctttaaaagatgtgggaaaaattggggccttttacccctattccctgggggaaaaaaaaggggaatggggaaaaaagttgtccaaacccaaaaaa

SEQ ID NO: 603298 - DNA, 359 bp, Homo sapiens
  misc_feature (354)..(354): n is a, c, g, or t
tcctttgaagccttaaagccaggcatcaactcctctctagctgggaacatcctagatggcatctccttctagtagaaggctgttttgtctccattgcaaatctatttagtgttgccatcttaatcagttatcttctagatagctttctgcagcttttccatcagtacttgctggctttatcttgcggcttttatgttatgggaggatggacttttttccttaaaccttcaaggaaacaagctcttctaggctttcaggactttccttctggcaggctgccttcacccacttcttcaggtctttcatagggattggaggagaagggccgggtgccggtgggcctgttcaacaccngtaat

SEQ ID NO: 603299 - DNA, 1456 bp, Homo sapiens
  misc_feature (1456)..(1456): n is a, c, g, or t
taaggactttaatgcgacagatggtaagtgggtgaagatctgaagggcgaaggttggtctgcaggactagtcatgacgattggatcaattcatgtagatcacctctagacatgacgttatgatagcaatctgaggtaataacaaatagttgtgcctcaagagttgcattcaggagcttgatacaggcatctctacaaggccataccctatcaatgagcaccaatatgatgattgcaatcatcccgtgaccggaacttgataaagttccacaacagaatatccaactcgttcacatgctaacttgagcttcagcaatcactgctgagcgttcactgacatgaattgctgcgcttcagaacgtccatcacattgactggtccacgcgacaaatggagcataggtaacaatttgtctgagtagatttgaagatcaacggaactcggcgtgtgggcgacaaaacgcccaatgggcaaggcaccgtggcaggcacaggtgcactcggttcgaggagatcactcaaggcggtaaaatgtggaagacgaccctgggggacacaacgccatcagttttggaaaacaattcgagacactcttcgagaaagagtacacctcccacgggcgggaccctaccccaggactaaagccgaaagacaaggaactcaagggggaagacaacgccaaaagaggccacgaaggctgcccaatcactcacccggcaaggaactacctcgcacagcacggacggaacatccacctcccatcgacagaagcaacacgccgggcgcacacagcgccacttcaaatcacaccattctgagcaaagagggcatcgcgacaacgccgaatcaccacgcaacggaccggcagccccacacctgccgacccgcaaccagacggacaccaacagcgcggcggaataaaaagcaaggaacaatgaaaaaatgtgcacaaaagacgggacgccacaggacgagaaccccacgggccaccaacatgatagcaacacacggcaggacagaaaccgcaacgacaccgacatcctcacaagccggctccgcctacaagcccataccatcccaagacaagcggtaaccaaagaggcaacacccacaacaccccagcatacagacaactcccaccatccataccaccaaaagaaaaaaataaaacatgtagccacagcatcatccataaacctatcatactaccacaccacatcccaagaaagacacaagaaaacagatacatactacatatcctacgacacacacttcaatcttttttgtttgcccatcccaacgaacaaacacacaacaccacagcaacccatcaacacccacaaaacccactacaagaaacctcacggacaaacacccaccaccccacacacacatcaacaaacaacacaaacccaaccacacaacaccacaatacaaccaaccaccaacaaccacccn

SEQ ID NO: 603300 - DNA, 308 bp, Homo sapiens
tttttgaaacagtgtcttcggctgttgcccaggctggagtgcagtggcgaatcccaggttcaagcaattctcctgcctcagccgcctgagtagctgggactacaggcgcttgccaccacgcctggctaattttttgtacttttagtagagacggggtttcactgtgttagccaggatggtctcgatctcctgacctcgtgatccacctgccttggcctcccaaagtgctgggattacaggcgtgacgaccgcgcccggcctattattattttttaagcatgaatctttttaaagtatcgatgtcgacg

SEQ ID NO: 603301 - DNA, 758 bp, Homo sapiens
tgggttggagggggaatgctggaaatggtaatggggtatggagacatatcatataagtaatgctagggtgagtggtaggaagttttccataggaggtgtatgagtgtggtcgtagcggaatcgggggtatagctgtgcgaatctcataaaaacaggggaggttagaaagtagggtctgggtgacaacaatatgttggtgtagcagtctcagggcgagatgtgcgtcatatgtgggtccctaggaacgatgtgtagtgggtgagcgcgtgtaccctcataataaatgtagggtagtataccggctaatagaagatatagggccgagatgggggccctgagcggggagggataataccagatctgttgagaaacgccttgagaggcacttatgttcggagacctcccctttcgggcaaagggtcagaagggggtccggggtaagggctctggcgtaagtggtgggaagataaaatccattatatatgggcccgaaggggtgtccatagatgggggccagggattgtaaaatccaggaggggtgggtgcctatggtgtgtgaggtgcgatacagggggttgggcagagaggtgtttcaaagagtggacgccccacttatatctaaaggtcaatcgggtgggcataaatgtgagaacatgggaatggggctaaaagggggttgcactttccctatatattaggaacgacatgtgggcttgggggggggcttaaacattgggcctccggccaaaggttgccca

SEQ ID NO: 603302 - DNA, 429 bp, Homo sapiens
  misc_feature (24)..(24): n is a, c, g, or t
  misc_feature (34)..(34): n is a, c, g, or t
  misc_feature (58)..(58): n is a, c, g, or t
  misc_feature (78)..(78): n is a, c, g, or t
  misc_feature (428)..(429): n is a, c, g, or t
gggggcccaccccacctcgggccnaggaagcccnccggggcccatttagaggaaaccnagtccagaagagaggttccnaaactccacaaaaccaaaccacctggagttttccatgtgacctatttccaaagcagccatgttgaccatataggaaagataggtgaagataaatgtcaacctgaattaagtcatttgacctataatagaaaagtggaaatcacttggcatttatgaatacttcttattttaccacagtcagagatagagagagatgcattaatacattgatcacttagggcagtttatccaaagagagtgctacaaatgatcccatttcaaaataaataagtaaattcaagttaaaatctggtgcataaccttaatatgattgtatttttatgttcatgtttaaaatacatctctttaann

SEQ ID NO: 603303 - DNA, 180 bp, Homo sapiens
tgtgtgtactctaaggatccttagagctgtgacctgtagtggcaacgtctgaccttggaggacgcaacattgtgcagctcttgggctgaccatcttggcaagcatctctaactggatcgaccggcagcagcagatgatcgagcgttgtggagaagaccaccgggggacaagcggactcgc

SEQ ID NO: 603304 - DNA, 485 bp, Homo sapiens
cacatggtaggaattctttggtcattgaagggacttgagtaatgtgtagctatagctaacacttttttttttggagagcgagtctcaactctgtgcctaggctgcagtgcgttgttgtgatctcagctcattgcaacctctggctcccaggttcaagcaattcttgtgtctcagcctcctgagtagctgggactacaggtgtgtaccaccagtgcccatgctaattgtggtattttaagttagagatgggatttcacatatgtgggacaggctggtctcaaaccccttacctcaggaggcctcagcctcccaaaagtgcggggatataggcttgagccaccatgcccagccagctagcactcagtgaacttttactatgtatcaggaattgattcaagtcctttaacctataatagctcatttaattaagtggatggtgggggggccatttgattttttaaaaggtttccatttccccctcttta

SEQ ID NO: 603305 - DNA, 210 bp, Homo sapiens
  misc_feature (210)..(210): n is a, c, g, or t
aacgacggcagtatagctgtttctgagtgtaaaggactggcgagtatagctgtttcctgattgtaaaggagggcgagtgatagctgttgcctgattgtaaaaggagggcgagtgatagaggttgccggattgtaaaaggagggcgagtgatagaggttgccgggttgtaaaaggagggcgagttttaacggttgccggattttaaaaggn

SEQ ID NO: 603306 - DNA, 277 bp, Homo sapiens
agctctaatttctttgactgcgggtacttaaggcatccggtgctgccgtgatgcgcgacggcgtcttattgatgcccgagcgagagacctgccgcaccacattgaatagacttgcgatggacgttagagatggcggcggcacggctttggtgttgcgtatagaggagccagccgactcatatttcattgatctgtttgaccgcagcgaggactacgcaacactgctgatcgatatcacaaaagctcgcgataccatgtctacagacacggtacaaga

SEQ ID NO: 603307 - DNA, 1091 bp, Homo sapiens
  misc_feature (517)..(517): n is a, c, g, or t
catttttctcaaaagtagtcgttcttaccacctaaggttcgatgtgtacccactaccaaactttccgtggtttaaacgatgcatttaagatttaaatgggccactcaccgaaggaatccacatgtggttgacgaaccttattaatttgtcctcactatgaatgggctcgccagaccggtgaatacctgaagcttcttaggttccttcaatacggccagatattgatccgaagttattctcgttataattttgcttaacctatcaggttcatagaggttactcttcttcatgcctactcattcgcaaacgtctttacctaagggggaactcactatcagtgcttaaaaggttggaagaattttcccactattgtccaaagaccttgcaatgtacatttcagttcaacataggtagcttgatgtcgccagagtaatagagttctttcttatgatgagttcttacatcactaatatcatacgaggttatcaaccctggcgtattatcgttacactggcanaggttactgactagtgaatatggtcatcttaagcctagcgacccggaactctattcaagcagaccggcacagtcactcgaatgtgaattacctagaaatactcgcggttctttactaatcaaatggcttgtccattgagattatggttattcatggatacaatgggcactattaactctcctaaaccgtcactaccacctcttgaatacgagtataataagtccacatcgtatgctgatgccgttagctatgtaatgtgagaactctgtacagtatcgatgtcaaagtgaatagtacgaatgtacagatcagttcctaggcacaaatttgaccaggtgtgttatacgagacaacatgtgccgaagcttgttctggtagccaaggataactatcaaagcaaacaccagaaagttatatcatttgatgcatttttttcaacattcatacacataatacacaaatccaaagacaaatgatgaatattactgtcagtaaatataaagtcactccccgttcttcttatgccaagaaacgtccaatattttcagccattgtttatgcacacaatcaactt

SEQ ID NO: 603308 - DNA, 609 bp, Homo sapiens
  misc_feature (69)..(69): n is a, c, g, or t
  misc_feature (99)..(99): n is a, c, g, or t
  misc_feature (101)..(101): n is a, c, g, or t
  misc_feature (134)..(134): n is a, c, g, or t
  misc_feature (149)..(149): n is a, c, g, or t
  misc_feature (181)..(181): n is a, c, g, or t
  misc_feature (203)..(203): n is a, c, g, or t
  misc_feature (214)..(214): n is a, c, g, or t
  misc_feature (221)..(222): n is a, c, g, or t
  misc_feature (242)..(242): n is a, c, g, or t
  misc_feature (245)..(245): n is a, c, g, or t
  misc_feature (250)..(250): n is a, c, g, or t
  misc_feature (259)..(259): n is a, c, g, or t
  misc_feature (268)..(268): n is a, c, g, or t
  misc_feature (303)..(303): n is a, c, g, or t
  misc_feature (321)..(321): n is a, c, g, or t
  misc_feature (333)..(333): n is a, c, g, or t
  misc_feature (369)..(369): n is a, c, g, or t
  misc_feature (376)..(376): n is a, c, g, or t
  misc_feature (388)..(388): n is a, c, g, or t
  misc_feature (410)..(410): n is a, c, g, or t
  misc_feature (429)..(429): n is a, c, g, or t
  misc_feature (479)..(479): n is a, c, g, or t
  misc_feature (520)..(521): n is a, c, g, or t
  misc_feature (533)..(533): n is a, c, g, or t
  misc_feature (537)..(537): n is a, c, g, or t
  misc_feature (540)..(540): n is a, c, g, or t
  misc_feature (580)..(580): n is a, c, g, or t
aaggctggatttggcgttggaggctggggccggcggtgcctgggaaggcacatgaggcttctcggcacnggacccatgagcccacactaaacctactcntncttcttttgttgaagaaatctgtgacagcgganataactgacggaaanagtgaacatctcaagcgggagcattcgctcantaatccctatcaagggggcggngccagctctangccccgnngggacttccagggcatcacnagncgcangatccaggncggacggcngacccctgacgagcgcacaaagagggcgctagtcnggaaccaccagccgggcngccgcaaagacngttgtaaaggcacggccacggcaaaggccacggcanagggaanaagaaccgccanggagacggcatcgccttgtggnacacccgggaccgcctcgngccagggcctgtgtttggaagcaaaaataacttccacggcttaaccatcntcctggacacctaccccaatgatgagaccactgagcgcgtnngcccgtacatcncggnganggtgaacaagggcgcccgggccgacgaccacagcaaggangggcgcgggaccgagcgggcgggcggcac

SEQ ID NO: 603309 - DNA, 114 bp, Homo sapiens
gagtgtaccaagactgactgctagaatcccatcatttctcatactagaaaacagctttcagaagaagaaagtgacttgcctttattaaagcattatttatgctgtaacacatga

SEQ ID NO: 603310 - DNA, 180 bp, Homo sapiens
  misc_feature (118)..(118): n is a, c, g, or t
tcgcctggtgcatgttgtggaaattcaagtgaggtgaaatacatttcagggtagagagtgacaaaaagggaagctggagagctgggtggggcacatgatggagtcttttgtatattcnaggtaggaatggcttgcaatttgttccccgtgtgcaagtgagggagctgctgaagtggtttt

SEQ ID NO: 603311 - DNA, 1171 bp, Homo sapiens
tcccgggttggtctgttttttttttttaaaaaaagtgggaaaaaacaaaggggtctttttccccccaaaagtgtgtctccccctccttttttatgttggtggtgtcgcccacagggtgaggtcccagtgacacttacaaaatgtgatacgcattttactcccccaaaaaatcccggtatcacaccacgcgtcttcaaaatcaatcggcagacatattcccttagaaagctgttcgtgttaacatatctcctgcacacgtgtggggaaactcgcgctattttctcaaacacaccttgtggcgctcttaaaactgggggccccgtgaagagagatcctcgcgcccacctttttacaccactctcgcccgtgcaagcgaggagggggattcctttatagagagagactatctgcaagagtgtgcttgtgcaaccctccgagagccaatacacccgatatgtcccccgtgtaaaatcttcttccacccgcgtggtgtggggggacccctcccgcggccatttttcagccctccgcaggggggcgcgtccctcctgtggggacgcccccctccagtggggggcccaggggtctgtgtggcaaattgtgggggcccccggtacctctcggaacacacacatttttgagggtgggacccctgtgtgtgtgtgtgcgcccaccatttcgagagttgcgctctgtgagtgtgtaacaggggatatacttccttacacgcgcggggcgcagatcttttgcatgctgtgcgtcagtgcccccacttgtatctccggtcgcccacggtggtctcccccggtgggggggcgccaccaactggtgggacccccttttctttcacaagaaaacagaaaaaaaaagggtgtactcctctcccacacagacatacgtgatgtagagaaatatgtgggtctcaacacgtgatgtgaaaacaccccttagggtagtttagacgacacccccccaagaagaggggtccttaaaataaacaactcctgatgagaaacgcggcgccccatctacaaagcggggccacgcgttgtgacagtgacgacacgagagcgttacacccacataacccacggtgtgcctcgaccaccagaaccaatggccgcacccactatcttttggaccacatctgcgggaaaaccacaaggtggcg

SEQ ID NO: 603312 - DNA, 309 bp, Homo sapiens
aagtcctgacccatgaagacatacagaatggggttcatgcagctgttggcaatggcaatggcagtggccaggggcacacccaagctgaagacggagccaggcatggctctgtgatggagctccaggaggtagagcgtatggtaggggcaccagcagaggaagaaggtgataatgatggtcacgatgatcttgaagggcttcttggtcttggccaggcggttgcgccgcagcttatagacgatagtgaagtagcaggctgagatgatgagcactgggactaggaagccacataggaagcgtgtgatgacc

SEQ ID NO: 603313 - DNA, 308 bp, Homo sapiens
agtgtcttcaagaggatatttggatagctttgaggatttcgttggaaacgggattgtcttcatattaaccctagacagaagcattctcagaatcttatttgtgatatgcgctctcaactaacagtgttgaagctttgttttgatagagcagttttgaaacactctttttgtagtatctggatgtggacacttggagcgctttcaggcctatggtgaaaaaggaaatatcttcccctgaaaactagacagaagcattctcagaatcttatttgtgatatgcgctctcaactaacagtgttgaagctttg

SEQ ID NO: 603314 - DNA, 1326 bp, Homo sapiens
  misc_feature (1254)..(1254): n is a, c, g, or t
agcgggggcccggcccctggtcgaagctaggtgaaggtgagtgtctcctaccagatcgcaattgaggcaagagctgacctgccaggctccgggcgtagggtgaaagtctctatgattctctagatcatctctggatattggctaccgtccggtccacgtcgtttgcctgcaggttctcagcgaggctcctagcgctgtcactcggctcttcccagctccacttgccggactctcagggtagagtatccaggcaccccccctgcgatggttccaacctgagcagttgggtagccttagtctgccactggtagtgtcttggcgctatgcgcccttggagctttattaggcccaacggtcagatcgaatgcaagaagttagcggaggaccaggacccgtactttgacctgactcggagccaaatcaagaccatgagatacttcgaccgaagattactcgtggacccgaaaatcacctggagtggccatagagtctagtaggatttccccggagaagcgttgtcggctatcctacgttcacttgtgccacatgaggggtgatttgcacagcaccccagcgaccttccacacggacagagacagctggcggtaagaggagacgttgttgccaaaatacggctttgggcgcgaggtaatccattgtagtccccttctttcgccaaatttagtggatcctttgcaattttcgtaaaagcggccgtaagggttgcctgatagggaaagcccacaacgatctagagaaacgcggcacctggtctctattcgcgtggtccttccactgcgatcgccatggggcgagataagtctacataggtgcaatggtgcctttctggcgggcatgggatggagcttgtgtatgactaaccagtttctggggtcgcataatctgactgagcctgtggttgaatgcccagacaaagatcacagaagggaaattcggggagccctccccaggtgggcacttatcctttgcaaattggagtctttggggcaagaataattgccttcccgttggcatgttttcttgccgaatatggtttggtccctttcccaaaggccctttgtgttgcaccagcgatgtgcccccacagcggtggcggaatgtgggagcgcccgcgatagccttccggggagacaggggtggggacaccgcccgggatttttgcctcgccttggtctcgctgcacacgcaccccggggagtgcgtgggatccccccctttccgtttttggagccntctcaaggccctaagtgcgcgggggcctctcgcggacatcctgtggcacacccctggtggtatagacgcctg

SEQ ID NO: 603315 - DNA, 101 bp, Homo sapiens
aattaaccactcattcatcgacctccccaccccatccaacatctcgcatgatgaaacttcggctcattctggcgctgctgactccaaatcacacagactat

SEQ ID NO: 603316 - DNA, 1322 bp, Homo sapiens
ttttgggagtgtctgggttccattgggtccctttctgttgctcttgcggtggtccttggggttttcctttgcgtcgttggtgtctggagtttttattgtgtgctctcttgctgtgctgttctcccgtggggtctctgttggtgatctgtggcgtgttggtccggtgtattgtggtgggtgcctttgggccgcttgttctactgcttggctttctgtgtgttgccgtggtattgttctttgtgtgcctctcttgtgtctgttttgtcctggtggttctccttctgtatggtccgctagtgtggtgtgcgttgggaggttgtctatgtcccgcggcatgcgtttggtgcttgtttgtggtgctgttcgttattggttttttgttctgggggttttcccgcagatgttgctcttttgtgatttcgtgcggggtgcttctgctcgcgtctcggtcgggtgtggcgcgcgtagttcgctgctgctgatcgcggtatgtgcccggttgtgccgcgtggcggcgctgtggtcgtcatgggccttgtcagccatttgttgggtctttctatgcgaggtctgtggctgtgttcaggctcgcagtggtcgagcagggtcgtggcggttgggtggaggcttttaggtcgcgatgtgagtcgttgagttgctcttgggtcattcgtcgctcgcgtgcacatggggggctgttgcagcgcccgtgtctagcaggttggagctgagttttgaagatggtagttttggagtggggactttgtgtcaaaggcatctgtacgctgaggtgctctaggtatcagctcgtatgggcttgagcggatgatgtcttttttctctttgagactagggtctgttgtcgtgttgcccaaggctggagtgcagtggcgcagtcagcagctcactgcagccctgactccccaggctcaagtgatcctcccatctaagtctcccgtatagctggaactacaggtacacaccaccctacctggcttaatatatatatatatgtttttttgttaagagactgggtgtcagtccgggtgtggtggctcatgcctgtaatcccagcactttgggaggccgaggtgggtggatcacctgaggtcaggagttcaagaccagcctgaccaacaatggcgaaacccagtctctgctaaaaatagaaaattagctgggtttcggtggcacatgcctgtaatcccagctacttgggaggctgaggcaggagaatcgcttgaacctgggtagctggaagttgcggtgagccaagattgtatcatgcaggtcagcctggtacagcaggcttcccccccccc

SEQ ID NO: 603317 - DNA, 197 bp, Homo sapiens
tacaatttaatgataaaaagacagataaccaattaaaatatgaacaaagaatttgttttattatactttaagttctagggtacatgtgcacaactatgcaggtttgttacatgtgtatacatgtgccatgttggtgtgctgcacccattaactcgtcatttacattaggtatatctcctaatgctatccctcccccc

SEQ ID NO: 603318 - DNA, 495 bp, Homo sapiens
tcaacctatatgataagacataagtcctgctgtacatacgtcacgtagaagaatataaggtagaacagtaacacgactaccactggtacaactacaaacgctgatactagtcgactctatctatctataaaattcccccaatgcactaagggcctaagatagagaagatactgaaacatgctacgatactcattggtcttagaaagactatacagcaagtatataatagaaagccactacacttccagctactaaaaaagagccagacacaaatccctgcttccagagttcaccattcagaatacaggaggtcaagcactgattctgaatcatataatgggctaagatttcgtctttcaagatcagcatagatactgattatctataccggaaagggcaaatacaatcttcccttacacacatcattctataggattctcgtaaaggagtaatcgcagtctgtatgtagccaaggccagtagatactatagtatt

SEQ ID NO: 603319 - DNA, 202 bp, Homo sapiens
accgtactattatttattagactgtggtatcagtctatcttataaattacattgtattaggccgggtgcagtggttcatgcgtgtaatcccagcactttgagaggccgagagaggattgcttgagtccaggaggtcaaggctgcggtgagctgtgatcacaccactgcactccagcctgggtgacagagcaagaccctgtcc

SEQ ID NO: 603320 - DNA, 333 bp, Homo sapiens
cagaatctagagtgatccctttggcatgagcgacgacaccccccattaagtagtgcatagtttgagagttcagcattagactccagacatactgttgaaattggggcacagagaggctagtgattagtcaggctcaatcagtggagtagggagaggggagcggatcctggggcggggcagacttaccccgtgccaggaccactccggctccctctggtatgcaaaatctgaccttggcgtcggacccccaagatgtgcttttagacgactcaagcccaacatctctagtctgggacctgactccgtcccgtcgctctgccaacgggtacccgc

SEQ ID NO: 603321 - DNA, 843 bp, Homo sapiens
  misc_feature (1)..(1): n is a, c, g, or t
nggtattgcctacttattgggataccacgtttacccgagcgctaaacggcttggagtgcctctttcacaagggtttgtccgagccttccaaaggcgcccgttcaagcacacgggggtcgtcgccgcccccattgggttctgcccgccttgcgtctgggccaaacccgcaatatacctgtctagggctcccccccacgatgacatttgcggggaaagatgctgccagttataaagcaccggttgtagctttgtaactccagctcgccggacatgttaactttcttggccgtagctcacgggagtgcagaaatcataactgggagttcatacctagtaaagttttcttcctaagccccttccacaccccattggtaaaaggacaatttgtcaaccccggaatctacttattaatcttggggttcaaaaaaaccctccacttcaaacgcacaggccccctgcgctcacttccacgagcccctcgggttaaaaatcgttgcgtgttttctaataaagcagccccacatgcgcccctctatagaatggtatataatattaattcctggtacacaacaaataattcaggtcccagttacagcaacaaacttggggagaatttattctccccacctattaatcgggccccaatatgccatacagccttataaattagttcgcccccccgtattatcccagaaaccaacgacaccgcctcttcttataacaaagtcagtccactgcctttaatatttattatacacattgtcgggcgaacaataacgtggacctagcaccatcggtcacttccatcccctttggagaacatcaaaaactaaaccccccaca

SEQ ID NO: 603322 - DNA, 468 bp, Homo sapiens
gtttgataatgcgccatttttttgccccattgtggaaacccctggtgtcattccccgggactgtacccctccttggtgaagatgactacccccatttctaacgagtgtcccccgcttgaggaacaacaccactgccagaatccccacctctgggggggggacccagccacgctcagggggagagtgctgcttattaagcaccgctgttatcatatagacgaagttatactttgtatagagacatcttattatgcagcgaggaatatataagatttcttcacatatgcgccacacgagtgcttgctcaagcatgtccatgtcttattttaatagtacacctagaagccacccccatttgtcgaacactctcctataaccacctgtcttctatgatgatcatgaagtgtcttctgttcaccatccctttttccaataaccctcttgtctcttctccaacccaacataaca

SEQ ID NO: 603323 - DNA, 279 bp, Homo sapiens
  misc_feature (4)..(4): n is a, c, g, or t
ctcnacgctttatacttttgactgctcttgtacccaccaagagggcaggaacttatccatctgtttgcaactctgaccttgcccaccaagtagctaaaaagtgtttttctggaaagaatagattgattgaacaactgcctgtaagatctgaaatgccacctactactggccgagcgtccagagtactaagtcatcagccacctgcaggtgctcagggagctcatgtgcatttgctgagctcgcagttccaagccctgccccaggcttgtcttgaactcc

SEQ ID NO: 603324 - DNA, 100 bp, Homo sapiens
aactgccctctgagagtgactgaacaacagtttgaaatctgcatagtggagcctgagactgtgccattgcattccagcctgtgcgacaagggcactccat

SEQ ID NO: 603325 - DNA, 378 bp, Homo sapiens
  misc_feature (98)..(98): n is a, c, g, or t
  misc_feature (209)..(209): n is a, c, g, or t
  misc_feature (291)..(291): n is a, c, g, or t
ttttaaagtattaaaaaaaaaagaaaagaaaagagaagcctaaataagcttaaataaactgcttcttataaatgtaatacagacatgccggaacacanaaggctaaaagaatgttaactttattcatgaacatgtggtgtgtgtttatacacatgctaataaacaaaaaggaaataactgttttcaagaaacaaaacttcatctgaatnagtttaaatactatataaggtgtactttatacaaaatgtgttacattaactactacagtcaccaggatagtcaatctaattnatgctagcatttggatacataaaaatcagttctaaaccaatcaccagcaaaacataagcttggacagtttttacagcattatgctta

SEQ ID NO: 603326 - DNA, 151 bp, Homo sapiens
  misc_feature (44)..(44): n is a, c, g, or t
  misc_feature (71)..(71): n is a, c, g, or t
tctgatatcatgtgtatcactttcttttgattgctcagtagtantccatcatatgaatataccagttccantcttgttttgatagaaacctgggctgtcttcagttttttggctattataaataaagctgctgtgaacgttcttatataaa

SEQ ID NO: 603327 - DNA, 228 bp, Homo sapiens
ggcaccgagcccagcgcagcagcctgggacccggattgggtttgccttaggggataggtttatacagatgaatataaaaggtttttttctttgggcttttgggttcttttttcccccccttctcaccttcccttctccccgacccccccccccaaaaaagctactttttcattccgggggacgattattttttttaactaaaggaagataaaattctaaaaaaaaaaa

SEQ ID NO: 603328 - DNA, 984 bp, Homo sapiens
  misc_feature (505)..(505): n is a, c, g, or t
tcagagggggagttgtttttttttggccaaaattcccccaaaagaggggggggtttttttaatacagggttcctttgaaaaattttttacaaaaaaaaaaagcgtttttttatcttttccacatttctatgctatctctaaaaaaaagctgaaaaccacttcttaaatcaaaatttcctaccacaaaaatgcggcgctctttgtaatgttcaaatctgctgtttttatcaaggtgtaatccctccccccaaatatatgcccacgtggctgacaacaaaacaacaaatatctcggttcactcaatcatatgtttctctaatggccatctaaagcatattttcacaaactccacatgatatgaattcaatttatttgttaaataaagcgccacagaaatatttttcactacactgtccactcccccaatttattgttgttttatctactacgaaaaaagacattttggtttatcatctcctatattagtgtggtacaagaaaactcnccttattataggtactcccctgtgcttcaacaacaaacagcgagggttttttgttgtggtcattattgttaacccagtcgtgttgtgtgtcccaatactctgttgcaaacaacattttcttttgcagaacaccgccaaaatatttgtttctacgactctctctcttattagagtgcccccctttttaatagcgtctcagccaggcggctctctactctacgtggggctttggccgtctaggcggacaacacattgtcgtctgtgcgcgacggggttcatctcagcatacttattcagcagcgggttacgcgaaatatccaacacacgtccgcggaatgtgggaccgcctggtgtggtgcgggtacaacacgcgtgctctccgggacttctcagacgcgagtcgggcgcttccttcgcaacctctatggctttcttcctctcccccagatattttctttgggcaccatttgtgttccccc

SEQ ID NO: 603329 - DNA, 312 bp, Homo sapiens
tcccgtgactcgatggctgtcataaccatcctcgaactcgtggttgagtacgctgcggattacaggtgcccgccactatgcccagctaattatttgtattattgagtagagacggggtttcgccatgttggccaggcttgtctcgaactactgacctcaggtgatccagcatgccttggcttcccaaagtgctgggattacagacgtgagccaccatgcctgtacttttgtttcgataaacatgaattcatgttagttgtataatttggtgatttctttttgaaacggagcctttctctgtccccccggctg

SEQ ID NO: 603330 - DNA, 638 bp, Homo sapiens
tcactgagcgagccgccaggctatgaccccaggtgctctgctgatgctgctgggggcgctgggggcgccgctcgcccctaggcgctccgcaggctcgtgaggcgcgacgggtcgactccggggcgaaacttttctctggctatgactacgctccgctgcggccagctgcggcgcacggctgggacgaccgctgtcacggtgtcagcgttgcgtctcactcctggcgctaactcatcacgcctagaacggagaacggatgacacgacgactgacgcacacacacggtgctactctacagcacctggacgctggagctgacttacagcgcctgacgcctggcgaacccccttgcccggcgacgccacccgaaccgcgcccacttccgcactttccgccttcccgcaaactccacggggccgcgcacactccgttggtggactccctgcaccgtggtgcctacctagacacacaccaactgcactgggaactcttctcaccgctgtcgcttctcgggaccacttttaaggccgtccgccgcgctggttcccttcccggcaccgcggcttcccggttggccggtttgggccaaaacccccccccgggggccaaattccttaattccggccacgctccaccct

SEQ ID NO: 603331 - DNA, 222 bp, Homo sapiens
ggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacc

SEQ ID NO: 603332 - DNA, 216 bp, Homo sapiens
tgctgggactgcaggcatgagccactgcacccatccagaaagtgagtatttgactttatttctatgaagtcatgaaggaaagggagaaaggacagagtctgcaggaggatttatgagagagagaggggttttccattttaatatgggaaaaactttgcatgtataatttgagggaaatgtacccattaaatatatactgctggagggggccgcgcg

SEQ ID NO: 603333 - DNA, 83 bp, Homo sapiens
ggcacaggccaatcccttagtccctcttgcgtcgaggctgcaaaatggttccattcgccaggagacgctcctgagagaagggc

SEQ ID NO: 603334 - DNA, 218 bp, Homo sapiens
cttactttgttccatcgtggactggggcagccattgtctacgttcttcttccgggagagttgcgcatggacgtttaactacctggagaagcgtggtggtgctcccgcagtggcccgcagttgtgcaagtaactgacgtgtcgatgctccaccccgccgttgctggagaaagcagatgtacggttcttctctgaaggcgcggtctcacactgttcgtgt

SEQ ID NO: 603335 - DNA, 528 bp, Homo sapiens
cgtaggtatgcctgcaccagacacaacccaagctcaaaactcaaaacatgttctaaagtcagctggaaacagtatttaatgtgctccaagtactatttatcccatctggaattatagctttcatcaacaaaaaagtgattagccttaaatatatactagaaataaaagccagtgtacagcaacaacatggttctattgtggaaagtctccgagtgcctgtttactgggaaaaaaaaatccatcctctttttctgttcatttatcatgaaaatgtttcccccttttaagaagacaatgagaaaggaagttctctaaagttctttgcattaagaaattatgaaaatagctgtgcttttacatttcctgtaaaaagcaacatctgtcatttgccatttcccctcattgcagtgagtaaatgaagccattccagatccctgaaagcaaacagcaatcctccaaatgcactgtggaatttcagttctgcctagcattaatcacattccaagcagactggtgcaggcatacctc

SEQ ID NO: 603336 - DNA, 274 bp, Homo sapiens
caaaagacaagaaccaatgtcatttgatcttttatttctgaaacactcaaacaccttacaaagtgctgagttgggtcactattacctactcagcactttgtaaggtgtttgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaatttttt

SEQ ID NO: 603337 - DNA, 220 bp, Homo sapiens
tggcgccgaccggaagggacttgtgaccctggtcaggctgagttttctgcttccctaatgctgcctcaggtccagagcaattggaatagaacagaagttgtgttccactcactggtggtcctaagatagggtggagagtcctctcgggaccttgggggtgtccgccgacccgcacccaagatgacccggtgtggcgccaaccggaagggacttgtaggcc

SEQ ID NO: 603338 - DNA, 154 bp, Homo sapiens
  misc_feature (56)..(56): n is a, c, g, or t
ggctaaggtggacaagaaacaattttttaagttggtgcgccataaaagcgccttcngtcagggtatcgcctgagagagcaggacttaccacccctctagagagtcagaagagataagttgtgactgtttctatttggtttggaaatagccgctt

SEQ ID NO: 603339 - DNA, 338 bp, Homo sapiens
  misc_feature (11)..(11): n is a, c, g, or t
  misc_feature (20)..(20): n is a, c, g, or t
  misc_feature (31)..(31): n is a, c, g, or t
  misc_feature (41)..(41): n is a, c, g, or t
  misc_feature (89)..(89): n is a, c, g, or t
  misc_feature (175)..(175): n is a, c, g, or t
  misc_feature (177)..(177): n is a, c, g, or t
  misc_feature (190)..(190): n is a, c, g, or t
  misc_feature (241)..(241): n is a, c, g, or t
  misc_feature (244)..(244): n is a, c, g, or t
  misc_feature (255)..(255): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (280)..(280): n is a, c, g, or t
  misc_feature (299)..(299): n is a, c, g, or t
  misc_feature (318)..(318): n is a, c, g, or t
  misc_feature (320)..(320): n is a, c, g, or t
  misc_feature (325)..(325): n is a, c, g, or t
ccctgcttctnggggccctnctgggaaccgnctgggctcgngaggagccaggatctccactgtggagcatgcagggctctggtggatgnactagaatgggaaattgcccaggtggaccccaagaagaccattcagatgggatctttccggatcaatccagatggcagccagtcantngttgaggtaactnttactgttcccccaaacaaagtagctcactctggctttggatgaaattcgnctncttaaaaaggnccttngnttnataggaatgaagganacagactcagaaaaaaganttggcgtctgtctcatttngnaggangctgcaggcttat

SEQ ID NO: 603340 - DNA, 481 bp, Homo sapiens
aacgggaagtgtggggagtgttggtgtgtaaccccaacaccgggaaatgtatacaggagccccccaccatccgggggaccccgagtgttatttttttttcaataaacagcagaaggcttggggggtgacaccccagcggaaaaagaagacacaaccaagcgggggtctggggcccctgctccccccccctctccaaacaccgacagaaaaagaaaagggttgggtggtgggggttggagaattttcccagttctacaaccggttttttttttttggaaaaaagacagagccgaaggtggggcccctcccgggcctcttttttccaagaggaaaaagccacacctgctcttttttgctttccccggggaaaaaaaggggttgtggtcgggaaattggggtacaggtttggggagggggaaaaaaaatttttatttttgaacccctgtgtcccttttgcataaaattaaaggaaggaaaagta

SEQ ID NO: 603341 - DNA, 170 bp, Homo sapiens
ttgaattcgccgatatgtatgatggcagtgaggggcgcaatgatctaggctatatatcgagatatgtagcggtaagtaacaagtggactctagaatatagtagatgcgaaataaaagcgtgatatcgatcgcgcgcagatctgtcatgatgatcattgcaattggatcca

SEQ ID NO: 603342 - DNA, 233 bp, Homo sapiens
cacgaggacaactcctactacgtgatctcattcatgaaaggtagccactatgaatttacaagttgtggagcaccagaacaggctgctgggctcaggcagggtgggacaggttcccacaccatgggctcagatcctggacacgatgcagaggggatccaggctgtgggacgtgtgaggagtgaaaggaacccgacatgggatgttggagtctgtgacagggtgatttcggtgtc

SEQ ID NO: 603343 - DNA, 166 bp, Homo sapiens
ctgatcaggtctcgttgataggttatgttgtatgtgtggtagtagcgcattgtgttgtgtaatatgtaagggagtatagggctgtgactagtatgtttgagtgtgtagtatgagagtgatatctgtcaggagacgtggtactagcacagagagctctcctagtagg

SEQ ID NO: 603344 - DNA, 728 bp, Homo sapiens
atgcatagacgctcacactttgtgggctgatggacacggggcagccgaagctggacctgaccgagtactgcatagtgcttctcatgagcatggagctaccgacaactacccataacttagaacccatgcctaactcatacctcgctttccgagaccattgtagcgtgctttaaacagctcaagatttatatggaaactttaaagacttagtagactatcaggatgaaagatttgataaatgtattctaaaacgtgacggaacatgggaggaatgtgtattacagagggaagaacgttgttgggagaaaagtgactgattagtgtacagagcctcacagaatgaccgattgaagggtaacgcttctagaattatcagagtgtgagcttaaagaagtactgcttagttcaaacgtgtgaggtgaatgacttattatgtatgaccatacttaaacagatactgaaccgcccgtgattccttatcgcgtaatcatgacgctgaagaattgcgcattaaggcctgataacgcattatatcgcttacgatgtgtctagataaatggacagttcctagaacagcttgagagcttcttgtaggcacaggacaggatttactggtcccgtttcagattctgtaggcccgggaagaagaaaccagggttactttcttccctggagcttgcaaacttgcatctaactggctggagtatacaccgggcccgttgccgctt

SEQ ID NO: 603345 - DNA, 131 bp, Homo sapiens
gaaactgaagagacatgggtgttagtactttacccactgacaaatgaagtttacactccaccctctcttccagaatcaagtctgtctccccgtcagctagaaggaaatgtggtacaaaatgtcctctcttg

SEQ ID NO: 603346 - DNA, 420 bp, Homo sapiens
  misc_feature (1)..(1): n is a, c, g, or t
  misc_feature (10)..(10): n is a, c, g, or t
  misc_feature (50)..(50): n is a, c, g, or t
  misc_feature (54)..(54): n is a, c, g, or t
  misc_feature (56)..(56): n is a, c, g, or t
  misc_feature (284)..(284): n is a, c, g, or t
  misc_feature (343)..(343): n is a, c, g, or t
  misc_feature (361)..(361): n is a, c, g, or t
  misc_feature (379)..(379): n is a, c, g, or t
  misc_feature (400)..(400): n is a, c, g, or t
  misc_feature (408)..(408): n is a, c, g, or t
nttcggcacngccaaggtgctgacaggccttagaagaccaaggaccgacnggcntncccccagagctcaggggtgcagaccagggcccgcctccctcagacctaagtaagagtccagactctagctgcctcctccctcagaccctaagtctgggcccccagccctcctccctcagaccctgggagtccaggcctcagaccctcctcccttacatccagggagtacaggccccacccctcctccctcaggacccagggagtccagtttccccaggcccttccttncggccagaaccagggagtaacagggtgtttatttttttgaagggtatttcgattcaatnggggttttggatttaacntggaaattacaaaacccntttttggggcagttggatttncaattttncttttcaggcct

SEQ ID NO: 603347 - DNA, 1369 bp, Homo sapiens
  misc_feature (1)..(1): n is a, c, g, or t
  misc_feature (13)..(13): n is a, c, g, or t
  misc_feature (27)..(27): n is a, c, g, or t
  misc_feature (59)..(59): n is a, c, g, or t
  misc_feature (71)..(71): n is a, c, g, or t
  misc_feature (156)..(156): n is a, c, g, or t
  misc_feature (390)..(390): n is a, c, g, or t
  misc_feature (606)..(606): n is a, c, g, or t
  misc_feature (731)..(731): n is a, c, g, or t
  misc_feature (748)..(748): n is a, c, g, or t
  misc_feature (872)..(872): n is a, c, g, or t
  misc_feature (874)..(874): n is a, c, g, or t
  misc_feature (882)..(882): n is a, c, g, or t
  misc_feature (922)..(922): n is a, c, g, or t
  misc_feature (947)..(947): n is a, c, g, or t
  misc_feature (1024)..(1024): n is a, c, g, or t
  misc_feature (1058)..(1058): n is a, c, g, or t
  misc_feature (1062)..(1062): n is a, c, g, or t
  misc_feature (1065)..(1065): n is a, c, g, or t
  misc_feature (1068)..(1068): n is a, c, g, or t
  misc_feature (1105)..(1105): n is a, c, g, or t
  misc_feature (1128)..(1128): n is a, c, g, or t
  misc_feature (1149)..(1149): n is a, c, g, or t
  misc_feature (1197)..(1197): n is a, c, g, or t
  misc_feature (1206)..(1206): n is a, c, g, or t
  misc_feature (1266)..(1266): n is a, c, g, or t
  misc_feature (1271)..(1271): n is a, c, g, or t
  misc_feature (1279)..(1279): n is a, c, g, or t
  misc_feature (1321)..(1321): n is a, c, g, or t
  misc_feature (1360)..(1360): n is a, c, g, or t
ntgggggcactangggaggcggcgggnccttctgtacaagggacccaccccggcgcatnatgggcacatcnatggggcccgcggttgcgccctcgcgggtgtttgctctacatcgggcgatcatcccccaccgggacgcgggtgcagccggccccnccgacaggcgtaggagggcgagatcatttagctctcacgtacttctgcacacgcagccatggcgcgcggaagggtgtatcctgaccattcagcatagatagagtatggaagaagagtgtataagacaaatctatcatgtacgactcttacttatagtgattggagtgctagtgttgacgtgtgatatatttaaataccgacgagaggattcactcacacatactgtatgcggtncagcaatacgaacattgacgcaggcgaccgtcgccgctcagtcgcccgaagaaccagcgacgacgacatcacatacgcgatgagcgggagcgggcggcggcgcgggtggccgcggcgcgggggaacgtctgcatataactataatatgtaaactctctcaatatcatgagatgtacatttcccaactcaagatagtgtattgtgtgatatgtatantcatgcgactgattcagcccattaacatgaacacaactacggtataccactcagtctcccgcgctctgcgggcggagcacgaagcggtgcgggcgcgcgccgtctgcgttccgtgtctcttatcnctatggcgtatcagctncggacaatgtggtgacggtgtatgtgtcgcgctggtgtgggcgggcgggtttgtggtgtgggcggcgctgcagctgtagggtggtacgcgcgtggcgcggcgcgacttgtcaacgcgtggctcngngcgtgtangtatgccacgcgttatgcgatctcgctgccagtcgcctcncgactcgtcccgagtcgtgcaggcngctgcggcgccgccgtgcgggtcagcgagtgaaggagtgcgtgacggtggcggcgatagaggctgtcgcgcgtgggnccgcgcgcacgcgctcgcttgcgtgtgtcacagntcgngcngtngacggcacgacggcgtgtcgttacgtgcgtcgcacangactacacgctcagcgtagttantgtcgacggctctacgtcgcngttatcggtatgcctgcgcgccacgcgacgtgcgaatagaaacgcagngacgacgancacacatctgtcatatagcgtggacacactgatcgtcagtctcgtcagcagacactcgcncgcgnctccgcgncacgcgcgcgcgttctacagctccgctgcgcgctcacgtgcnctcacacaggcaccgtcaccacgcactaacgcacaaccntagtcaggc

SEQ ID NO: 603348 - DNA, 293 bp, Homo sapiens
cggaatgcgactcaagcacgcagagacggtggagatggtgtcatcgccacggtgacgggctccctgagcctggtgactgtcgtgggcaacatcctggtgatgctgtccatcaaagtcaacaggcagctgcagacggtcaacaactacttcctcttcagccgtggcgtgcgccgacctctatcatcgcgcgctttctccatgtaacctcatacaccgtgttacctcactcaacgggctcctgcgcctctcgggcgccgtggctctgtgaccctcgcttgagactcaggcactgt

SEQ ID NO: 603349 - DNA, 212 bp, Homo sapiens
agtccacgcagacgatggcttctaggaaaagttggtgacccgcggcgatcggtaggacatgccgcagcctttggtacaaaagtcgtggcacctttgcccgggaccccctagggccttaggttgtgccttaaaggtcaaaaatatggttaagccttcaagggccgcgatggacgagtaatttgggccgataattttaaaaattaaaagtatta

SEQ ID NO: 603350 - DNA, 989 bp, Homo sapiens
gcggttccggggtctccaacgatttttcccggctgtggtcctacatctgtccaaagcagaggcagtggagcttgaggttcttgctggtgtgaaatgactgagtacaaactggtggtggttggagcaggtggtgttgcgggaaacagcgctactgactaactcgcaggctaatccagaaccaccttggctagagtgaagtatgatcccaccatagaggattcttacagagaaacaagtggcttatagattggtgaaacctgtttgtcggacatactggatacgggctggacaagaagacgtacagtgccatgagagagcaatactttgaggacaggcgaaggcttcctctgtgtatttgccgatcaataatagcgaagtcatttgcggagtattaacctctacagggagcgaccatataagcgagtaaaagactcggatgatgtacctatggtgctagtgggaaacacgtgtgatttgcgaacaaggacagttgatacaaaaactaagccccagcgaactggccaaagagttacgggattccattcattgaaacctcagcaagagctgacagggtgttgaagatgctttttacacactggtaagagaaatacgccagtacgagttgaagaaaatcaaaggagtgatgatgggactcacggtgtatggggattgcatgtgtggtggatgtacaagatgctttaaggtttgtcgaaaagagccatttaagctgcatgaacctgtgtctgattctggggagaggtatacggtggtgtttagattaggagagggcgtgtattccagttagagggatttgagatctttattgaagtccaaaatagctgtatggtgtggacagaaggagctgagtacggttatagggggtgtaagaaaactagctgggttttgagattttagaaacgatgatattagtgtatagaggtttttggaaaggaagaagatagtagtattgatcaaattctcaattacgt

SEQ ID NO: 603351 - DNA, 425 bp, Homo sapiens
aggagagagagagagagagagagagagagagagagagagagagagagagagagagagagagagagcgagcattacactgctaggccctgtcagcttggggtgggcgcctctcgtacactgcgcactggacccgctttgctttcggagcgtacattcacttcttttctctattgggttacatcagtatatggcgtttctgcagtggcaatttgctgttttgcacacgacgctttgtcagatgttgctcattgtcttcttcctgttcttgggacctacttgtgccttcttgatgtgcttggtgctctgtattgtgtcatagctgctatttacctctttctccttcttcggtttgcttctgtatttcgtgatctcttgcgatcctccggtcttgtgtcatgtcttgttctggtgtgttggctcgccgc

SEQ ID NO: 603352 - DNA, 279 bp, Homo sapiens
  misc_feature (41)..(41): n is a, c, g, or t
  misc_feature (64)..(64): n is a, c, g, or t
  misc_feature (87)..(87): n is a, c, g, or t
gggaggctgaggtgggaggatcactttaagccaggacttcnaagaacagccctaggcaacatgngtgggacctcaatctctactaanaatttaaaaattagccaggcatggtagcatgcacatgcagtctcagctacttggggggctgaggcaggaggattgcttgagcccaggagtttgaggttgcagtgagctgtgatcacaccaccgcactccagcctgagtgttaaaacaagaccttgtcgcaaaaaaaaagtcgacgcggccgcgaatttagta

SEQ ID NO: 603353 - DNA, 655 bp, Homo sapiens
gttttgagattaaatgacaagatgggatcttaaaagtgatttaaattatttggagctagaactagactggaactccttcatagactgtgtgttttatctcagcttcccagtgcctcacgtagcacatggaaaacagtggttactcaacacattcttgtcggctgggttcaaaaggctgaacgacatcaaaacaagtgtaactcctcttgtagtcatggacttcagatcagaaatttgatatttattgttttccctttatttttagtattcaatattcaaaagataattcagaagacagcagtttaccttattcaaacattgcctcatgcagaaccaccagagatgaagatgtttatttattttttttaagttggaagttaccagtttatgtaaactataatacacctctgacacctgtctgtacatgcatttagtaaaggcttattaaattaatctgtaaatatattatacagtggtaagcatagtcaattttataccttacaaactaagattgtttaaaatccaacaatttaaaaatagatttcaagtggatgctagatactttttttctttctttcttttttctctttctttctttctttccttcttttcttatatttttcccagggtctcattctgatgttggagcggccgc

SEQ ID NO: 603354 - DNA, 430 bp, Homo sapiens
gatcctgtgtcctagtgactgttcctggcaacctgtcttctgttacctcagctgtcatcagcatttgctgctccctgaatcttctactgaacatcttgctatgtactaaggctacctgtacaacgactctgcctcttagatgatagactgaacctgatgactttgagctgcttttttttttttcactaactctgcatgcctctatctcagaactctgcatctgcggaactgttttaattacaattatactaacaatacacatgagaatagatattagaaactaataatgaaaaagcatagctgttaaactgacttgatttttttcttatcaatattttctatatcacaaaaatggcaacatcttttacataaagaaaataagtttgtaagtgatatttcttaaaagaatcaataaatattagcaatttct

SEQ ID NO: 603355 - DNA, 672 bp, Homo sapiens
taaagtatggtttttaattaatgttttgttttttttgaggaaatttaaatgctaaagatcacctacgtaatgtaaaaggtatcaggaaaaataagatccggaagttgtattccgggaccaatcttttgtttaaataagtagttttgttgaggttgcaagaattgctggccattatcaagagatagagctatattaatggctttcatcacgttcaattcatgtatttattgagcaccctatcttaattatggtgctccaccacttgttactgccagctaccctggatgttccccacgagtggtgccctactctgttttttctgatatggtcttcccattcacgtgtgtgtgacactacctcgttgtttatcacgcccttgtaggtggctgtgtctgttgcactcactcataagaagagtttatagctttgtgctctgataaattgtgttctgttaaagagggttatgtaggagtgaagaacacgccaaacccataattgttttcacagccaagttgtaaaattataagaaaaagagttggtttgtgtaccaccattttaatgattcccttggtcatttttgcttcgtgaaatgcactgcaaaaaatcctccaaatgagttatagttcctgtgttgggaaaaatgaccaataattaaaactagaggaccaacca

SEQ ID NO: 603356 - DNA, 1643 bp, Homo sapiens
  misc_feature (281)..(281): n is a, c, g, or t
  misc_feature (1601)..(1601): n is a, c, g, or t
gtcctaattcacgagcagctccaacttctcctatctctcccagtcctagctgactggctatcactatactatctatagcgagacgcgcaagctcaatcacccaccgttgcatatcgactcccgaccgagaaggaaaggatgcataccctactttcttatactcaatccatcctattatcatagattttccttcgagtctaactcacatgaatagttaagtacttccatgtaatctcatatccatggtcttcggacactaacatcttcgccaatcatatgtnaacattcactaactctcggcataatacacatacgacaccccatattggagagtaacaataagggtcatggagtcgtcgagcatacatgcgatgatcacaaattacgtgctctctccataacggagttctccactctggtgtggagccaccctctactactaatttaccatggtcagcgaacctatgaaccgatatgcaaccccaacagacgccaatagtcttccaccatacacggacttacacaaattaaatccaatcgccttcaatccgcccacacgggacgcttcaatatcagataacttctcatggattgcaacataccgacaccatctaacttcactagcaggcgtaaaggctataatcaatcgaccactaatggcattccttgacttggctaagatagccgagcctcgcattgcctctcctaaaggggaattttcactacctttttactgatattcacccggtaaaaggctcggcgactcgtgagcatagggccgacttcggtcactggccaggcgagaaacaaatactaattgctaatttcaagcacccattcaggtcaacctccaccatcgggaaacacactggatgagcatgagccgtaatggtgacccctttccaataatttgcccttacctaaaaaggttccccataaatctcacaaacacgccgcaagcttgggctatatcgggcccaattccaattcaagagacagcgcctttccctttggcaactgggaattccccccccctggtaagggcccattacagggagcttatcaacaaccggtaagtacacactaatagccctaaacggcaccaacaattcgaactttaacacattatactccattcagtttcgccactgaggccggcttaacacacctcagacccgtttccttattccccccaacggagaattaatacatggcgccccttacttcccgggcaaaaaggccccccggagagaagagacaactacgcgcggggtaaacaccaggaataggccataaaacccccggcgcaacgagagcgtctctcaattccgccccgcgacacgggccaccatggccgcacagcccacaacacgccgccgccccaaacatcacaacaccccacgccccgcgctcaccgaaacgacagcacgtctcctccgcggcgcacaaccgaaccacacgtcccccaccatccaacagaagaacaccgccgcagacccaccaccgcacgacacacgcacacaagacgagcacccccacccctcgccaacaagcagcacacgcgacgcccctcagcagacgcaaccaccacaacaccgacnaacatccaacacgcgcgtgccgacaccccaccacgcgcgaac

SEQ ID NO: 603357 - DNA, 209 bp, Homo sapiens
gtatatgaggtgtagcagggacatactgagctgttcgtcttcttctaagattcagggaaggagcctatactgcccttttctggcttctgggaggtagctagcattctgtggcaattccgtaaactcattgctgcagtagggcaagatcctaacctccactttcctgaggccaatctttttgtccatccttcttataagctacaccaacc

SEQ ID NO: 603358 - DNA, 336 bp, Homo sapiens
gaaaaaaaaagaggagtcatcagcagttaaacatcaaaaacagagtcagggactggagtggtggctcacgcctataatcccagcaccttgggaagccgaagcaggaggatcactcaagcccaggagttcaagaccagcctgggcaacacaataagacctcctctttacaaaaaaaaattaaaaacttggctgggcatggtggcatgcacctgtggtcccaagatattcgggagggcaaggcgggagaatttctagagcctaggcggccaaagctgcagtgagctgtgttcacgccactgcactccagcccaggcaacagagcaagaccctatctca

SEQ ID NO: 603359 - DNA, 870 bp, Homo sapiens
  misc_feature (368)..(368): n is a, c, g, or t
ggccttttctttggcaagatggcggattacgacttgactactcgcatcgccgcactttttggatcggcgatctattctttccgcttcttgaatttctctctcgtagacaggagatatataattgagaagaggagattcattacaacggtaaattgtggaccttcttcagtgataccatagcactggtagtacttatgctatggatgtctacgagaaaagcctgttattcctgatgatattgcctcatgcttggagagatgacaacagaaccacagtggttggcacaactgaataccttcaggccatgaaacgggtagatccacattgtgaaggactgtttgaagatcctacgagaatctactagaggncaagatgcgagtgcaagccgagggatggtaggatgctctttgactacctggctcggacaagcatggttctctacggctggagtatttagaatacacttctactgatatgtcctaagttccagtatgaattgtgggaactcacgtcaggagcagcatgattatctttcatttctgagagtgctggttccagcaacgagatagaagatgctttaagttcactctgggggaaagctgtgctctggaactcttagtgcagaattgggatgcaaccatgggaacgacctttacatcgggtttacttagagaccatatgataataattctggtgaagttcgcgcactttcagatcctcttttagccagtagaaacattgttccattcactgggtctcctggtggggtttggcgttcaattctacccccaaattgtgagagattaagattttttgggacctcattcccttgattcaggccccaatattctttagtggcgattcagaaca

SEQ ID NO: 603360 - DNA, 1049 bp, Homo sapiens
  misc_feature (11)..(11): n is a, c, g, or t
  misc_feature (13)..(13): n is a, c, g, or t
  misc_feature (18)..(18): n is a, c, g, or t
catcgcgacangncgctnttcgcacgccaggaaggtcccctctatgtgctgctgagccggtcctggacgcgacgagcccgccctcggtcttcggagcacgaaatcgcaaaaacggaaggactggaaatggcagaccatatgatggccatgaaccatggaacgacttccccagacgcgcacgcatatgggcatgcaccgatacaccctgacctcaccgatatggcgacatggggcagtttcccgagcccccatcacgcgacctagcagtcagacagccccagcacgccttcaacgccctaatgggcgagcacatacactacggcgcgggcaacatgaatgccacgagcggcatcaggcatgcgatgggcgccggggactgtgcaactggagggcacccctccgagcgcgctggcccccgtggccacgtttcactgactcccagttcagtgggtccccggtggccagccatggggaggctccctgccggccagcatgcagctgcagaagctcaacaaggcagtatttcaaccatcacccctacccccacgaaccagtacatgccggagtgtgcaccctgtctgcaaggccagcagatgaacgggacaaaccagcacttccgagattgcaagcccaagcacagcggcggcaccagcacccccggaggctcggtgcggaccaaaagcaacacccggcggctctggcaccagctcgaacggcggccacggagtcaaccagcaacagcgagctgcaggcagccgagcacacagaccaacattgcccgccctcacgaggcgcccaagtaccacgatgccaatgcttgacgccccacatgttcatagacactgcatgacgtcgaccgacggcaaggtcataatacccacggcgataccaactgggctaggcccgactcaaggcagccagaccgacacccgcgtggcaacaaaccgagatgacacacacgacggcaccccgcgggcaaatcgcacacccagccgacgacaccactgcaccgaccaaacacccgagcaacgacaccacccccaccaacc

SEQ ID NO: 603361 - DNA, 165 bp, Homo sapiens
  misc_feature (124)..(124): n is a, c, g, or t
  misc_feature (133)..(133): n is a, c, g, or t
tagagacagggttttgccatgtactcccaggctggtctcagggactcctgggctgaagcaatctgccagctttagcctgccaaagtgctgggattacaggtgtgagccatcatgcctggccttntttgtattntttgatattttattttaggtagtaagtcttag

SEQ ID NO: 603362 - DNA, 204 bp, Homo sapiens
tcatttatagaataatttcagataaacaaaatcaaaggctgtattacctaattttggcatgaacccccccttgtaccaaatgaagacggcatcacgaagcagctccagaaggaaaagcttgggcggtgcccagcgtgcccgctgtcccatcgacgtctgtcctggggacgtggagggtggcaccgtccccgcctgcaccagtgc

SEQ ID NO: 603363 - DNA, 147 bp, Homo sapiens
tatatatgccatcgtattaggccagcctgggaaagagtagcttcttcaggacttccaaaaagatagctcgattctcctcctgggggcatcatggacctggagccggcgcggccgccctcgctatccgggacctggattcgcgaccga

SEQ ID NO: 603364 - DNA, 366 bp, Homo sapiens
caaaaaaaaaaaaaacaaaggaaaaagaaaaaaacacttgaaaatgcccccaaccccaccccttttccaccccacagttgctattacgcttacggtgcatagcctctaggttatttactttatggttgtgttttaaaattgtacagtttcatcgacaccctattttcactggcaacactgtgaacacctttatcccttgttacatgtatctaccccaccatttttaatgcccacgcggtgttaggttgttgagaaggactgtgatttatttaataaagcctgtattgctgacagtgcttcggtgaatattattacacacacacatcttttcattgtcgtttatttaataaagcctctgttgctgac

SEQ ID NO: 603365 - DNA, 658 bp, Homo sapiens
  misc_feature (591)..(591): n is a, c, g, or t
gtgcgtgcgtctagaactatgtggatcccccgtggctgcaggctgaagtctacactcgttcaaacttccaaacttcaacctctcaaccccaaccaaacaaccaaaccaccacccccaaaacaaaccaccaaaaaccatcaaaatgcgtgccgccgctgttgtcgctatcttcgctgcctccgccatggcccagaccggcggctctgcctctcccaccaacggcaccagcgtcacccacaccggtgctcccaccaccgcccctaccagcggtgccaactccctgtcccagaacatcctcctcggtgtcggtgctgctgccgtcctcgctgccagcctctaagcaacttcaacttttttttattcgaaacctttctctctcttccctgataatttgaggggctttcggggatgtctagctcaagtttgctaggcttcctgtgaagctccttaccgacttcttggggaggggaccggaggaaaagaatatatcatggatctggacgggatggggatggagggggaaaagaaggtcaatttagtttgacggcattagaagtcttgggaggaagagagaagagcggtactttttcntcgtgctttattacgaccacagaaaatgggataagggatatacctatggctataacatcagtcatca

SEQ ID NO: 603366 - DNA, 349 bp, Homo sapiens
gcctgtaatcccgagtagctagtactacagatgcatgccactattttttagtacaaaaatattaaaaatttgggtcgggtgtggtagcttacgcctgtaataccagcactttgggaggccaaggtgggtggatcacaaggtcaggagttagagaccagcctggccaagatggtgaaaccccatctctactaagaatacaaatatcagccaggtgtggtgcagggtgcctgtagtcccagctactctggaggctaaggcaggagaattgcttgaacccagcaggtggaggttgcagtgaggcaggatcacgccactgtactctagcctgggccacagagcaggctccatc

SEQ ID NO: 603367 - DNA, 568 bp, Homo sapiens
ggtggacgccgccgaagaagcatcgttaaagtctctcttcaccctgaccgtcatgtctaagtcagagtctcctaaagagcccgaacagcgtgaggaagactcttcattggtagggttgagctttgaacacaactgactggagcagcctgtaggagcccattattgagtcaattggggcaacgcctcatcgaggactcgtgtgcgctacatgaagcagcagtccaaaagcacctcaatgacgcctccaggggccttcgggctaatatgtcacatatgccatctgtgcgacggacgagtggacttgcagccttaatgaactgcaaaggccatcactacaggctggcaatgcgaacgagttcgtggaaccaaagacggagctgtctccacgcagaacgattctcaaagacccaggctggcccagctttaacctgtgcacaatagagccatactttgtctgcgtggccatcaacaggacgccacactgcaagcaaacattcacccttacagagcactcatctccgacaacagcccactggcacaaaccttggaccctgcctctgaccaatcg

SEQ ID NO: 603368 - DNA, 128 bp, Homo sapiens
taagctaaatttggttgaatatttggataggcaatacaggctatatggtacaaatttaaaagatgcaaaagggttatgcacaagagaagtacttttcttaggctttccttggccttccattttccctt

SEQ ID NO: 603369 - DNA, 301 bp, Homo sapiens
gtcgacgtcatggcagtgcatgcccgttagtcccaactactcaggaggctgaggcaagcaaattacttgaacctgggaggtggaggttggaatgagctgagattgcaccactacactccagcctgggcaacacagtgaaactccatctcaataaaaaaaaaagtacatatatataccaggcatgatgtctcacacctgtaatgtcaacacctcaacactttgggaagccaaggcaggagggttgcttgagcccaggagttagagaccagcctgggcaacatagcaaaaccccatctctact

SEQ ID NO: 603370 - DNA, 481 bp, Homo sapiens
  misc_feature (26)..(26): n is a, c, g, or t
  misc_feature (77)..(77): n is a, c, g, or t
  misc_feature (80)..(80): n is a, c, g, or t
  misc_feature (82)..(82): n is a, c, g, or t
  misc_feature (92)..(93): n is a, c, g, or t
  misc_feature (95)..(95): n is a, c, g, or t
  misc_feature (97)..(97): n is a, c, g, or t
  misc_feature (191)..(191): n is a, c, g, or t
  misc_feature (204)..(204): n is a, c, g, or t
  misc_feature (208)..(208): n is a, c, g, or t
  misc_feature (221)..(221): n is a, c, g, or t
  misc_feature (241)..(241): n is a, c, g, or t
  misc_feature (243)..(243): n is a, c, g, or t
  misc_feature (245)..(246): n is a, c, g, or t
  misc_feature (248)..(248): n is a, c, g, or t
  misc_feature (271)..(271): n is a, c, g, or t
  misc_feature (280)..(282): n is a, c, g, or t
  misc_feature (285)..(285): n is a, c, g, or t
  misc_feature (291)..(291): n is a, c, g, or t
  misc_feature (293)..(293): n is a, c, g, or t
gttcccccccttacacgcacgccggngcggctttggaataatttcacagagcacgcagctagccttgaagctctctntgntnctttgtccanntncntcggtccttacagccgctcgtcagactccagcagccaagatggtgaagcagatcgagagcaagactgcttttcaggaagccttggacgctgcangtgataaacttgnagtngttgacttctcanccacgtggtgtgggccttgnananngntcaagcctttctttcattccctntctgaaaannnttncaacgngntattcttgaagtagatgtggatgactgtcatgatgtcgcttcagagtgtgaagtctgcatgccaacattccagtactgtaagaatggacctaaggagccagaatagactggagccaataagggctcgtggccaccattgatgacttagcctaagcatgtctgctgagcatagccagccattgggttgt

SEQ ID NO: 603371 - DNA, 456 bp, Homo sapiens
agtatttttttcccatctatttaaagaaagttggagtagatagggttctgcaggcgtaattggggctgcaaatgtaaaccatcatccttgcactgggaaacctatgaaaacgagctaccaaataattttttttttttttgagacagaatatcactctgttgtccaggctggagtgctgtggtgccatctcagctcactgaaaccacctcctcccagtttcaatcagttcttgtgccttaacctcccaagtggctggaattgaaggcaagtaccgccaccatgcccagataatttttgtattatttttgtgtttttagtagagatggggttttgccatgttggccaggctggtctcgaactcctggcctcaggtgaattgccgacctcagcttcccagagtgctgggattataggcatgagccaccacacagtagtgaaacttgacagataattttt

SEQ ID NO: 603372 - DNA, 647 bp, Homo sapiens
gagtaggtcatagctgttcagagtgacctggtatccggtaggatgctatccaccagatatgcagttacttctttcaatagagtcttgaacttctctaagtcatccatgaacgttgtaattgacttcttttaacttctgtaactattaatattttgacctcctcctgtgaatgacgaatgttcttaatggcatcttgaacagtaaatcctttccataaagttttcacttatatttggcccagatccatcagaggaatcactatctatggcagttgtggccttataaaatgtattttttagataactcaaaagtcacaattagtcttggatccatgggctgtaggggtgcctttggtcttagcgagcatgaaactattaatctttcctgacatcttcatcagagctcctgcgtaagcagggcacatcataaacaaacagtagtatttggaattgggatcgtgacttcttgagcaataggtctcagtagtgggctgagcatattcagtaaagcaatgctgtagagagatgtgctgtcatccatgcttgtgtgtccacttacgagcacaggcaaagtacatatagcataattcttaaaaatcctaggactttccggatggtaaatgagcactggcttcaccttaaaacccg

SEQ ID NO: 603373 - DNA, 843 bp, Homo sapiens
  misc_feature (29)..(29): n is a, c, g, or t
  misc_feature (40)..(40): n is a, c, g, or t
  misc_feature (70)..(70): n is a, c, g, or t
  misc_feature (97)..(97): n is a, c, g, or t
  misc_feature (159)..(159): n is a, c, g, or t
  misc_feature (215)..(215): n is a, c, g, or t
  misc_feature (225)..(228): n is a, c, g, or t
  misc_feature (247)..(247): n is a, c, g, or t
  misc_feature (262)..(262): n is a, c, g, or t
  misc_feature (281)..(281): n is a, c, g, or t
  misc_feature (289)..(289): n is a, c, g, or t
  misc_feature (298)..(298): n is a, c, g, or t
  misc_feature (325)..(325): n is a, c, g, or t
  misc_feature (354)..(354): n is a, c, g, or t
  misc_feature (408)..(410): n is a, c, g, or t
  misc_feature (432)..(432): n is a, c, g, or t
  misc_feature (781)..(781): n is a, c, g, or t
  misc_feature (818)..(818): n is a, c, g, or t
ggcgctgaccccctcaactctgcaggacncggcgcgcgangaccccacgacccgcgggcgcctgcgcggnccccgcgagccccggcgcctgcgcgantccccgacgccgcccccgcccccactcaccgggccccgcagcaggggccggagccgccggcngcgtggcgggggggggcgccccgatgagccctcgagtgcgaggagccgccgccccncctcgcaggnnnntatgttttggaatttttanctgcacacaagctcncacctggacacgctgctgnagcgggangacctgagnctgcctgagctgctggtcgagtgaagnttttttgcaggattgctaatgtcgtcaancgcaatttgctggtacttcctgcttcagccacaccatcctgcaagcaatggtgnnntgggtcacccaggagccgccanatagcggtgaggagcggctgcgctacaagtaccccagtgtggcctgcgagattctgacctcagatgtgccccagatcaatgatgccctgggtgctgatgagtcccttctgaaccggtctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttngtcaattggctcaacgaggagaagatcgtccagcggntgatttagcagatccacccgtcgaa

SEQ ID NO: 603374 - DNA, 285 bp, Homo sapiens
ctcagtcattactgttaaatattttttctatttctcgactctctttattctcctttggtattcctattacacatatattatatctttgtacttgtcccatagttattgaacattctgttctgcttcttcaggtggttgttattgtgtgtgtgggtttttttttttttttttttccagtttgggaggttcctacggggatatcctcaaggccagagatactttcctcagctatgccaaatctcctattaagcccagaacacaaggttatcacattacggtaacagt

SEQ ID NO: 603375 - DNA, 104 bp, Homo sapiens
ggcacgaggtctccctctgcttctacagatttatagtactccttggctctcttgagtctacacttttactcactgtctctgggtattttcaagatacatttcac

SEQ ID NO: 603376 - DNA, 1050 bp, Homo sapiens
  misc_feature (327)..(327): n is a, c, g, or t
agcgaactatatagtttggcactggctcactaagaagatggagagagcgcctacagaaattgactgtgcgcctagtgtagaggccatgcatcagataggaaaagatatgagatcagccagaataacccagggatgatgaactctcttatcgtcgaacataagtctggagagatagagtatgtgcactccatggacatcgctctctctggacataccagtcttcctcgcagacggagtcacaagacacttagtgtcaaggttagtggattcgagaggcgctgcgatcagtatgacccgcgtgactggcacttgtaaagtttttctatncgtccccccaagaagaaggcctagctatgacgtacgtcaaccatgcataaattgaaccgtgttaccatacttggtagtacctagcataaagacgctatctggtattagtagacttccaagggtaccaagcagctacaagggaaggcagacggtcgcaggcgcctcaacacgttccaacgtcagaccccaaggttaatactggcaggagtagaattggggacagtcataccgagacctcggtttgcctagagctcttggtagtgcgacccccgatacgccatcctagaactcgtgcccttgcgaaggtcagcgttctagtggcaggctaatctcgcaagcatgatcgtcatcatagtccgtgcatggagtacttatatttacctatgtcaaaattagttccatactaaacgaaccgaacttccgtagcatggccttgcctagggggatgcccagcatccttattccaagttcccaaacatattggctcgggctgagtaattgccgggcccaggggtgcctccgtaccaaccgaacagttttattaactgttgcagaatccccgatctctacagccgggtgtcccggagtctttgttctacacaaaccgatgtggctgagacagtttctccaggaacaatgggctccgtccagaggtattcggccctgaggaaaaacttctttccacggtcccaaaaaatatgggagcggaaccgcaacaaaaaa

SEQ ID NO: 603377 - DNA, 319 bp, Homo sapiens
tcggatgcaaagtgtcaggatacaataatcaatgtgcaaaaatcacaagcatttctgtacaccaagtaatagacaaacagagagccaaaatcatgagtgaactcccattcacaattgctacaaagagaataaaatacctaggaatccaacttacaagggatgtgaaggacctcttcaaggagaactacaatgtgagccattttaatagatgtgtagtggtaactcatttaggttttacattaggagttcccaaatgactaacgatgttgaacatcttgttcatagacactttgcatccaaggacactttgcatccagag

SEQ ID NO: 603378 - DNA, 302 bp, Homo sapiens
  misc_feature (207)..(207): n is a, c, g, or t
  misc_feature (267)..(267): n is a, c, g, or t
tgtgctggcatggtgggttctagtgaggactttctttcaggttgtggctggccatcatccccctgtaacttcacatggcagagagagtgccaggcagctctctggggcctctttcataagtgtactaatcccattcgtgagggctccacccttatgacccaatcactttccacacatcggggggtaggacttcaacatataaatttnggggggacacataatggggtatcctatgtgtagtaaggacagaggggtgcttaaaggctntgccacattcttcacataatggggtatccgggtac

SEQ ID NO: 603379 - DNA, 1158 bp, Homo sapiens
gcaggtaagcacttgtagtacgtactctgccaaggcgcagtcttgtgcgagaggagtgccgtgcgaggtagattctgcagttgagaatctgacagaagttcaagttgcccttggtcttctgcatcacgagtgatgacgattgaatactaactacttcattcacacatataggcatgatggttactaatgtatatggcgcacatctgtatgattatggacacagttattgtaagataaggactgtatatgacttgtgactgtagggaaaagtactaatagtaacttcacgaaggaggttatgccgtgagagaaggggcaaagggtttagatatgcgtgtgcttgaaaatacaagttgagccgtgaagcgcttggactgtaatgaaaagcttgtcttgtacagtagggaagattgaaactcaagtagtgaatagggaagacatggaaactaatataggaaaacgcaagaggcgaacttgacgctgtagacactctcggtagatttaaattcactccacttgatgtagaagggtcgaatggtctatcctggggaattttagaagctctgcaaaggggtacgtagtttgaacaacctatgctattacacaggtctttggaggtatttgtaataaggttcagtatagatgtttgaatttaggccagcaagaaaaaggctaccggtcacagggcgaatgacgttttttacaccatatactgcaggcaattcaacgaggttctgtacaagtggtggtactggtagataaaccgaagtccctttttgcaaaataccacctccaagtgtggcattcaggcccaagtggggaacagaattattttggccagatgcagaatcgttacatacactgccataagtgcgtttagaaaccggacacatttggtaagcttaattataagggccgggcaagtggacaagatttagagtacaagacggattctatatgaaatgggggccaatgcaggaggtcagggaagtggaaaggtccatagtttgggggaaaggagaagaaatttgtagtatttggtttggggaccgatggtaattcacacttgggggaagtgatatgaaaagagttatcaggacagaggggtgcaaagtaaggcaggacacattatgaagaataagattgtgggggaaaaaa

SEQ ID NO: 603380 - DNA, 103 bp, Homo sapiens
tgacagcagctgcttcagaccctgagcagaaataccagagtgagcacagctggcagcaccagatgactgatcttggctccagtgtgcctcctctgtgctgggt

SEQ ID NO: 603381 - DNA, 357 bp, Homo sapiens
ggtccgtggaggattatatttgcccttttatgagcatgctcattgagatcttcatcatctcacctcaaaatcgcaatagccagccaggcgctgtggctcatgtctgtaatcccagcactttaggaagctgaggtgggcagatcagttgaggccaggagttcaagaccagccaacaacaaaaccccatctctactaaagatacaaaaattagctgggtgtggtgacttacgtctgtaatcccagctactcgggaggctgaggcaagagaatcactgaagcccaggaggggaaggttacagtgagctgagatcgcaccattgtactctagcctgggtgacagagcgagatccttgtctc

SEQ ID NO: 603382 - DNA, 1277 bp, Homo sapiens
cggtatggcaagaacaagcgccttacgacaggcggcaaaaagggagccaagaagaacgctgtgttgatccataattctacgaacagattggtatgatgtgacagcacctgctatgttcaatacgaaatattggaaagacgctcgtcaccaggacccaaggaaccaaaattgcatactgatggtctccaagggctcgtgctgttctgcacagtgcagtctatgctgcatttgccatcacatgcatgcacagttgccatttcagcaacacttccacagcttgcattcactgcaagcatgtactaggtgtacaaaactgcctgaccataaccattccatgtgcactgtgactctctaccccgaagcacacaaactgtgtctccactggctcaaacaacagtggccacgaccacactgagtttgagacgctcaccgcttgactgtcaccccgacctaaccgcatggctctactttgcattccgctcttgtatcatgctgatatggctctttaccctaactcatactctgccaaccaacctcacgactaccggacacgaccctctatactgctacagcagacacacaagcacggggtaccggcgcaacacttcctgtgacacgacaagacttgacattgtgacacaactcatcttgaccccctgactgaacggttgacatcgactcagctacttggaacgctatggaaacgagaataccgatgtgtacaacatactcactttagacttccccgaatgcaatcaatggcgaatatggcgaacacaatggactaacgttacgaacaatagactgtgcactagtgccccaaaaatgcctatcctgatagttccaccatcccatccccacattggactctgttccatacacaggattaaagcaacatgacagggtaaagacacaactagtgcgttggcaaacgcaacgcccaccaaatggcatttggcacccttcggacaacacaacaggctacaagtggagacagcacactccaacagggcctgaaccggacagacaaagcaagaccagggccaaaccaagcaacaacgatggttgcaaccccgacccaccacggcgcgacacacaacacctcagcacaacgcacgcccgcgagcgggacaacaatgaaccacccaccgaggcaccaacacaacacacggctctcacaacacgaacaacaaacgcccccacaccacactggcccccacaccacaccgctcgatcacacggcgaaaccacccccgcacacgccacagaccagcgca

SEQ ID NO: 603383 - DNA, 281 bp, Homo sapiens
ctctgagggtggcatgccaggagtcttatcccatcgcttaggtgcaggccaagtttgtccaggacgagcaagtgaacatgaggccatgggatgactcagtgacacatagcccttcaagattagttccgttgtggtcatttttggggatgggcaaaagggcgccagtggttttgagaagcaccatcaactcagcgtgaaacataattattttttgcatgttgagaccaccgaaggacaatggtcagctcagtacagccgatgacgacagttttgtagtttga

SEQ ID NO: 603384 - DNA, 338 bp, Homo sapiens
ttttttgtatttttagtatagatggggtttcaccgtgttagccaggatggtctcgatatcctgacctcgtgatccgcccgcctcggccttccaaagtgctgggattacagggtagagccacggcgcccggctggaaccatacatctttcaaaacctacggctgtaggtaaccaccttaatattagagttaaagcccttagatttttgtgcttagcaaagcagtcaactttcagatgtaactagtccacaaaattagtatctggttctgacctaaaagactccaattctttccttatgataaagaattcaacatatgaaacataaaccatgcgtcgacg

SEQ ID NO: 603385 - DNA, 311 bp, Homo sapiens
actgcatagggctcggcgtggtgttcagttgctgctcacaagagttgatatcccatgatttagacttgcaatgggtaatagtaattgttggttactgactacactgttagtaaattgaggaccacctaaatggagaatcatgataaaacagatgtcagatgcctcataacagggtgcagggttgtttatacttcatttctccttcaggacatggacttaaaccatttgatactaagtttatgaagcttttgcttgaaaaagtgaatatcattcccacttattgccaaagcagacatgctggataccagaga

SEQ ID NO: 603386 - DNA, 800 bp, Homo sapiens
gtcatggaggccaggggtggctgaaaccagcttggggggttcgattccttcctttttgtctagattttatgtatacgggttcttggttttctgtatttttccccctctctttaaaacatcactgaaatttcaataaatttttattgaaatgtcaaaaaaaaaaaaaaaaaaaaaaaaaaaaaaaaaaaaaaaaaaaaaaaaaaaaaaaaaaaaaaaaaaaaaaaaaaaaaaaaaacaaagaagaaacaagaaaaaaagaaaagaaacagaacaagaaaaagcaagcagaagagaaaagaaagaaaggagagaagagcagaaagagcacgcgcataccagcagccgacaatcacagaagagagaagaggagaggaggctagactaatagcgcagaatcaccagagcggagtctgggggcgaacgattagaggagaaggccagggccagggcagagagctacagcgaacagcgagaacagacagaagcagtcacagcggcaggcaggagaggaaaaaagtagagtcaagacgagagcgaggagaactaggcgagagagcgctagccgcagtcaataacagagagaagggttgattactagagcgacgcacgagcagtagagagcagtcagagcaaaagaagaagagagagagagaagtaagtagaacaagaaagaacacgagacacgacaaagaaaggacaccagcagaacagaaagaggataagagagaaaagagagaccactgtagccgcgcagcgagagaacaaagagaacagaaggaagagcaaaagaacagaaaagc

SEQ ID NO: 603387 - DNA, 122 bp, Homo sapiens
atttcactgttggaaaagaaataactatttaatattatgaaaactaatggtccactaattttaagcttcttccattgttccgacatttaaacttattttacttgaaggggaggattattttg

SEQ ID NO: 603388 - DNA, 486 bp, Homo sapiens
  misc_feature (144)..(144): n is a, c, g, or t
cggccgcccccgaagcgctgctgtcaccccggccgcgccccccaactttctgcacagtcgcggagctggaagtttccgggcttcgcggacacgctgggctgggtttcagtcgcggctccgaggttggcaacaaagagggaaagnaggaggaaaagcaggccggggaggggaggaagagaaccgcgcggaggccgcggcgccgagagccccagaacttccaattctacccagaagcttttttcgtcgtgtttttctcttcagacatgatcctctctgaggttggtcctgggcttccatacgtgattcatggaagaggtctcagccccaagagcccctgagggtactgtccactccccctggaaacttccagaacctgacgtggggctgaagacatagaggctctgagagttacataattgattctgactttggctgttggtcaacagtgtcataaggctgttgtagaatctgctcagcccaggaagg

SEQ ID NO: 603389 - DNA, 4950 bp, Homo sapiens
  misc_feature (144)..(144): n is a, c, g, or t
  misc_feature (2495)..(2495): n is a, c, g, or t
  misc_feature (2529)..(2529): n is a, c, g, or t
  misc_feature (2624)..(2624): n is a, c, g, or t
  misc_feature (2798)..(2799): n is a, c, g, or t
  misc_feature (2850)..(2850): n is a, c, g, or t
  misc_feature (2907)..(2907): n is a, c, g, or t
  misc_feature (2912)..(2912): n is a, c, g, or t
  misc_feature (3580)..(3580): n is a, c, g, or t
cggccgcccccgaagcgctgctgtcaccccggccgcgccccccaactttctgcacagtcgcggagctggaagtttccgggcttcgcggacacgctgggctgggtttcagtcgcggctccgaggttggcaacaaagagggaaagnaggaggaaaagcaggccggggaggggaggaagagaaccgcgcggaggccgcggcgccgagagccccagaacttccaattctacccagaagcttttttcgtcgtgtttttctcttaggtaaacaagcaagttccacgccccagtcctgctggggccttcgccagccaccgctctgggctcatctcccggcgcctcctcggggcacctgagcgttttaagccccactgccaagtgttttggacacaggtttttttgcggggtggtgaggttgggcacaagatgcttcctaaaaggttgttggcacgcagaccatggccccagtgacggagcggcaggcaggggcttgaggaacacgctgtctttgtctcgtccccaaagcacccggccgtgggtcacccgtgatccctggagtggagggactgttgtgacccctggtgctccaggagaaggggttccatgctgggtcccgggcccaggcccacggtgccctcagcctgcagttctccaccttgcggaatgatttgctggcccggcccagctccccggcaccaccattttctgccctcttttccctgcctggcttcaaaccctcccaggccagggtcccgaggagacacctgggctgggggaggcaactgagtgagcccaggcctgggaatcggcaaaagtggccaagccacatctctcgagactgcaagggccctggaggcgctgggaggcacagatctggctgccagctgggcctgaggcctccctttgtccgtccttcctgttcttcctcaccaggtgtgtttacggagaagacactccgggccaggccagctcctccagagcactatttcaggctggggagaatgcggatttttttgttgttgttgttttttaaagaaaaatgaacaaggagcctggttggggattggggtgggaggaatatttgtcttttgtcccacaaacgtgtgtgatgctccaaagggctggagaacctctctcttaagtggatatttttcccctcaaacgacttctcagacatgatcctctctgaggttggtcctgggcttccatacgtgattcatggaagaggtctcagccccaagagcccctgagggtactgtccactccccctggaaacttccagaacctgacgtggggctgaagacatagaggtaatggggatgggctggtggggcgctggctgggacaatgtgtggagcccttgttttcagagctacagatgcttgtcagctgacagttcgtttccagcatccacagtggacctcctttgggggagcatttacctgccaatgaaccccaagatcctttctcagaggcggcgggatgaagttttcctttttttttttttagttaatatattttatttaaaccaatatatccaaaatattatcagttcaacatacgatcaagataaagattaatgagatactttacattttcatactaaatctttttttaaatttttgtgagtacatagtaggtataaacatttagggatgaagtttcttactgtgttttcccagtaacaagcactggcatcagctgtcatgatttctccccaaggcctaggatggtcagcctcgcacgctccacagcagagtgactgaagctctatcgaggtgtggcacgagcgtgttgtcatttcaagagaatctgcagcctccctggtttttaatgaaagctcctatgcagggcctggccctttcctggggagggaagcctggctgtgtctcccgctgcatcctcactgggaacttcattcctgagctgcgaccgctattttttggattggaaaatgccttgggaacggctcatcttcctgcggcttgagcccatttgttttctgactggtggtcactggtgattagagtgtgtcccaaagggaaccgtcaccttagttctatcatacactatcaataacttgtccagggctgactttgtggctgtgtggcttgcccagtggcagagggccggtgtgcaggagggccccacactcaatgtttggctgtccccggtcttaaaattcttagtcattcttgaacaagggaacccatattttcattttgttctaggctctgagagttacataattgattctgactttggctgttggtcaacagtgtcataaggtaaaataaggtaaaaatctatgatttttatatttctttttttctttctttttccttttttttttttttttttttgagacacagtcttgctctgtcaccagggtggagtgcagtggcgcagtggtgcgatcttggctcactgcaacctccgcctcccgagttcaagcgattctcctgcctcagcctcctgagtagctgggactacaggtgngcaccatcatgcccagctaatttttgtatttttngtagagacgggatttcaccatgttggccagggtggtggtctcgatctcctgaacttgtgatccgcccacctcggcctcccaaagtgctgggattncaggcgtgagccaacgtgcccagctgatttttatatttcttttactaaattctgtttacagaaataattccagattctatgtaagatacaaatattttaactgaagatcattgtatttagggaaaatgttcacctttaagagacaggggctgggcgttgtggctcacgcctgtnntcccagcactttgggaggccgaggctggtggatcgcacgagcccaggaatnccagaccagcctgggcaacacggcgaaaccctgtctatgcaaaatatacaaaaattngccangcatgggggtgtgcacctgtaactcccagctactccagaggctgaggtgggaagactgctcaagcccgggaggtcaaagctgcagtgagagaccttgtcttaaatacaaacaggcaggaagtcgttataagcataatacaatcctggatgttggaatcatccctgtccagccttggctctgccacgtgggtgctgaatgctgcctcagggaccctggtgcccagctcccacctgcagggtgttctgaggagccagcacgctgggagggcctagcaggagatgtggcatgaaccaggtattcgataaataaaaagtgcctttgattgtcacgtttatcatttgacatgtaggcacaggtgcagtttgattatttttaatgtaagtctattttatctcttcccgttataaaagcaatacacactgtgatagacggtttggagaattcaggaaagaaaaagaaaaagaaaaaaaattcctcctaggccctctgctccagagcctccagccgtcacatgacagtgtatttctttacaattacagaaatagatacgtgactgttacattttgaaactttttcttttaccttgacttatttttaaatagaaacactagtgaggccccacagaactgagcagaactaatggccccccatgtggtggaatagttcngagctggccccactttggatgcagccttccccggcaagtctaaacccagtctctgtggctgcctgttcacagggaccgtggactgtgatgtttacagtacgaaagcactgggagagaacgctacatcacaaagtgtccttaacctgctgccgcctcagctttcccatttgtgacttggttaaaaaaattttttttgacagttttaagctcttattttaatttccacaggctgttgtagaatctgctcagccagggaggggaaaggagtcggcaatcaggtctcctcctgggcacctttgtgaggccagctggcgagagtgcggggtgacactgaggtcccagcagctccaaatgcaggcagagccctgtcctcagagaaggtcacagcctagccaagcccagccaggtggatgggcccacggaacgcacaggaacactggaacggaggttgaaagcaggaagcacagtctgtgactccccagcccactctgcattcgaccacttggggcccagaagcttcaggaaaggtgcacaaggtcactgggtcccagtactcccaacaggaaggtctggtccagggacagggctcttcccgactccccttagccacacgcaccagaagttctgcagtgcccagtgggcatagcagtccccaagaatgacccagcactgaagctgagccaaagaacttggggagcgagccacaccccctcactccctcttcgcctgctccagacttgccaggcggttgcttttcgtgggaaccgggatgtcctcaccaccctgtccagggcccagccccatgtccctggcctgctacagctggaaagaaaaaagagagatgtttgtttttatttgtttataaaaagaaaagtgttatatatataacatattatacctcatgaatacatacaattatttgtcaattaacaataaagaaaaatacagcaagcaaaaaagactctcttccacaaaaatagtgttcattacagaaaagtacaaaaaaaaaaaaaaactaagaggatatttagaattaagaaaaaactaagagggtatttagaattaaaaaataaaaagaaaacaattacccatgaggtaattactgaatgcatttggttgaaagtccttctgctatattttccaaactgtatgtgtatatatgtgcgcatgcatatatgtgtttgtgtgtgtgtacacatatctatatgaatggaccatatcgtaagttataaatgcatacatatattcatgtatatataatcattagatcatactataggttattttacagtctttttgttgaatacgttgtgagcattttatgtcattattttctacaagatttgaaaaataaagtataaataccagtt

SEQ ID NO: 603390 - DNA, 1463 bp, Homo sapiens
tgttggtggggcccccattttttttggtgggggaacacctcccctgagtgtgtaaaaaaactgaggagaaaaaaaacgcgggggagaaaaaaccccccacacaacacacacgagggacgagggggggcgcccgagagggcaccacagagaacaaaggggcgtggtgccccgcccagagggggggggctccctccacccaccgccgggggaggagaagagggggtccgcgagagagaagagagggagagagcagggaggggtggcggaaagagagagcccacaccccgcgggggggcccccgcgcggggcgccgcggggcgggggtgtcccgcggggggggagaaaacacaataggggggagggagagaggggacgcctcctctccacacccgaggggcgcgaggagagggggcaggggagagagacccggcgcagccaccatgagagggaggagagaaaaaacatccgcggaggagagacacccgcgagggaagagaagagagggggggggaggagagaagacacacgcgcggaggagaccaaccacatccgcgagaagagagtggtgccacacctctctaacacgacaacgagcggagagagtaaagagagagagagaaacagagagagagaggggcgcacaccgcgccgcgcggggaccacccaccacgaggagaaaaactagagaggagaacaccacacacgtggaaagaaaaagagtgagtgtggggaaaacagcgcgagagaaacacccacacgcgcggaacacagagagagagaggagagagccccacccaacagaaaaaaagaaaaccccccacaagaagagaaaaacaaaaacagagagtgaaagagagcacccacaaacaagaggtggggggaaagaagaaacaaccaaaaagcaggtgacccacacaaaaacaaaaagaaggagtgtacgcaattgagcgaaagacaaaagtgaagaggaaaacaagaaaaggagagcccaaaacaaaaccgcgcgggggggagaaaaaaaaccccaaccatttcaacaaaacaacaccccctgaaggaagaaagaacacacaaacagtgtggtactcaatgatggcgggggggggacgcacaaccaacaaaaccagaggggggagaaaaaaaaaacagagagggcagaaagagaaaaccaccaaggcggcaccgcgagacaaaaaaaacaatacagacaaggaggggaaaattatattagaaacacaacaaaacaaagtggggtgacaaaaacaaagaggaggaaataaagcaacccccccagaagatcaacagcaggatgaaggacggcagcacaacaacgaaccgagggggaaacgaagaacaacagacaggaacgaacctatgtggtggagaaaaaaacaaagaaggactcgtgtcagggagagcaccaccacccacaacacagtagggaagaagtactcaaccagcgg

SEQ ID NO: 603391 - DNA, 484 bp, Homo sapiens
  misc_feature (5)..(6): n is a, c, g, or t
  misc_feature (433)..(433): n is a, c, g, or t
  misc_feature (448)..(448): n is a, c, g, or t
  misc_feature (471)..(471): n is a, c, g, or t
ttgcnntagtttactgagaatgatgatttccaatttcatccatgtccctacaaaggacatgaactcaccattttttatggctgcatagtattccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatataccgaaattttgcttttctaaaatactgccagggattacactggaaacaggaatctgggcaagaggatttaaaaggacggatgccaggcttaggctggggaaattggaaaataaaagcccaatttcttcaatttaccccgttaaatagccttggttttgatggatttttggggggaggggggtgtgngggggggtattaggncttcctttagtttaccatttttntgtgctccttctc

SEQ ID NO: 603392 - DNA, 4710 bp, Homo sapiens
  misc_feature (144)..(144): n is a, c, g, or t
  misc_feature (2255)..(2255): n is a, c, g, or t
  misc_feature (2289)..(2289): n is a, c, g, or t
  misc_feature (2384)..(2384): n is a, c, g, or t
  misc_feature (2558)..(2559): n is a, c, g, or t
  misc_feature (2610)..(2610): n is a, c, g, or t
  misc_feature (2667)..(2667): n is a, c, g, or t
  misc_feature (2672)..(2672): n is a, c, g, or t
  misc_feature (3340)..(3340): n is a, c, g, or t
cggccgcccccgaagcgctgctgtcaccccggccgcgccccccaactttctgcacagtcgcggagctggaagtttccgggcttcgcggacacgctgggctgggtttcagtcgcggctccgaggttggcaacaaagagggaaagnaggaggaaaagcaggccggggaggggaggaagagaaccgcgcggaggccgcggcgccgagagccccagaacttccaattctacccagaagcttttttcgtcgtgtttttctcttaggtaaacaagcaagttccacgccccagtcctgctggggccttcgccagccaccgctctgggctcatctcccggcgcctcctcggggcacctgagcgttttaagccccactgccaagtgttttggacacaggtttttttgcggggtggtgaggttgggcacaagatgcttcctaaaaggttgttggcacgcagaccatggccccagtgacggagcggcaggcaggggcttgaggaacacgctgtctttgtctcgtccccaaagcacccggccgtgggtcacccgtgatccctggagtggagggactgttgtgacccctggtgctccaggagaaggggttccatgctgggtcccgggcccaggcccacggtgccctcagcctgcagttctccaccttgcggaatgatttgctggcccggcccagctccccggcaccaccattttctgccctcttttccctgcctggcttcaaaccctcccaggccagggtcccgaggagacacctgggctgggggaggcaactgagtgagcccaggcctgggaatcggcaaaagtggccaagccacatctctcgagactgcaagggccctggaggcgctgggaggcacagatctggctgccagctgggcctgaggcctccctttgtccgtccttcctgttcttcctcaccagacatgatcctctctgaggttggtcctgggcttccatacgtgattcatggaagaggtctcagccccaagagcccctgagggtactgtccactccccctggaaacttccagaacctgacgtggggctgaagacatagaggtaatggggatgggctggtggggcgctggctgggacaatgtgtggagcccttgttttcagagctacagatgcttgtcagctgacagttcgtttccagcatccacagtggacctcctttgggggagcatttacctgccaatgaaccccaagatcctttctcagaggcggcgggatgaagttttcctttttttttttttagttaatatattttatttaaaccaatatatccaaaatattatcagttcaacatacgatcaagataaagattaatgagatactttacattttcatactaaatctttttttaaatttttgtgagtacatagtaggtataaacatttagggatgaagtttcttactgtgttttcccagtaacaagcactggcatcagctgtcatgatttctccccaaggcctaggatggtcagcctcgcacgctccacagcagagtgactgaagctctatcgaggtgtggcacgagcgtgttgtcatttcaagagaatctgcagcctccctggtttttaatgaaagctcctatgcagggcctggccctttcctggggagggaagcctggctgtgtctcccgctgcatcctcactgggaacttcattcctgagctgcgaccgctattttttggattggaaaatgccttgggaacggctcatcttcctgcggcttgagcccatttgttttctgactggtggtcactggtgattagagtgtgtcccaaagggaaccgtcaccttagttctatcatacactatcaataacttgtccagggctgactttgtggctgtgtggcttgcccagtggcagagggccggtgtgcaggagggccccacactcaatgtttggctgtccccggtcttaaaattcttagtcattcttgaacaagggaacccatattttcattttgttctaggctctgagagttacataattgattctgactttggctgttggtcaacagtgtcataaggtaaaataaggtaaaaatctatgatttttatatttctttttttctttctttttccttttttttttttttttttttgagacacagtcttgctctgtcaccagggtggagtgcagtggcgcagtggtgcgatcttggctcactgcaacctccgcctcccgagttcaagcgattctcctgcctcagcctcctgagtagctgggactacaggtgngcaccatcatgcccagctaatttttgtatttttngtagagacgggatttcaccatgttggccagggtggtggtctcgatctcctgaacttgtgatccgcccacctcggcctcccaaagtgctgggattncaggcgtgagccaacgtgcccagctgatttttatatttcttttactaaattctgtttacagaaataattccagattctatgtaagatacaaatattttaactgaagatcattgtatttagggaaaatgttcacctttaagagacaggggctgggcgttgtggctcacgcctgtnntcccagcactttgggaggccgaggctggtggatcgcacgagcccaggaatnccagaccagcctgggcaacacggcgaaaccctgtctatgcaaaatatacaaaaattngccangcatgggggtgtgcacctgtaactcccagctactccagaggctgaggtgggaagactgctcaagcccgggaggtcaaagctgcagtgagagaccttgtcttaaatacaaacaggcaggaagtcgttataagcataatacaatcctggatgttggaatcatccctgtccagccttggctctgccacgtgggtgctgaatgctgcctcagggaccctggtgcccagctcccacctgcagggtgttctgaggagccagcacgctgggagggcctagcaggagatgtggcatgaaccaggtattcgataaataaaaagtgcctttgattgtcacgtttatcatttgacatgtaggcacaggtgcagtttgattatttttaatgtaagtctattttatctcttcccgttataaaagcaatacacactgtgatagacggtttggagaattcaggaaagaaaaagaaaaagaaaaaaaattcctcctaggccctctgctccagagcctccagccgtcacatgacagtgtatttctttacaattacagaaatagatacgtgactgttacattttgaaactttttcttttaccttgacttatttttaaatagaaacactagtgaggccccacagaactgagcagaactaatggccccccatgtggtggaatagttcngagctggccccactttggatgcagccttccccggcaagtctaaacccagtctctgtggctgcctgttcacagggaccgtggactgtgatgtttacagtacgaaagcactgggagagaacgctacatcacaaagtgtccttaacctgctgccgcctcagctttcccatttgtgacttggttaaaaaaattttttttgacagttttaagctcttattttaatttccacaggctgttgtagaatctgctcagccagggaggggaaaggagtcggcaatcaggtctcctcctgggcacctttgtgaggccagctggcgagagtgcggggtgacactgaggtcccagcagctccaaatgcaggcagagccctgtcctcagagaaggtcacagcctagccaagcccagccaggtggatgggcccacggaacgcacaggaacactggaacggaggttgaaagcaggaagcacagtctgtgactccccagcccactctgcattcgaccacttggggcccagaagcttcaggaaaggtgcacaaggtcactgggtcccagtactcccaacaggaaggtctggtccagggacagggctcttcccgactccccttagccacacgcaccagaagttctgcagtgcccagtgggcatagcagtccccaagaatgacccagcactgaagctgagccaaagaacttggggagcgagccacaccccctcactccctcttcgcctgctccagacttgccaggcggttgcttttcgtgggaaccgggatgtcctcaccaccctgtccagggcccagccccatgtccctggcctgctacagctggaaagaaaaaagagagatgtttgtttttatttgtttataaaaagaaaagtgttatatatataacatattatacctcatgaatacatacaattatttgtcaattaacaataaagaaaaatacagcaagcaaaaaagactctcttccacaaaaatagtgttcattacagaaaagtacaaaaaaaaaaaaaaactaagaggatatttagaattaagaaaaaactaagagggtatttagaattaaaaaataaaaagaaaacaattacccatgaggtaattactgaatgcatttggttgaaagtccttctgctatattttccaaactgtatgtgtatatatgtgcgcatgcatatatgtgtttgtgtgtgtgtacacatatctatatgaatggaccatatcgtaagttataaatgcatacatatattcatgtatatataatcattagatcatactataggttattttacagtctttttgttgaatacgttgtgagcattttatgtcattattttctacaagatttgaaaaataaagtataaataccagtt

SEQ ID NO: 603393 - DNA, 1707 bp, Homo sapiens
  misc_feature (733)..(733): n is a, c, g, or t
cctttaatttgggcctaactggggccaaagggggttaattcaggtctctccataaaagagaggggacaaaaggggcacaggtggggtctccggtgaaagaagggagggctccaagaagctctcacaaagaagaagccttctttgtgagaaattgtgcacccctctccactcccctctctctcgagggagagggtgtggtggagagatcacagtgtgggcctctcagagtgggataagagagccacagatgggcacaagacaaagtgagagtagaaaacctccacaacacacacaggcgtgggacacaaacagagctcacagagaggggcgcgagagaagagggcgagccacaagacggttctcgtgacgccacacacaaaggggccctatatatacagcgacacatgtgggagccacatctcggcgagaaaagtctcgcgagtctctctcacacaagtgtgagagagatgtgtttgtgagcacacacaaccggcgcgtgtgtgtgtcgcgatctatgctgagacacgttgtaggcgtgcgtgtgggcgccactatctggtgtaaaagacacaccctgtgtgagacacccacactgtgagaactctctgcgcggtgtatacaccacccccagtgatgagaagaaagccaagacacagaggcacccccgcgggggaccccccgcaccagagaaactccccaatgattgggagtgtgacgcctatgtggataaaanaaaaacaccgaggagggtgtaaggagcccacaagggggccaccaaaagaggggcccacacagcgtgtttgtgcgtcgtgtactcccacaacgaaaaagagaggggtggcaaaacagcggtgggagtacccacacgcggagagacaaaacaacctgcgtgggtggtggattacaccaacggcccacaagagcacaacatcaataatctctacccgcacctactatcatccaacgagaaaggagggtggcgccccaatacatcaacacaccaggatggggggaagaaaaacattccatctatgcacggtggatgtatcttcttcatcagacaaccgcaaccaagacttcgttggtgttctattcttccaagaaacatctttgtcccagaaataattagatacagacgtggctgttgttgattactacctccccaacaaaacaagaggggagtcgctccgctaggataccacccccaccaaaaagacgtactcaacgggagggcccaacacaacgaaatgaagacgactgctcgttatcaaacataggaccaatatgcttgatgttggtagagcacgcgccgaagtaatacacaaccataagtattgttagtttgctgcccccccaccaatgagctgatgttgtacaacacaataattcgtgcgttgtatgaacccacccaacaatagtactaactccacaaggaaaaaagagttcccaccaaagagaaggggggcccccaccaagagtgagcaaatccagacagcacaccacaagcatgcaccacgaagtggaggggagggcgcccacccgcagaggacggagacgatattgacgataacccaccaccgaaaaagtagacgggtgagtcataccagataaagggtgtcgcccacccacaagacgaaagatagtcatcacagccaggcccgccacatataatacgcacaccaagcacccacacgaagaaacattatg

SEQ ID NO: 603394 - DNA, 408 bp, Homo sapiens
  misc_feature (44)..(44): n is a, c, g, or t
  misc_feature (59)..(59): n is a, c, g, or t
  misc_feature (158)..(158): n is a, c, g, or t
atggttcttgaacttcctgggcttcaagcttatcttcccaaacntgggaatcttacccnaaagtggcctagggattaatagtttatgagcccacccacccatgcctggccaagaacattttcattatcaccaaaagttctattacaccagtgctgacntaaatgctttatgaaaatacataacaaatattttcaaaaatgattttctcttttttcttcttctctacaaatatgcttggtgagaaatccaggaaatataagaaatgcatggaatataagatgtaggctgagcgtggacgttcacgcctgtaatcccaggactttgggaggccgaggtgggtggatcatgagatcacgagtttgagaccagcctggccagcatggtgaagccctgtctctactaaaaatc

SEQ ID NO: 603395 - DNA, 3179 bp, Homo sapiens
  misc_feature (144)..(144): n is a, c, g, or t
cggccgcccccgaagcgctgctgtcaccccggccgcgccccccaactttctgcacagtcgcggagctggaagtttccgggcttcgcggacacgctgggctgggtttcagtcgcggctccgaggttggcaacaaagagggaaagnaggaggaaaagcaggccggggaggggaggaagagaaccgcgcggaggccgcggcgccgagagccccagaacttccaattctacccagaagcttttttcgtcgtgtttttctcttaggtaaacaagcaagttccacgccccagtcctgctggggccttcgccagccaccgctctgggctcatctcccggcgcctcctcggggcacctgagcgttttaagccccactgccaagtgttttggacacaggtttttttgcggggtggtgaggttgggcacaagatgcttcctaaaaggttgttggcacgcagaccatggccccagtgacggagcggcaggcaggggcttgaggaacacgctgtctttgtctcgtccccaaagcacccggccgtgggtcacccgtgatccctggagtggagggactgttgtgacccctggtgctccaggagaaggggttccatgctgggtcccgggcccaggcccacggtgccctcagcctgcagttctccaccttgcggaatgatttgctggcccggcccagctccccggcaccaccattttctgccctcttttccctgcctggcttcaaaccctcccaggccagggtcccgaggagacacctgggctgggggaggcaactgagtgagcccaggcctgggaatcggcaaaagtggccaagccacatctctcgagactgcaagggccctggaggcgctgggaggcacagatctggctgccagctgggcctgaggcctccctttgtccgtccttcctgttcttcctcaccagacatgatcctctctgaggttggtcctgggcttccatacgtgattcatggaagaggtctcagccccaagagcccctgagggtactgtccactccccctggaaacttccagaacctgacgtggggctgaagacatagaggtaatggggatgggctggtggggcgctggctgggacaatgtgtggagcccttgttttcagagctacagatgcttgtcagctgacagttcgtttccagcatccacagtggacctcctttgggggagcatttacctgccaatgaaccccaagatcctttctcagaggcggcgggatgaagttttcctttttttttttttagttaatatattttatttaaaccaatatatccaaaatattatcagttcaacatacgatcaagataaagattaatgagatactttacattttcatactaaatctttttttaaatttttgtgagtacatagtaggtataaacatttagggatgaagtttcttactgtgttttcccagtaacaagcactggcatcagctgtcatgatttctccccaaggcctaggatggtcagcctcgcacgctccacagcagagtgactgaagctctatcgaggtgtggcacgagcgtgttgtcatttcaagagaatctgcagcctccctggtttttaatgaaagctcctatgcagggcctggccctttcctggggagggaagcctggctgtgtctcccgctgcatcctcactgggaacttcattcctgagctgcgaccgctattttttggattggaaaatgccttgggaacggctcatcttcctgcggcttgagcccatttgttttctgactggtggtcactggtgattagagtgtgtcccaaagggaaccgtcaccttagttctatcatacactatcaataacttgtccagggctgactttgtggctgtgtggcttgcccagtggcagagggccggtgtgcaggagggccccacactcaatgtttggctgtccccggtcttaaaattcttagtcattcttgaacaagggaacccatattttcattttgttctaggctctgagagttacataattgattctgactttggctgttggtcaacagtgtcataaggagaatctgctcagccagggaggggaaaggagtcggcaatcaggtctcctcctgggcacctttgtgaggccagctggcgagagtgcggggtgacactgaggtcccagcagctccaaatgcaggcagagccctgtcctcagagaaggtcacagcctagccaagcccagccaggtggatgggcccacggaacgcacaggaacactggaacggaggttgaaagcaggaagcacagtctgtgactccccagcccactctgcattcgaccacttggggcccagaagcttcaggaaaggtgcacaaggtcactgggtcccagtactcccaacaggaaggtctggtccagggacagggctcttcccgactccccttagccacacgcaccagaagttctgcagtgcccagtgggcatagcagtccccaagaatgacccagcactgaagctgagccaaagaacttggggagcgagccacaccccctcactccctcttcgcctgctccagacttgccaggcggttgcttttcgtgggaaccgggatgtcctcaccaccctgtccagggcccagccccatgtccctggcctgctacagctggaaagaaaaaagagagatgtttgtttttatttgtttataaaaagaaaagtgttatatatataacatattatacctcatgaatacatacaattatttgtcaattaacaataaagaaaaatacagcaagcaaaaaagactctcttccacaaaaatagtgttcattacagaaaagtacaaaaaaaaaaaaaaactaagaggatatttagaattaagaaaaaactaagagggtatttagaattaaaaaataaaaagaaaacaattacccatgaggtaattactgaatgcatttggttgaaagtccttctgctatattttccaaactgtatgtgtatatatgtgcgcatgcatatatgtgtttgtgtgtgtgtacacatatctatatgaatggaccatatcgtaagttataaatgcatacatatattcatgtatatataatcattagatcatactataggttattttacagtctttttgttgaatacgttgtgagcattttatgtcattattttctacaagatttgaaaaataaagtataaataccagtt

SEQ ID NO: 603396 - DNA, 288 bp, Homo sapiens
agctggtactgtaggcacacaccaccatgcgtgggtaattgttttttttttactcgaggacgcgggtgttcgccatttggccgagattggcttaatcttcttataagaaccgattcgcctaatgaaaaatcttttatctgagggcacaggtgacactaactatcgccgtgttgatggccaagcttgcgccacttaccgtagctcttgtcgtgggagaaagcgttgatgaagatactgttgtccctgaaaccgggaaactatagtcgggataccccgccagtctcagga

SEQ ID NO: 603397 - DNA, 605 bp, Homo sapiens
ggacgccggcctgcacagcgccatgggtcttcctcaccgcgcagctctggctgcagatagtcgtgtcaccgaccgtctactttcggatccatgaggtgctgaagcacgccaggcacttccggggaaggaacaatcgcgtgctacaggttggcggctcatgtaaccgatgattcgatgcctttgtgaaattgcatcctaagagcccgtataccgctgtagatgaaaaatgagacactgaggacccgtaagcggtggacccgggacacccgccggccagcgcactcgcgtgtccctgcgtttctgcgcctgcgacccagctagtgtgctagccgccctgggcaccctcagccccgttcctttcataccttgcttcgaatactccgacgatattatgtcgccccgtcaggcaagactgtgggacatccgttctctcgcgcggggcaggcgctccagcgaacaacaacggacaacagaagtttgaccttacaagttaccgtttgttacgcttgagcgactattattcattttcgtttacaaaggaatataattttcttctaatcaaaaaacaacatccaacaaagaaaaaaaaaaaacacaacacagca

SEQ ID NO: 603398 - DNA, 843 bp, Homo sapiens
  misc_feature (69)..(69): n is a, c, g, or t
  misc_feature (97)..(97): n is a, c, g, or t
  misc_feature (132)..(132): n is a, c, g, or t
  misc_feature (189)..(189): n is a, c, g, or t
  misc_feature (194)..(194): n is a, c, g, or t
  misc_feature (210)..(210): n is a, c, g, or t
  misc_feature (225)..(225): n is a, c, g, or t
  misc_feature (228)..(228): n is a, c, g, or t
  misc_feature (249)..(249): n is a, c, g, or t
  misc_feature (254)..(254): n is a, c, g, or t
  misc_feature (258)..(258): n is a, c, g, or t
  misc_feature (263)..(263): n is a, c, g, or t
  misc_feature (266)..(266): n is a, c, g, or t
  misc_feature (277)..(277): n is a, c, g, or t
  misc_feature (280)..(280): n is a, c, g, or t
  misc_feature (290)..(290): n is a, c, g, or t
  misc_feature (301)..(301): n is a, c, g, or t
  misc_feature (312)..(312): n is a, c, g, or t
  misc_feature (314)..(314): n is a, c, g, or t
  misc_feature (324)..(324): n is a, c, g, or t
  misc_feature (335)..(335): n is a, c, g, or t
  misc_feature (337)..(337): n is a, c, g, or t
  misc_feature (350)..(350): n is a, c, g, or t
  misc_feature (355)..(355): n is a, c, g, or t
  misc_feature (363)..(363): n is a, c, g, or t
  misc_feature (367)..(367): n is a, c, g, or t
  misc_feature (369)..(369): n is a, c, g, or t
  misc_feature (375)..(375): n is a, c, g, or t
  misc_feature (378)..(378): n is a, c, g, or t
  misc_feature (389)..(389): n is a, c, g, or t
  misc_feature (391)..(391): n is a, c, g, or t
  misc_feature (400)..(401): n is a, c, g, or t
  misc_feature (406)..(408): n is a, c, g, or t
  misc_feature (412)..(412): n is a, c, g, or t
  misc_feature (419)..(420): n is a, c, g, or t
  misc_feature (427)..(427): n is a, c, g, or t
  misc_feature (435)..(435): n is a, c, g, or t
  misc_feature (444)..(444): n is a, c, g, or t
  misc_feature (452)..(452): n is a, c, g, or t
  misc_feature (457)..(457): n is a, c, g, or t
  misc_feature (459)..(459): n is a, c, g, or t
  misc_feature (468)..(468): n is a, c, g, or t
  misc_feature (476)..(476): n is a, c, g, or t
  misc_feature (486)..(486): n is a, c, g, or t
  misc_feature (490)..(490): n is a, c, g, or t
  misc_feature (492)..(492): n is a, c, g, or t
  misc_feature (546)..(546): n is a, c, g, or t
  misc_feature (750)..(750): n is a, c, g, or t
  misc_feature (802)..(802): n is a, c, g, or t
agtataatattcatctccctggagttatgttgaaggcagagttttcatagggttagatttttttatccntttctagttcagttaattcatcctgttnaattgcaccatcgtgaaagatgggaaaaatcgtgntgatgggtaaggggaaaacttcccggaaggcaatggggcaaggaaaaagaaagcctntgggnaatggctgtgctcccnacatagctttgcagntgntgtgggttttttttttttttngggtngttngtttnganagagagtctgntcngtctcccggntagggtgtggnggtgtgatctngntcacggagcnttgccctcccngntcaagcagtcttnatctnagctccanagtngngggacnacnggcatgtgatntnatgctcggnngattnnngttnacttttnngagaganggggtctngccatattngccaggcnggttngnactcctacnactcaagnattcctcccncctngntctcccaaaatgttgggaccacgggtgtgagccaccgcgcccggcttgctcctntgttttgtttttgttttgttactttggttgatgtttaggccctccattttggaaagcaggaaaacaggattttttttttttttcttgttccctggaggatccagggatgaggatagagtggccttagggcagggcttggattcagcctcctgctgggtccttctgctggaaacaggcacccagaggcgggggtggggcagggantgcgccttcctggggtgcccggtggtgtgtagagaaaagctgcttgtttacnccttaagtcaatgtattggtcactgttgatttgttgaacaa

SEQ ID NO: 603399 - DNA, 665 bp, Homo sapiens
cacgagcttgctgtcacccaggatggagagcaccgtgatgatcatggatcactgtagacttgaccatgcaggctgccaccttagactcccaagtagctgtgaccacaggcacgtgccagcatgcccagcttatatatattttggtagagacaaggcttcaccatgttgactaagtaggcatcaaactgccggactcaagtgaacctcctgcctcggcctttcacagggatgggattacaggaataagccactgagcccggacctttttatcttctgttacagaggccagtactggctagctagcaggttatctgagcctcacaagtgttgaggcaaactctatactatatgcttactctacagagttgcagaatactgtatttttagagataaacatacatacttgattctgcccagtatattctgttgaactgtacaagctacgatattaattctctttggagaggaggcatctgttaagatcgaaagggggatattttctcataacggtcattgctgagaggtcgggacattctcacttaacgagaggcctttggggctcctgtgactaagtttagtcacatggggcatggttttatgggactcattcacactgtgctaggggcttgcaataactctgtgtaacacagaaggtacttcttccc

SEQ ID NO: 603400 - DNA, 342 bp, Homo sapiens
agaaaatagcactttaaggccaggcaaagtggctcaaacctataatcccagcactttgagaggccaaggtgggaggatcacttgagcccaagaggtcaagaccagcctggacaacacagtgaaacctcatctctacaaaaaataaaaattagccaggcatggtggcaaaatcctgtagtaccagatactcaggaggctgaggtgggaggattgcttgagcccaggaggttgagggtgcaatgagtcgtgattgcacaactgcgctccaacctgggtggaatgacagagtgaaaccgtgagaaagagggagtgggtgagagtgagaccgtgtctcaaaaaaaa

SEQ ID NO: 603401 - DNA, 960 bp, Homo sapiens
ggcggaggcggaggcttgggatgcgtcgcggattcagcttcacccgcttaacccatcgccatggtcgaggaaggttgctgctggaggtgtagtggacgttaatacatgctttacaagaggttctgaagactgcgctcatccacgatgggctagcgagtggaattcgcgaaggtgccagatgccttagactagcgccaagcccatcttgtgtgtttgcatccaattgtgatgagcctatgtatgtcaagttggtggaggccttcgtggtgaacacgcgaatagtcgatgcctaattaaggttgaatgacaagcaatgaaactaggagaatgggtaggcgctttgtaaaattgacatgagaggggaaagcaccgtaaaagtggtaggttgcagtgtgtagtagttaaggagtatgggaggagtctcagggcacggtatgtgatggaagagtgatgtcaggatgcaaggacatgatgatgtaaatgttgggtcactggtatcgacctggctgtggggagacgggtggtgactgttagttgagtataaactgcgggctgtctcccagaaaggagttgaaaagaaactttggatgtcaggaagagaaggaatgcctcatacggaaagactctggatcaagaattttaattcaggggagaattagagcgggcagcggaaacacgttcgaccgaagatgggcttgcgcatagtggaaatgcagcggcccaagtcgcggtggcccggaccgggttcggaggggcaacgttcacgagccactatgacatcaaggtgatggaagtccagccgcactgggtgttgcgcacagaggcaccttgagcccagaacgtgcacgctcaagaggacgcgtacgaggagccaagagggagtacgataagccacaggtagaacacgcgcgacacgctgaagaagagacccaagcaaaaggccgcggtataaccatccca

SEQ ID NO: 603402 - DNA, 113 bp, Homo sapiens
actggaagagcagaaattaataaaactgaacatgcagaaaatcaactgaaacgacaagaacttacttcttgtgttgttgtatgtttgtttggctaacaaggagcatagtcttg

SEQ ID NO: 603403 - DNA, 124 bp, Homo sapiens
gaggcagttaaggaggaggaagccttaaggggaactggcctgcgtgcactccgaacctcgggaacataatagcgcgtgaacgctgctcttgaagactatagccagaggaaagatgtttggttta

SEQ ID NO: 603404 - DNA, 149 bp, Homo sapiens
tctggcggggtgcacagattagactctcatagaaaaaaacaacgaagagcgcaagacactgctcagcaacctacgaagaagcccagaagaagaaagaggatgccctaaatgagacccggggaatcagagcacaaagctgaaggagctcc

SEQ ID NO: 603405 - DNA, 544 bp, Homo sapiens
  misc_feature (274)..(274): n is a, c, g, or t
  misc_feature (450)..(450): n is a, c, g, or t
  misc_feature (459)..(459): n is a, c, g, or t
  misc_feature (505)..(505): n is a, c, g, or t
  misc_feature (531)..(531): n is a, c, g, or t
ggaacagggagtgtactgatacaaagttgtttgtcaggaattgtccttgatttacagaaacaacattggttcgtgattggctatccattgttgagctatgcattattaggttaatttgcagctgcttgtggcaatagcaatcagtttcaacagttgaagacatagctcaaaagggagggggagtagaaagtgattgctgtatcgttttaatgtctctctgggcctgataataaagacttgcatccctcagatgttatttctcagtaacttagcntaaagtattaagttaacagagttttgtcgtacaagtgtatatgtttgaagagtaatagattgttttgtcaattaacttgaacctggcccgaaggagaagccacagttgtcccattctgccccaccacctttgggctgattgtcatggtcaaagaagctagtggtaagtgtgagccnagcaactcncctttccctcctcccagttctgagaccttagtagagctttggagantgaatgagagtgttgagttatggtcncatgtgctgacgg

SEQ ID NO: 603406 - DNA, 819 bp, Homo sapiens
tttccggtttgccgcgtgcgcctctaacgttggggagaccgccgggggtgggccaaaaaacgtgcccggtgtgtggccactctccgagggggcattcctggaccgcggttttgtgcccaccaccgctggggaccccctgttgtcgtggccccgtgggctggggcgaaaatcctggaccacgaagttggggcccctcgtcctgtagtgacgacagggcgaggatccgccacccaccacttcgggtgcgctcacccgcgggcttcttgtgtgcacaccgccgggtggtggtgttttccccccgatagggatcccctcgctggtcttctttgggggccacaagacaggcgccccgcacgacgtgttctgtgggggtttccactctgaggacgcaccaaacctccattcaccccggcaaagtgggggagacaatctactctccagcaggccgccggctggtggtccaccgcccagtagcccgcgtcctcacttctgtgtgtcgcaccaccacagaccccgcactcacattcactaagttatggggcgtattatgagcagggagaagaaatccatgtccagggaaccccggagcccagaagcgtatcctcggccaaccccaccaggcgcgtagaaccacccacgcgtcgcccacgacaggggccaggtgctgcagtacaggcccaacagagcgtgttgcgggtgtcaacaggcgaccacaacggggcggcgacttgggcacagggggcacagggcgccagcccctacgaacagtttcgggccgaccgccttcccaaagataaaaaaaaactcccccacataaca

SEQ ID NO: 603407 - DNA, 624 bp, Homo sapiens
aatcctccttacttgaaacactgaaagcatggcagcatttatactttgtttgatagcatttcttattgtatagtttcgtttctgttattgagatggagtcttgccctgttgcccaggctggagtgcagtggcgcagtctcggctcactgcatcctccacctcctgagttcgagcaattctcctacctcagcctcttgaatagctgggattacaggtatgcgccatcacacctgactaatttttttacttttagtagagacagggtttcaccatgttggcccggctggtcttaaactcctgactttaggtgatctgcccacctcggcctcccagattacaggtgtgagccactgcgcccagcctctaataactttttataattagacaagaaattattaatgttttcccttatattgctagggaagttcatttcatcctgtgcaatccttggggaaaaaacatagtcttatctctaccttggctcttcatagcattcattcagcacatctttattgagcacctactgtgtgctggacactgtgctaggccctgaggctgcagaagtgcatagcacagaacagtactgcccaggctcatgagttagtgaaggagaatctcggggct

SEQ ID NO: 603408 - DNA, 356 bp, Homo sapiens
ccatccaagcttttccatgtctctactatcagtaaactaactagagacataactcacaatatgcagaccccactgagatgtacaccataatttgagattcttggcatgttaccttcacattatggaatattgaataataacaatattattcatacataacttgatgttcacacatacacaaaaatagaataatgaaactctacccatcacccagctgcaacaaatatcaatactttaccgttcttaatacatccaaccccttactttttgtttgtttctgttggtgacgtatttaattgtactctctttttaaatagacaggatctcagtctgtcacccaggccagagaacagtgg

SEQ ID NO: 603409 - DNA, 617 bp, Homo sapiens
  misc_feature (520)..(520): n is a, c, g, or t
aggctgcctagatttcccactgttgagcagcatgtgttttagaaacgttccacacttctggatagacagaaggtaacagagtggatagcaaagatgagggggaggagagggaagcatctggacagcagagtaaaataaaaggggtagaattgcaggaggctagtcatatgggggcctggaatttacccagtatattccaccccaagataggggtaggacactaagggataactaagaaggagtggatgaagggggtattgaataggttgcataataggggaccagtatgtgcctagaggggattccattgactctcacaatagagatagaagaactgaggagggtcaagaatattctgataaaactgagtaactagtccccagatctaaaaggaagagcatgggcttaccaaagactgacagcgttaccctgggttccgaggtggtgatggcggtgggggcagcggaccctgggccccgtcagtcttcagcagccaggtctacaatgcttgcaagactgnaaccagggttgcaggacctgtttgagtcagaggtggcaagcgggggaagagtctgtggagtgcatctgacttccaggtccctgatacacagataggc

SEQ ID NO: 603410 - DNA, 133 bp, Homo sapiens
  misc_feature (8)..(8): n is a, c, g, or t
  misc_feature (73)..(73): n is a, c, g, or t
catatttntagccagctccatgatgagctgctggtccgcagatcatgcttgcaggttttaaccagagtcagtnttggttagagagtcttgaacacagccacgtggtggaagaagatttatggacaggaaaagg

SEQ ID NO: 603411 - DNA, 555 bp, Homo sapiens
  misc_feature (111)..(111): n is a, c, g, or t
  misc_feature (122)..(122): n is a, c, g, or t
  misc_feature (130)..(130): n is a, c, g, or t
  misc_feature (555)..(555): n is a, c, g, or t
gtcatccaagctaccagctcagcgatgtggatggagtcacctgtgaagacatcgacgagtgcgccctgcccaccgggggccacatctgctcctaccgctgcatcaacatcnctggaagcttncagtgcanctgcccctcgtctggctacaggctggcccccaatgccgcaactgccaagacattgatgagtgtgtgactggcatccacaactgctccatcaacgagacctgcttcaacatccatggcggctttcgctgcctggccttccagtgccctgagaactaccgtcgttccgcacccacccgctgtgagcgcttgccttgccatgagaatcgggagtgctccaagctgcctttgagaataacctactaccacctttctttccccaccaacatccaaaccccccgcggtgggttttccaaatgggccccctccaatgcttgtccccggggacaggattggcacttggcatcacccggcgggaattgaaggagggttttttcaccaacccggaaggtgaggcccccacagggggggggtgggccctcaccaan

SEQ ID NO: 603412 - DNA, 615 bp, Homo sapiens
ggaggaaggaaggagctccaactcgccggcctgtgccacgggattgcccccaaattcccagactctgtggaggagctcctgctgccgcctggcacatgagatgtttcctgcaacggcctagtacgccgatggcctcctgcgctctactggcctgcgctgctgcgggtgctgcatgtgcgcaatggttcttcatacccaagaagaacgaaagtgttctcgtacttccagacctgagcagcatgtcacattgaatggatggaaactgcagagactgcatcgaaagattgcacttcagcactggccttggttcccttcagcattaatgcccctgtcttgcgtgcgagcatctgcttatgatgtgctctggatgaagtacacctattggcctatgtttgactataaggaacttgtgctgcagattgatgataatgtgacgtcagccgtagaaggcatcaacagaattgaccagagctctcatggactctcttgggcctgagttggtgcctgaagacttgccctcaatccccttggtgcctgtttcatgctcagaagaggtggaattccttggcttcggagaaccacaaagagatggtaaaagcagatccaaggaaccac

SEQ ID NO: 603413 - DNA, 587 bp, Homo sapiens
ggcgctgccctgtgtgacgaggcatccaatgctctttgaagagccatgaaggagccccaggtaagccgactcattcttcgtcggaaatcagtctcctccgtgctccgacgtgatagttcagccacagcggtcgctacactgctcacccgggactaccttacggtcaaggtctgggacctgaacatggaggcgagacccatacagacctaccaggtccatgactaccttcggagcaagcgtctgttccctgtacgagaacgagctgccttttcgacgaagtttgaactgtgcctggaacgggagcgactagcgtcgtcatgaccggggccgtacaacaacttcttccgcatgtacgatcggaactccaagcgggacgtgaccctggaggcctcgtgggtacagcagctggccccgggctgttgctcatgccgcggtgcgtgtgcgtggggggcaagcgccggcgtgatgacatcagtgtgggcagcttggacttctccaagacgatcctgcacccggtcgggcacccggctgagagcctcattgtcattgtcgccacctggagcctgtacatcttccaggacgaggta

SEQ ID NO: 603414 - DNA, 151 bp, Homo sapiens
tcttcagcgtctggattgtagcgttctcaggtccttcggatgaacctatcccgtaccgtgtacatgtagacggactacatcgaagtgataggcagacgtcgactggtcgtcgcgcacggggcgtgcgatcgaccggcagagcgactgacag

SEQ ID NO: 603415 - DNA, 823 bp, Homo sapiens
cgagtggagctggctaatcaagaggtaatgagagtagtagctcggtgctagttattgtggcgatcaatacgtaggccactgagtcgtcaggttgatggcgaacgacgcataccgcagcctggtggcatatgcatggttgggctccacgatcagagatactgtgaggacgaaacatttaaagagtgtgctcgctacgaggaacccttcgtgaaaatcgcccgttgtacaattgtgaagctgtttagatccgagagagtaggaacagcttcatgggtccactaactagggaacatgaattcgttgtttgcaggagagtccatcacattgataagccctatgaagtgagggatcttagaaaagactggcctagcaaatgccaaagaaaacggcgtttgccaagacatgcggacatggcgcatgtaaaactggagaatattccccaaactatcactagtagatggtgagagcttcgcattccaacatccgcaaagtgtgtgaatgcacccattcgtaatccatcccctgagtatgagaagaaagcatacacatgtttgaggcctaacggttacaccattggcagtaccaatatctaccattcgcgtggataaagtctctggcggtccagaaatttaggagaccatttgatagcgtgactaatttagacgagtccccaaatatgctcgcgaattcaaacaccgaacagacagtgcctttaattagccgctgcagtggtacaaagcccaagcacaggggcatgccgtccatagagcgcacagggtgtaagaacaaggtaagggggaacctcgggaaaattcctaacacc

SEQ ID NO: 603416 - DNA, 106 bp, Homo sapiens
gtttttcttcgtgcgggttgtgcggcaccctcggcgtgcgctggaagccaagggcgaaaaactcgcgcacctgtttatggtggccgccgagggtggccgccacaaa

SEQ ID NO: 603417 - DNA, 722 bp, Homo sapiens
gtgttgatgtggcgatacattcacacagaacagttgactgatacgaattatacgaccactataggaattggcctcgagccaagattcggcacgagggaagagttgcttttgatagatcagcaaagaaaatggtttcttgagatgaaatctactactggcgaagatgctgtgaacattgttgaaatgacaacaaagggtttagaatattatgtaaacttagtttataaagtagcagcagggtttgaaaggattgacttgattttgaaaaaagttctgctgtgagtaaaatgctctcaagcagcatcacatactagagcaaactctattgttaaaggaagagtccatcaatgcagaaaacttcactgtcatcttgagagattgccacagccacctaaccttcagcaaccactactctgatcagtcagcagccgtcaacattgaggcaagcctctctaagactcagtgaagactcagataatcattagcaatttttagcaataaagtatttttaaattaagctatgctcattatttttaaagacataatgctatttcacatttagtaggctacagtatagtgtaagcctaacttttatgtgcaatgggaaaccaaaaaatttgtatggctctgtttattgtgatacttgctttattgcagtgatctggaagaacctgcaagatctctgagttatgcctgtaataaaattttttagaagtcctgca

SEQ ID NO: 603418 - DNA, 143 bp, Homo sapiens
  misc_feature (25)..(25): n is a, c, g, or t
gggggggggggggggggggggggtncccccccccccttcccccccccctggggggggggttttttccccggggggggggggggtttttttttggggggggggggcccccaaggggccataaaagggggttttttggggggtta

SEQ ID NO: 603419 - DNA, 327 bp, Homo sapiens
  misc_feature (43)..(43): n is a, c, g, or t
  misc_feature (50)..(50): n is a, c, g, or t
  misc_feature (56)..(56): n is a, c, g, or t
  misc_feature (60)..(60): n is a, c, g, or t
  misc_feature (66)..(66): n is a, c, g, or t
  misc_feature (68)..(68): n is a, c, g, or t
  misc_feature (101)..(101): n is a, c, g, or t
  misc_feature (103)..(103): n is a, c, g, or t
  misc_feature (191)..(191): n is a, c, g, or t
  misc_feature (199)..(199): n is a, c, g, or t
  misc_feature (210)..(210): n is a, c, g, or t
  misc_feature (229)..(229): n is a, c, g, or t
  misc_feature (233)..(233): n is a, c, g, or t
  misc_feature (282)..(282): n is a, c, g, or t
  misc_feature (323)..(324): n is a, c, g, or t
  misc_feature (326)..(326): n is a, c, g, or t
ggaggcttcagggccagtccttctggacactgctcccagaatncctcccntcttgngggngttctngngggtgggcaaggctgggagggatatcaacttcngnggagaacacctagacccaaggacttttttctgcccaaggaacacagtttccttcagcttccatccctatgcatgcatcatggtccccncaaaaggnggatatgtcgnctcggtgggagggctgggngcangggccagatagaaattattggttttgttttttaattttgtttttcctgntttctgagaataaaggttttgttatatcaccacacaccacnngng

SEQ ID NO: 603420 - DNA, 138 bp, Homo sapiens
acagctgccctggaggttaccataggcactactgatgcgagtgtggaggctgtcagccccagagaggagaacatcgttgtcgattgcggatgatgtgcaaggggtggatccgcacccggctatggaagccatcttgga

SEQ ID NO: 603421 - DNA, 124 bp, Homo sapiens
tgacgggttccggtaagaagagcgaccctcacatcaagctacaacttccgtgcaaaagagagaggcagttgtgtctatcaacaggagtgtgtgctaaccgttacctggctatgaaggaaggggt

SEQ ID NO: 603422 - DNA, 476 bp, Homo sapiens
tcgtaaggaggcgagtgccctcaatgctccagcaacaagtctgagcagccattgcttgcatgacaggagtgagtatagaacataacgacacatgcccaacgctgtaatacagttgctagaaggtctacatgtccaacaaatgaaagattggcctccttttctttgaatattagattacatgttacaaattttcgtgggttttttcggttggtgtagctatcattttgtactgtagtgtgtgtacaacaacaggaaaagtccatggcatggatgtcccgtgttagcagagttaggatgtcatctggtccgactgttggaggatctgcgtgtggtacagcgtccagtggtgtgattcacgcctgatgatctcgctgttgttcagtttcaggcgtggttacagcatacaggagaacgagtccagtctgggtagcccgcgcgcacacagaagggtgcagtgctagtaatacggtcgccga

SEQ ID NO: 603423 - DNA, 800 bp, Homo sapiens
  misc_feature (5)..(5): n is a, c, g, or t
  misc_feature (102)..(102): n is a, c, g, or t
  misc_feature (104)..(104): n is a, c, g, or t
  misc_feature (114)..(114): n is a, c, g, or t
  misc_feature (126)..(126): n is a, c, g, or t
  misc_feature (174)..(174): n is a, c, g, or t
  misc_feature (176)..(176): n is a, c, g, or t
  misc_feature (197)..(197): n is a, c, g, or t
  misc_feature (218)..(218): n is a, c, g, or t
  misc_feature (252)..(252): n is a, c, g, or t
  misc_feature (258)..(258): n is a, c, g, or t
  misc_feature (293)..(293): n is a, c, g, or t
  misc_feature (296)..(296): n is a, c, g, or t
  misc_feature (306)..(307): n is a, c, g, or t
  misc_feature (329)..(329): n is a, c, g, or t
  misc_feature (333)..(333): n is a, c, g, or t
  misc_feature (342)..(342): n is a, c, g, or t
  misc_feature (350)..(350): n is a, c, g, or t
  misc_feature (370)..(371): n is a, c, g, or t
  misc_feature (374)..(375): n is a, c, g, or t
  misc_feature (382)..(382): n is a, c, g, or t
  misc_feature (396)..(396): n is a, c, g, or t
  misc_feature (398)..(398): n is a, c, g, or t
  misc_feature (404)..(405): n is a, c, g, or t
  misc_feature (409)..(409): n is a, c, g, or t
  misc_feature (432)..(432): n is a, c, g, or t
  misc_feature (442)..(442): n is a, c, g, or t
  misc_feature (460)..(460): n is a, c, g, or t
  misc_feature (474)..(474): n is a, c, g, or t
  misc_feature (503)..(503): n is a, c, g, or t
  misc_feature (515)..(515): n is a, c, g, or t
  misc_feature (607)..(607): n is a, c, g, or t
  misc_feature (724)..(724): n is a, c, g, or t
  misc_feature (734)..(734): n is a, c, g, or t
  misc_feature (761)..(761): n is a, c, g, or t
aattngggaggttactactttagttcagagactgtaaactaaacctctgttgagcaggggtgtgtgtgtgtgtgtgtgtgtgtgtgtgtgtacgtgcacaangnggagcaaggngggatgattggngcaggaatcacgtcttcaagtcttcaacaacttcccactgcaatccananggccacgccataccctttgangtcaatcgcaatgctctgtgntatccactaccactgccttcttccagctgacggngaagtntcctgtaccggcccctgctgctcctgcaatgcagnggnccccgttgtnngccatggagatgagcatcccgnagtngcttatggncacctggntgttgtgcagctctgtttgnnggnngtgtggnttgtttagtttttntngctctnntgtnttgtgtgtgtccataggggtggntccttttggntctgggagaggggtgggnttgtggcgagtgcngggttgtgacttacgcagcaggctctctngggctatcttgngtgcttcatagagcattgctagtgaaacactgccacaaaagctccagccatttctccagctgtattgatcaccaaaccggaaaacagtagtnccacattcttaaagccaaagtagaaggtcataggcatcatcatcatgctgctgtctcctccaccatgggagtgtgaggctgaagtggttgggtgatggtgagaaggttgcatggtantgttggagtncatatagctcatccccatatggtgggnatgatccattttttcaggaaaagttgagagtagcagaag

SEQ ID NO: 603424 - DNA, 137 bp, Homo sapiens
  misc_feature (11)..(11): n is a, c, g, or t
ccaactcaggngcgagctgctacagaagcttgggcagagatgatggtggcttccacaggatggcagtgagtgccctcactctgctttcttctttgaatccttgcaaggtggacaggtagacagcagctcgcccagtt

SEQ ID NO: 603425 - DNA, 342 bp, Homo sapiens
ccggtctctgtaacttagattgatgggcatttgggttggttccaagtctttgctgttgtaaatagtgtagcaataaacacgtgtgcatgtgtctttatagtagaatgacttatattcctttgggtatactcagtaataggattgctgggtcaaatgggatttccggttctagatcagaggctaatagtctagctggctttgcagaatcgcgtcctagtgggtcccttgcctgtcctgcccaccagtgcctgggtcattgagtgatcacacctgtcaatagttctggcttctcacgaacttcccaggcctaagttcagagccaggcgtaagttcagagccagg

SEQ ID NO: 603426 - DNA, 82 bp, Homo sapiens
gtaagactgacatagaggaggagagaggcgtccacctggcagcttgaaatcacctcttcccaaatgcaaggcactgggtgag

SEQ ID NO: 603427 - DNA, 436 bp, Homo sapiens
acagcattatgtcaaaaaaagtatgcaccttaacttaaaaaaaatgctaacattaaatgctaaattaaaaaatgctaacaattatctaggcctttagtgagtcataatctttgctgtagagtgtcttgcctccatgctgatagctgctgactgatcagggtggtggttgctgaaggttggggtggatgtgaccatttcttaaaataagacagcaatgaagtttgcaatgtctgttgactcatcctttcatgaatttatctgcagcatgtatgcagttcgatagcatgtgacctatagcagaaattctctcaaagttggagtcagtcttctcaatccctgccaatgctttgtcaactaagtttatgtaatattttaaatccttttttttgtcatttcaacatggttcacggcatcctcaccaggattacattccatg

SEQ ID NO: 603428 - DNA, 121 bp, Homo sapiens
  misc_feature (82)..(82): n is a, c, g, or t
gtactacaaacctattttatttatataacttcttatgaagtagattttgtacacatggtaggctaaaaattaaaactgctcnctccgcggtttctgataaattactagattcttggttctt

SEQ ID NO: 603429 - DNA, 216 bp, Homo sapiens
tgatgcagctctctctgatgaactcgcagtacagcataaattactgtaatagcacataaccagaaattcacatgtagttccctttttttttttggttggagacagattctccttttgtcacccgggctggagtgcagggcggtaatctcagctcatggaaacttcaaccctcaaagtccaagggattctctggcctcagccccttgagtagctgga

SEQ ID NO: 603430 - DNA, 925 bp, Homo sapiens
catggcggatactgcatctgcagcacgaacccatctccagcctggagcctgacagcctgactgccctgggcctgaggagcagcctgcagcagccgccaccagtgtgccgagtgagcggagcctgagtttgatggcagctgcctagcggtgaatctggggccctcaccatgagttcctcgcctgttaatgtaaaaaagctgaatgtgtgtctggagctgacagaggagctcaagaagcgacgccttatctgacaagggtctcaaggccgagctcatggagcagactccaggctgcagctggacgacgaggatggcctgggggccgacccgaccatggagccctgggaactggcagactagacctgggcggggattccgctggtgcgctcgtggagcaggcctcgagcaggaggcacgcggcacggcggcgatgaaagaggaggaggaagcaggaagaggaggaggcatggaatctccgcatctggacggcgaccagatggagctaggagaggagaacaggggccgcaggggtgcggacgactcgggcccgatggaggaggaggaggccgactcggaagacgagaacggcgacagaatcagggattaccacggacagggcggcacgatgacgctccggggaacgaacagtgacagggacgcggagcgaacgaagaaacggggaaccggggagccagccaggcatcaaacggacgggcgacgcacacaggcaaacagccccaaaaagaaagagacagtgtgacgacagaaggagggaccgcagggtgaacgaagcacgacgggaccacacacatgacatgaataagcgggaagaacgatggaggccaccaggggcgcgacgggaagggcacaaaagcacagaaggaaagggggaagaaagaaggagacagagacaaaggagagaaaaa

SEQ ID NO: 603431 - DNA, 100 bp, Homo sapiens
tcagcctggtacagcaagacattgctcaaaaagcaaaaaaccaatcctctcaaaaggcaaattttaagaatttcctaaacccttcctttttttgcctggt

SEQ ID NO: 603432 - DNA, 336 bp, Homo sapiens
  misc_feature (112)..(112): n is a, c, g, or t
  misc_feature (135)..(135): n is a, c, g, or t
  misc_feature (158)..(158): n is a, c, g, or t
  misc_feature (201)..(201): n is a, c, g, or t
  misc_feature (247)..(248): n is a, c, g, or t
cgatccccagccttctaggacacttaactgcagggcactccctgccagtttggctttggggtctatgggaccacctgctagtggcttccagcagccaagagaatatccctgntccgacctttttcgtgccctgcngttttctagggcgctttttttcntcgccacggaaggtccgtgccactctcgcaggccgctcccgcncaagtggctccggccggcggcgggtctctttcttcctctgggccannctcccgcctccgcgctctgtgtgactgggagctagcgggccggctcttgcggcggctctctttctccccggcgtccgctcatgcccat

SEQ ID NO: 603433 - DNA, 326 bp, Homo sapiens
cgtgctactctgctctgggttcaagccattctcctgctcatgctcctgagtagctgggattataggcacgcgccaccatacctggctaatttctgtatttttagtgaagacagggtttcaccatgttggccaggccggtcttgaaatcctgacctgaagagagctgcccgcctcggcttcccaaagtgctgagattacaggcgtgagccaccgcacccggctcagacatatgttccttaacgtacactctcagaacagccgttgagacactttttccacaatgtacgctccttgagcacccaagctctccaacgggttctctgcat

SEQ ID NO: 603434 - DNA, 1404 bp, Homo sapiens
  misc_feature (530)..(530): n is a, c, g, or t
  misc_feature (944)..(944): n is a, c, g, or t
gacaggaacatcgataagtagtgtaaaaacttgtcacaatcgaacatcctgaaatgccacagaagggatggacgaggaggaaagtctacatgactagctttcaaagaatccagagtggaatgacatcagggttctgtaccagtcctcttgtctgtctgggagaaggcacagagtgtcagagtcacacagctcagaacagcttaacatgtatgatatccgaaagctctaagagatactcgacgactgctggcatcctagaagagcacgtgggccacgggatcttatccaggtagagtcttcacgtagcgaggcagttcgcacgaagtcagacgttccagtcgtaccgtatcttacaagatcttgcctggtgcctcttcatacccctgcacaaatggtgttgatacaattgccatggtgacgaattagctgtcggttcttccaggcaggtcgactctaagcgacaaatgggccagactgactcacctgatggcagtcacatgggctggggaagttgtcactcccctctaaangaagcttcaggttgcgaaggcacgaaaaggctacgttacatgtcttcgtctgactcgcttaacaatcgagcgatcgagggggaggcacgtccgttcgacgcccttgaggaaggaaacctatctttggtttcggcaaaaggggctaccccaatcgagaagaggtaaggacaaggaattggatcttccttcgtggtaccgcctaaccccaaagtccccccaaagtccaaagtcctcaacagccaggtgaatctcttctgactttgccaatcagtctttcccaaggcctaaaaaccacggggctaaagccattgcagcatgcaataggcacacacggaatggccagtgtacagaagaatgggcctttgatactttggggacagcttggtactgaaccctatatgcaggggcccatgnacatgaaagttggtcacaccttccgccgattgggggtccaagaaaagcggaaaagcaatacccaacaactttgaacgggacataacgttcgttcagagtgcggctgacaacaggaccgagagaaaacgttactgcgacatggggcgacatcccccaccggaaatcaccgtaggtccataggacgacaaaaaggcgacccgaaggcacctaaccgggggcgaattgcaataggttggacaccgagtaggaggggacgcctggtacaacgagggggaaccactgagagcagaacaaatgtaacagttggatgactaattggccacacaggaacaacatagagctcaaacattgcgcagaaaatgcgagtgggacagccacctgtaatacaccacgagaaaagacaataaacgcagagcgacacacacaacaacaagaagaaagcgcggggcacacaaacagg

SEQ ID NO: 603435 - DNA, 292 bp, Homo sapiens
atccccgtcgggtacctgtactaatgcctattatccctgcctttctggttaggctgatgcatgttgatcacttaggtcatggagttcgagaccagcctggccaacatggtgaaaccctgtctctactaaaaacagaacaagtcgccgggcattgtagcatgcgccggtcatccctgctactcaggaagttaatggcacaacaagtgcttcaacccccgaggcagaggttgcatttagccgagattgtgccatttgcactccactctgggcaacaagagcgaaatgctctctc

SEQ ID NO: 603436 - DNA, 751 bp, Homo sapiens
  misc_feature (197)..(197): n is a, c, g, or t
  misc_feature (255)..(255): n is a, c, g, or t
  misc_feature (666)..(666): n is a, c, g, or t
tttacagtatttgagatgtgtgaaatttcaaaacaaatcactttaaattttttatagtattgatttcatatgtataatgaaaatgccttaaaacttgtacattaggagatcttagtacaatttacaactggttaatttaaccatgtatggtgtaatattatggttaccccattccaatatgtcaatgggaggacttnaatgagatatattcttttttatgtcataatcctctaaacaggtaaatacaaacctggnctatactcagatagaaatccggaaaatctcatattttatggatatttcccaataagtggacctcattaacatatatcttacttattaactcgaatgtgagttgtataccacggttgctgtatgtgcaggcatagcgtcctactaggctctttggaaacacgcagtttaaacttggaaggtttacaacaaatatctccacataccgctatagtcacaccactgtgtaagcggcgatcatatcatagtccggcgtatcacgaaagccgggaatcattccacttgtggtcacgttctcaaactacggtgtgcaatcaaactctctcgaatatacttcaccgccaaacactacccacatacgacacaccccaccaacacaacaccatcacaccaccccacaaacccccgcggggnggcccggagcccatttcccccaaataaggccgcacacacacaccaaggcgcgcgggaaccgcctgcccgggcccgcgggtacccc

SEQ ID NO: 603437 - DNA, 346 bp, Homo sapiens
catcgtagctagtgtctcgtagctgccatccagtgtctgggactagcgggcgcccgtccaccacgcccggctaattttctgtacttttgagtagagacggggtttcaccttgtaagccaggatggtctcgatctcctgacctcgtgatccgcccgcctcggcctcccaaagtgctgggattacaggcgtgagccaccgcgcccggccaaatgggagtataagtttaagacctgacaaaagaactaaaaatggtcattgatttgtcatgctgcagaggattcaaattgaagacaccagcacttacatataattggcttataaaagcaagcagttaattaaaacaaag

SEQ ID NO: 603438 - DNA, 294 bp, Homo sapiens
ggtttattttggacacaccctgaagcttttgttttgaattaagaaatgagttccaggaattgacaaaccatttgttaaccagctgtcctggctattgaagagattcatttccgcgcatccacttgttgcagtcaagtctctagtgcacgcatacaaatataagatttctatgcacgtgatacattcatggagtcctaagcaagatagtaattcatataaggggtaaatgattcttactactatagtagtcagtatacttgcatcataatgagctctactgcaatcatgtcctaa

SEQ ID NO: 603439 - DNA, 157 bp, Homo sapiens
cagtatatggagatcactgccctggcacccagcacaatgaagatcaagatctttgcgtcctcctcgagcgcaagttctccgttgtggtatcggcggctccttcctgtgcctctgctgtccacgcttccagccacgatgtggtatctatgcaacgcac

SEQ ID NO: 603440 - DNA, 178 bp, Homo sapiens
cccaaaccactccaccttactaccagaaaaccttaaccaaaccatttacccaattaaagtataggcgttagaaattgaaacctggcgaattagatatagaaccgcagggaaagatgaaaattattaaccagcttatttagcacggactaaccctattacctcttgcatattgattaac

SEQ ID NO: 603441 - DNA, 751 bp, Homo sapiens
  misc_feature (5)..(5): n is a, c, g, or t
  misc_feature (11)..(12): n is a, c, g, or t
  misc_feature (22)..(22): n is a, c, g, or t
  misc_feature (24)..(25): n is a, c, g, or t
  misc_feature (32)..(32): n is a, c, g, or t
  misc_feature (34)..(34): n is a, c, g, or t
  misc_feature (260)..(260): n is a, c, g, or t
  misc_feature (262)..(262): n is a, c, g, or t
  misc_feature (272)..(272): n is a, c, g, or t
  misc_feature (308)..(308): n is a, c, g, or t
  misc_feature (345)..(345): n is a, c, g, or t
  misc_feature (347)..(347): n is a, c, g, or t
  misc_feature (368)..(370): n is a, c, g, or t
ggcgnagctcnngcctcggagncnnagctgcngncctgtattgagctgagatggctcgagcctaacattccatgatccaggatcgtgacagatgtgcacaggctgcgtgctgttgctgctgtgggtaatttggaaccacgaggcaccccaggaccagaagacgaggcattctgtctgcctggatgtgtgggaactctctgccaacttgattggtggatctggggggggatccacccccaccccacgaggaaagcacagtntnatttctgtgngtggaggcttcaggtgccagccagctgaaggatggncacccctgtggtcaccaatgacagcctggaagttgcnangagatcgtcgacgcatgccannnacgtgtcctcacctgtgtgctgtgcaaagcctccgggcggctgctggtttacatggcggggatgactgccgcgtcaagctgtggtccatcagcaaagccctaactgcatcatgagcctgacggggcacacatcccctaggttggagagcgtcttcgcctcaacactcccgcgaggagctcaatcgtggccgtgcatcctcagtcggcgctcccatccgtagctcgtgggagctgtcaagcatgccaagaaattcttcgcacactctatggggacactgaaggcaacaatcgtgcagactgggatttccaccccgtacggccgaagttcgtagtctctggcttcccgggagacaaaatcaaagctctggggacatcaggagg

SEQ ID NO: 603442 - DNA, 1331 bp, Homo sapiens
ggtggtaatctagttacatggatgactaaacatggagacctcatcgtctgagaggatggacgtcaggaatcgtattctcccagcatagttggcatgctgctggcctgctgtctagtcccgggttcatacacgggtcaatcaggtctgagatggtgttaagcgcaacggaacgtgtttcacagaatgactggcgactacatgagcatccgtcatgttaatacaaagagagctgcgagctgatcttgtgaacagagtgtccaaaacggagatcgttgagagacactggtcacgtacatacggtagcctctgtctccctgctacctcccatgatcgggacacctgtgtagactgactctacccgagggagttagtcgtgcttctcattcatttcaggaccaggtcaacggtggtagctgtccagtgaagagagacggcgctgtgtagttgacgacaaggaggtgatagagcaatggatactggcagtgctatgtaatagtccgtagatgaaccataagctcacccgtaagggacacatgccactaggggctcagtaccactagccaaatcaatggtatgtatgtgatccgaaactttgtcagagtttgagtcactacggcgtcgaagatgggagtgaatcaacaaacgaattcgggatgggaacccacactttgggggcaccatgtaacttggtacggtgctgggagaggcatcccaccgttatttaagccttccacattctagacttggcgtggttaaaacagtgtgcaagcaaaaaaggcgattataccaacagggtaaaggacatcaattgggaggaatttgaactaggttggagatcatcgcttatttttgttaggaacactgtcacgaatccattcccagatcacagaggcaatgaggagtatttaaccagaacggctcgtcacaatacgatgggcgatttctccgttgacccatttccgttaccatggggttggggcgctcccagggaaaacattgagtacggggggaccgcaccacaggttgccaacgtcaggacttttggatcccgttgcatgggcagtaagacactcctagacggctatttggatgatgcgcaggtgacagttcgaccacgggacgagatgctggaacactctgacatacgtaggggtcccacagaccatatgtccttaggctcttagtatccgcacgtggggggacataggagcacgagggaccaggtacaacgtgcgcagcaacatcataggcaccttcgttcaggggtggacacgacgcactgtataataagacgccactgtggctctaacgaggagaccgccctgtgggct

SEQ ID NO: 603443 - DNA, 471 bp, Homo sapiens
agacccagcaagagtccaagtttcagtttgagtccaaaggcagaaaaaagctaatgttctagtttggaaacagtcaagcatgaagaattgtcttttacttgggggagggccaccctttctgttcagctttcactcgattggataaagcccacccacattaggaaggccaaagctttattcagtcttccaatttaaatggtaatcttatcccaaaacaccctcacagacacactccgaataatgttctacctactgtctgggcatcctgtggcctagtcaatttgtgaaataaaattaaccatcacgctgactataaaacctcttgactataataatggatgcttgaaaagaaatcttcaaaggagtatcttcaaagtgctaaataataatatctgtgagcgaagttttgtaatctacaaaaatgtcctttaaaatgtagataaaataaagttccttatgttaaaacttaaa

SEQ ID NO: 603444 - DNA, 748 bp, Homo sapiens
cagttaggagctttaaagcctttaggtcttcggaaggtgggaaggagtgctatactgccctgtcgtggcccatggtccgggggtgtacacggccgaggcctggcaacgtatcgacagtatctcggattccttttggtttagtgttaatgttttgatactttggtgtttgcacttcatgctctgaatactgaataagccatgaatgactgaatagtttagtgccagatttgttacagaggatacatctattggtatcattatttggggttttgaaaaagtgggttgtgttggtacaccttctaagtgtcgtttagtttctgcaaagcagataagttcttctgtgtgaaaatgttttcgtttttgtgtaatttaaggtattaaaagttccttgttccaaatcatgttgattttgctctttgctttttcgttgtctgagaaattgttggcgtagatttggcttctggtatgtgtcttctgatatgcttcgctgttgagcatcaaacgtgagacgctgccatctgagcagacccatgccatggcggtagacatgttatcacggactgtggcatcgcacagcgcggcctgctctgcaaaccaacgggctgggggcaaaggggcatgagtccagggtccaccagggtgggctcagctccagggagaggccacccacgtggcagcccacacctcttgagagcccccagtgcaggagcagaaagatcctgaccagagttaatcctgggggtagtaa

SEQ ID NO: 603445 - DNA, 424 bp, Homo sapiens
  misc_feature (11)..(12): n is a, c, g, or t
tgctcagtttnncgggacgtaggccggcctgggcactgggaggagtaaaaatctcgggataccggatctaaggagcccagaggcaggacgatttcattctccgggtcagtggacaggaggggctggaagcctggtgccagcatggtctcgggaacggtggtaatctagaatacacaaactttactaagaggttaaagaagcaaggaccaaacattggtaacaagacagtggtcaaaggtcctagaagaggtgaaaaacaggtgagactggggaaggcactttggagggtggaccagatatagtggggggcagggccctggttatatctatgtaactaggtagctggctcatagatcttttgaatgttaacctcaaccggtccagagttaatatatgtgcgtcccgaaactgagcagggtaccga

SEQ ID NO: 603446 - DNA, 160 bp, Homo sapiens
ggttgtaagagtaaatgtttcaccttaagataaccatgggcaatatattaaactctagtctgttttcttgcctttaagtaaggctgcactgattatatttgatctttgtcgtaatacatgggacgccagctaagttggtgaaaacgcgggatccaaagac

SEQ ID NO: 603447 - DNA, 752 bp, Homo sapiens
gcttcgatgccaagaacatgatggctgcgtgtgacccccggcatggccgatacctcaccgtggctgctgtcttccgtggtcggatgtccatgaatggaggtcagatgagtcaagatgtcttaacgtgcagaacaagaacagcagctactttgtgcgacatggatcccctaacaatgtcacgacagccgtctgtgacatcccgaccgtcgtggcctcaagatggcagtcacctttcattggcaatagcacagccatccaggagctcttcaagccgcatctcgagagcagtgttcactgtccattgtttccgccgagaaggccttccgtccatctggtacacaggcgagggcatggactgagatggagtttcaccgaggctgtagagctaacatgaacgacctcgttctctgagtatcagcagtaccaggatgccagcgcacgaacgaggaggaggatttcgcgtgagcgaggccgaagcagcgaggcctacaggccagagacccccatacacctcaggcttctcaggttcccttagcgcgtctttactcaaggatggcccatttccatcttcccgtcagaaatacgatcttggcgtgaccatctatcttgatcactggtttaatacttcctgggaggagggtctatgacacacgttgcctggtcgacatatgtcaggcgctcgattaaataactggctaggatcgaacacacaccctacaacctcgctccgaaaacacaccaggacgagacaa

SEQ ID NO: 603448 - DNA, 217 bp, Homo sapiens
tcgtctttactatgctggccgcaatcatcctaggtcctcatcgccctcccatccctacgcgtcttcagatcagagacgaggtcaacgactccctacgcttagcatcgaaatcaatgtggccaccaagtggtactgaagcctactagtacaccgacgtacggcggactaatcttcaactcctacatacttcccccagttattcctagaaccaggcgag

SEQ ID NO: 603449 - DNA, 241 bp, Homo sapiens
ttggtccgtatcccctttgtgttatagatatgtctttgtgtgaaaggattgttttggattttcggaaagataagacctatgttcgatatcttgtgctgtcagatgcacgccatgttattgttcatttgcattttcgagagccaccaccttcctctggtttttgtatagtttattgttgggtcggatagataatgggggaaacgtgtaatgtttaatgctggattggaaacgactttttggg

SEQ ID NO: 603450 - DNA, 961 bp, Homo sapiens
gtgatttatttaagcctgcaagacgcagggcttagagaggagggtggctgatcaagtccttagaacatttactaggaagtcacacttaggccaatgtgagcacagaatatattttcttcatgaaacgctcgttagtcacagctacaacaatagttactatgtattgagtgctgctctatggcaaatgcttacattcattatctcactgcatccttaccacaatctagggagatcgtgttattttctcagttttgtaatcgataaaggtgaagttcaaaaatgttaaatggctttccccaaatcaaagatctactgagtgtcagaactgggataggtggcatgttcaatcgctattcaataattcaatcattatttctgaaggaagaataagcaacagaaaggccaggtctgtacgactttaagccttagctgttaatcattcatttgattttttatatactgcaagtactctgaagaagtgacggccaacacgtttcctccaaagaaatctgggtaaaggcatgctaagttccaaactcatcgtatttcaaatagtttacgtctacctcttgcaattacagaaaataaccaaattcaggcacggagacaaaagttactgagattttataactgtctctggattgcactaaagggtgtcctaatttacccaaaggtgggttttcattggcatcattcctcttggaagataatccaatatgatatttctgtattaatttatgccatgggggctttaagtggtcatgggcaactagagattacacttatttatttctttattattgggctaaatctctctaaaatttctccttcctgaagtaaaaagaggcccctttgggaccgccctgaccccatctgggggggccttttggggggggctgggcctccaaaaacgggtgtgtgcctcaaggcccagaaaaggggggaaagggccacatcggac

SEQ ID NO: 603451 - DNA, 259 bp, Homo sapiens
cttgcaggtgagtaaagtgacataaacataaacatattcattgaagcatttatttcttaaataaattacagtacataccaatagtggcatattttgcagctgagaaagataatgaaatagctctttaagcttggcaccgtggctcacacctgtaatcccaacactttggaaggaaggctgaggcaggaggattggaggatcccttgaggccaggagttccagactagcctgagcaacatagtaggatcctgtctttgca

SEQ ID NO: 603452 - DNA, 584 bp, Homo sapiens
caactcaaagaacacgatcgtagaggccccaaatattgccgatcggttcgactctctacgaacgaattatcaccctaagttgtgataaataagcatttgcgacatccaccgatagattgtttttggcacaaccgcattcggtcattgatggatgtgtgtaagttgtagggaagggtaagtgttagcatatagagatctggccatgcttcatattgcattgttactcagcacctcaaccatggccgtccttaactgggaaacaagcgaaacaaggtgcggcagacatcgaggaaagaaaggaaatcgaaatcaggattatgcaagtaaaaattagaagacatgctcaaaactaccaaactaattgccattccaactaaaataggcatgcgaagcaaactaaatctttgggaggctagtagatcaaggtgggggagagtggaggcagaaccaaattccttctaaccaaaagaacttcaagatcagaggatcaactagtatgataaactttcaaggaaaagggatcatgtgagaaaagaaatgcatgccaacatataagaaggtgctcattcaggaatccagagtac

SEQ ID NO: 603453 - DNA, 256 bp, Homo sapiens
  misc_feature (13)..(13): n is a, c, g, or t
  misc_feature (40)..(40): n is a, c, g, or t
  misc_feature (60)..(60): n is a, c, g, or t
  misc_feature (63)..(63): n is a, c, g, or t
  misc_feature (101)..(101): n is a, c, g, or t
  misc_feature (140)..(140): n is a, c, g, or t
  misc_feature (142)..(142): n is a, c, g, or t
  misc_feature (144)..(144): n is a, c, g, or t
  misc_feature (210)..(210): n is a, c, g, or t
  misc_feature (212)..(212): n is a, c, g, or t
  misc_feature (221)..(222): n is a, c, g, or t
  misc_feature (226)..(226): n is a, c, g, or t
cgaccctcccggnggcgcgcgctccgaaccccggcccggnccccgccccgcccccgcccnggngccgttccgggcccgcacccccgccaggcgcatgtctncacctccgcttgcagaggccctcggtcagcgactggatncncnccatcaaggtccagtggaagttcttcaagaggaaaggcgcccccgccccaggcttccgcgcccagngntcgccacgnncagngcccgttttaccaataaactgagcgacccc

SEQ ID NO: 603454 - DNA, 439 bp, Homo sapiens
gaggagccccccccctcgcctgtataaattttacacacccctggaaacatttccaagaccctgtgacggcgaggcaaatgttccttaaagaaggtgtgggctctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtggcagcctctttcgaaagctaagatgaccatgcgccctttcctctgtacatataccctacccggggagggg

SEQ ID NO: 603455 - DNA, 482 bp, Homo sapiens
tatgcctgggccaagtatagaaaatcattatatgtacgatggactggatctagccatgttgcccagtgctagtctcaaactacctgtgcttcaagcaatcctccatgcctcagtcttccacagcactagaattaggcatgagccactgtgcccagcccaatattgtattttaaataaatgcagtttttgattttctttcttggacatgatagttacttaggaagctttgctgatttaaaatttccaaattttctaccttctacttttataactgtatccacagtttcatggtatggtgtcgtcaaagaattcggccttactacttctcagaaatgtctattattcagtacttataaaagtttttttgggcctcccatgtattccatcatttggtggcttaaaagttggaaacctacttactctgcaatgtaaaggctccagtggacatttattagacaacctgattcatgatactaaatcct

SEQ ID NO: 603456 - DNA, 121 bp, Homo sapiens
tgccctgtcctgttggctatgtgttttgtcagtgtggttgagaatgagtgtgagtgctgtattataccatagcctgcctagttttaagagtacttgctgtgcaatgtactatatgacccat

SEQ ID NO: 603457 - DNA, 179 bp, Homo sapiens
caggatccccagtcagtgtaagccatcaaagaattgggtgaccacgtgacctacttgcgcaacgatgggagcgcccgatatctggcttggtcggaatatctctttgacaagcacacccctgtagacagtaattatgaaagctaagcctcgggctaatttccccattgccgtggtgtgac

SEQ ID NO: 603458 - DNA, 1003 bp, Homo sapiens
  misc_feature (806)..(806): n is a, c, g, or t
  misc_feature (809)..(809): n is a, c, g, or t
gagtcgatacactcatgcctgtcagctcgattcaccggcctgtcatccagtcctgtggatgtgctggtgctgacgtccgtttggctctctttccaaatggtgacaggtatgtagagcagctccaccatagggagctctgatgggtaggaatttgctctgccatccttgtccctgtgttctcctggtccgggactacagcaacgcacgaattggttatacctgcaaccagtcacgtacccaagtgagaactaggggtctcctaggaagggtatacttgcgatcgcgactaggggggccaaaatttcgctgcgcatcaggtataaggaagggaaaagcgacgctgaatcctaacactggaagagtacatccctgcggtgttgtaatatcacgatcccatgcccttatgtcgaggttatcgcatgtacaggagcattacgttggagagcctcatgccgtctgctaccttcggcacactggtcaaagtatctgctgagtcttcttgtgcctgcaaggatgctagaaatagtgctgagggtccatgggaaagaacatgacaatgaggcagtaggaggtgtgggaagaaggggaggacagactgctcctagtggatacttactgcactggtgagacgatcatggccccccatctcagggaaaagaaaggtatatggggaggaggggctgggcatgggtctcacagtagtaagactctacgatggtgggcgtagccgcctgagggcctgtgtgctgaatttgcacatggagacgtcgactgcatcccattcgagttgtatcccacgctggacngtngatgggtcgttgccccgttacgtggtccccttgggaactgcccaggtagggcactcaacacgcagaaccgtggcgggacctgggcggaagaatgtgaaccctcaaaacgcgcccgcaagggggagaagctcgccttgtctttcaccgggaggggccactagaacccccagcacggtcatacatgcgacaggtcc

SEQ ID NO: 603459 - DNA, 1006 bp, Homo sapiens
ctgctgcctggaggggctcgcggaagaggcctgagccgcagtgcgccgcctggagcggggacagtggcactgtttcccagagccacagcagctgcctcggggccgtgggacggacgaggtgcgctgtgaggactgtgcgcgccgggccgcgacctgcctgctgcttcgcctgctgcctgctgcgggctactgcctgcctgcctgtctgcccggtggccggggcgctgggcccgaggtcggatggccctggactgcgatgcctaggaggacctgcttacccagagtggacgagttcgtgggcatgctggacatgcttcgcggcgactcgtcccactgtcgtcagcgagggcgtgccgtgcattccacggcgaaggccgccgacgattgcggcgcatctacagcaggatcgaccggctggaggccttcgtgaggatggtgggggtgccgctgtggccaggatggcaggagcagtgtcaccaaggccgaggaccgagcttggggcacctttctcccaggggcgttcaagaagctcctgcacaacgatgaaacggtgcccatcggcatcttttagcaaaggtcattgcttcccttcagagggacacagcagagcctggctaccgaaagccccctgtaccatgtttcgggaccgaaagagactactttccccttgttttgcaggttgaacgggcgcctcaggcttcttgacgggagcctgaacacactggcggccacgaagtaactcccattcttggggttcgcttacctcccagctattgaagctgaactttgccaaaacttcctttccatttcctcgaccgacttctctttacctgctccgcaaccctgccttcccaccttctcccaccccttcaccacacccatacccacttcccacctaccaccacgcacaatgtcaatgcagactcactctcagtcactctcaacatacgcacactaccacactaccacactacaactgaccactacctatctccatcatgacaat

SEQ ID NO: 603460 - DNA, 919 bp, Homo sapiens
aacactgagctggtatatgctttgctgtagatcatggtgatccatgcattcattcagttcataagaatatccagtgatgtatgtactgtgtgactggtctgcatgtgaaagacaactaggctggagtgagctctataagacgttgtgtgagacatagatcatataggcgaattacggaggcttaggaatcgcagtcgagaatgagagttgaggataatgaggagaatgtatatataattagtgactgatgtcgatgggtgtgatgatgggggcagagtagtgcagaggacacatgagtgatgtgtaaacggaaggaagaaagaagttgattttgagtgcgtagtagtgtctccagtaccgtggtagaccaggaccgcgacgatgtatgtctcttgctaacgattggccatttgaaatcttacgttcacacatgcgtacatctgccatctctgccaatccacactagcataatgtggcaaagatgcgttgagagccatgctatgattgagctggttacccgtattgaatcaggtcagaagtagattcttctcaatcatcgccagaccagtgcatactatgataccaaggagtctcattccctagatgcatacattaaggcacgtacaggatgcacttttctcgaacacgctcagcgcatgttatcactcattggtccagttgatcggtagtattcggaagtcctggggggtctatggagaattcactcaatttagagcataggagcaaaacatgcatccaaggaaattgttgctgtcatgttgcgcaagggggcatatagccgtataatctccccgcatggtcagtatgcccctctctgtcatctgaactggtaatgtcaccgattatctacacacaataatgaggcgcaggttgaaagggcatggatatcaaatacaag

SEQ ID NO: 603461 - DNA, 188 bp, Homo sapiens
tagggagattgggtagggtggaagatgatagtacaacgaatcgagaatagtccagtagttagagttcctattccgaaggaagaattctctcatgtgtgcacaggaaaacatggaccaagatgttagttggtttgtttatttatttatgtatttatttttgagacagagtcttgctctgttgctcaggc

SEQ ID NO: 603462 - DNA, 81 bp, Homo sapiens
  misc_feature (39)..(39): n is a, c, g, or t
gacgacgtcgacgaggagcgcgaccacgcccggcacgangcccacgagcagccacacgcagtcgaggacgatcgcgaaaac

SEQ ID NO: 603463 - DNA, 784 bp, Homo sapiens
  misc_feature (11)..(11): n is a, c, g, or t
  misc_feature (28)..(28): n is a, c, g, or t
  misc_feature (30)..(30): n is a, c, g, or t
  misc_feature (43)..(43): n is a, c, g, or t
  misc_feature (48)..(48): n is a, c, g, or t
  misc_feature (60)..(60): n is a, c, g, or t
  misc_feature (69)..(69): n is a, c, g, or t
  misc_feature (79)..(79): n is a, c, g, or t
  misc_feature (82)..(82): n is a, c, g, or t
  misc_feature (103)..(103): n is a, c, g, or t
  misc_feature (121)..(121): n is a, c, g, or t
  misc_feature (123)..(123): n is a, c, g, or t
  misc_feature (155)..(156): n is a, c, g, or t
  misc_feature (158)..(158): n is a, c, g, or t
  misc_feature (161)..(161): n is a, c, g, or t
  misc_feature (181)..(181): n is a, c, g, or t
  misc_feature (203)..(203): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (226)..(226): n is a, c, g, or t
  misc_feature (230)..(230): n is a, c, g, or t
  misc_feature (236)..(236): n is a, c, g, or t
  misc_feature (279)..(279): n is a, c, g, or t
  misc_feature (304)..(304): n is a, c, g, or t
  misc_feature (316)..(316): n is a, c, g, or t
  misc_feature (319)..(319): n is a, c, g, or t
  misc_feature (364)..(364): n is a, c, g, or t
  misc_feature (369)..(369): n is a, c, g, or t
  misc_feature (373)..(373): n is a, c, g, or t
  misc_feature (388)..(388): n is a, c, g, or t
  misc_feature (411)..(411): n is a, c, g, or t
  misc_feature (525)..(525): n is a, c, g, or t
  misc_feature (530)..(530): n is a, c, g, or t
  misc_feature (545)..(545): n is a, c, g, or t
  misc_feature (555)..(555): n is a, c, g, or t
  misc_feature (621)..(621): n is a, c, g, or t
  misc_feature (626)..(626): n is a, c, g, or t
  misc_feature (666)..(666): n is a, c, g, or t
  misc_feature (694)..(694): n is a, c, g, or t
  misc_feature (700)..(700): n is a, c, g, or t
  misc_feature (716)..(716): n is a, c, g, or t
  misc_feature (721)..(722): n is a, c, g, or t
  misc_feature (758)..(758): n is a, c, g, or t
tcaagtattantatctttattatggtananagcagtattttanaaatnagctcattttanagtaaaaanatttatgcanaantgtagagaaactgctgcacanaaagctccaacttaaatnanaaaaaattttctttgtagaaaaaagtaaaaannanaanatttaccaagcaaacccaanaagttcatttaaaccaaaaagnagcnaaananattaaacatttanaaanacaggntgaattctgggatccaggagaaactttagtcctttattgaaanagccatgttttaagttatgtgaagngaaatttctatnaancttctctcttactcttaatttatgccagattatttttctttaggntaaanccanaatccacaacaaggntttagctgttcttttctaaaggncggggaccaaatccttttaatctgcttgaaaagggacccatgcctatccaaaaaatgaaatggttcagttattattaaagcatgcccagtatttgggcaaaaccagaatctaanaaatnacactgtcacctaanaccacatggnttgatgggaagccatgaggaacaagggtaaagtgataaaactggcaagtggatcaaggaataaaanccaanagaattctgagaccagagggcaagaaatatctagtcgggnttcaaggacagaactgaagttcaaatanaaaaanaatgttgcctcaaggnttagnngctgagctggctatcagagctcctagtacatggtgntcaaataaggggcagttagagataaa

SEQ ID NO: 603464 - DNA, 222 bp, Homo sapiens
tctggagacgggttcactttctttcacccaagggcaaggggtgtgacctcggctcagggcaacctccaccttgggggctcaagcaatcctcccacataagcatcctaagtagggggaccacaagctcaggccaccaggcccagtaaattttggtatttttgggtaaaagacaggggttttggccatttgggctcagggcaggtctccaattggggagagctc

SEQ ID NO: 603465 - DNA, 1153 bp, Homo sapiens
tgtgtgttgctgcctgtggatgtctctgggtgcgcgcaggccgtgagtgtgcgcttttgagagtcgcggcggaagtgagccctggccgccgcccgccggcatgagctacgaccgctgccatcacctgtcttctcgccctgacggccaccatcttccaatgtggatgtactgctgcatggatggcctgtcaagaagtggctcgacctgcggttggtgttcgaggaagagacattgttgttcttggtgtggagaagaagtcagtggccaaactgcaggatgaccgaacagttgctggaacgatcttgtgctttggatgacaacgtctgcatggcctcttgcagtgccctcacgcgccgcattcgcaaggcataggtcagtcaacatgtgtgcccaggtgttggatgttgccagatgccacctggctgactgtggacggaccctggtcactgtggagtacatcaccctgctacatcgccagtctgaagcagctgttatacgcagagcaattgggcgcaggccgatttggcatctcttgccctcatcgtgggtatcgactttgatggcactcctaggctctatcagactgaaccctcgggcacataccatgcctggattgccaatgacataggcctgggtgccaagtcagtgcagtgagttccttggaggaagaactatacttgacgaagcattgacacagattatctgaccatcaagcttgtgatccaggcactcctgaaggtggtcagtcaggttggcaaaacattgaattgctgtcttgggcgaaatcaatcccatcaaggatttcaatccttaaaaatttagcactatttctctctaacatttgcaacacactcatactaaaaccactagaactattacggttggaaaacagagtctacatctgcctgtgctactactatcatagacacgactttttttaaaactagaacttacagaccccaattagccgaactatcaaaacacgacttatagataacaacaaatagaatataaaatacaaattatcaacaagaataactaccatagcagtacacaactaacatcaactaatcctacttactacacaaatcatcaaaacaacataatacctaacatacacaccgactcctactctctctctaagtgaaaaatt

SEQ ID NO: 603466 - DNA, 260 bp, Homo sapiens
gttctccaagactgattccgcgactccatcgcttttcaggggtcaataaaaatctgccgtagattctatagtgacgatgatcatttcaggaaagagtttgcaggatcagccatgctcagctgtgacgcctgaataactgtctactttatcttcactgaaccactcactctgtgtaaaggccaacagatacatactgtggttatcatatcacaagatcatgtagggataaacttgccttttaccccaaaaaataaactctc

SEQ ID NO: 603467 - DNA, 1793 bp, Homo sapiens
  misc_feature (280)..(280): n is a, c, g, or t
  misc_feature (803)..(803): n is a, c, g, or t
  misc_feature (1268)..(1268): n is a, c, g, or t
ggccagtatgcacaacaagtgtgtggacagagtgtgtctcgctatcaacaccagaagggtggccaaagtagtccgccgcgctcgcacgatgtgccccagcggagctatagtggtgctggtggagcgccccgggatgttctcgcccaggacgcaatgcgtatttgtttgcagaggacccccacaccgtgttgaccctgtggtggagattggttgccgccagtggatgcggagttggcgccagaaatggagacccgccgatggtgctcccacgggcgggcgngcgcctttggggcgcctttgagaaaagcagtcccgttggtggagcagcttctcgcggcgggggttagaaaaccgtgttgttgtgccgccacatggagaagtagtggggtgtttgcggccacacagaggggcgccccgcgcaaaggggcgttttgttctttgacgaagagaggaaaaggcgggggaggagataagtttgtggggtgctcaagtgtggttgaggctgggaaagccccgcggagttgggtgccgccacctctctgatggggggcttgaaccgacaggggtgtttctacccgcagatatccaacgacctcaacaagagccgctttggttgtgtggtggtatcacacttcggctggaccccccgctgtggtaggtggtggagaccgccccctccaccggaggggccccgccgcgtgtccgcgtgtgtagcagacgggccgcgcccgccgtgggtgggcggccccagcagcccccgcgcgcctgtggtgtgcgccctcctcaacgtgctcctcaactgntcgccgacgttgtattggggggcctcgacgacgccacagacggcgccgtttgggtgtaagggaggagaccttctcggcaccttcttccttgggggggcgcgtcgtgtgatgaacaccgctggggggcacaccacctcgggtttatagagcttttgggggaaaccacaccaccccgcggcgagaaagaaagtggagggttgctcacgacgcgcgcgtgccacgcgctggtgatagacacacttgggcccgctgcgtggggtggtgtggcacgccgcccgtcgcgccgtcgttaataggttgtggggacgacacagcgccctgcacgcaggagcgccacgctggcgggcgtgtggcagcccacactaagaagagtgtgaggccccgccacacccgccgaagtccacaaagaggggtaaagataaagaggcagagtaaatagtactttgtgagacactgtgagagagnccccccgctggggtgagacccccagagattagtgccacagacgagagagggtgacgacacagccgagtttctcagtgttgctctactgtgtggtgggtgagactttctggtgtcgcacgatgtgtctctcttatagagaaagaatatgggagagagtgccctacagagagagagactctctccacacaccctgcggctcttgggcgtgtcacacagagaaccacacctcacgctcacaagaggtgttaagagcggctctctaaggcgcacactgggctggttggtttccacttgaaagccgcaacttctgggccctgggcccttaacttggctttcttctaggcttcttgtaggcgcttcttccacgctttgcacacctgttccccacccctcccaccttcaggctgttcctgcacgccacaacactccaccctccaccttcccttttccccccctcccgcagcacctcccagcctgttgctatagagcctacctgtaagtccaataaaccaccactgaacacca

SEQ ID NO: 603468 - DNA, 445 bp, Homo sapiens
gtgagggtctcctacctagaagctgctttagtactatgtgctgcactgccctgcgagcatcggcaccctaaggctcaaaagaatgaggtatctgttccgctctcttcaaagccaccagattctatcagtccacaaagctggactgggtgtaggttgggctccaggtttgccgcctagggttactacatgctcaatgcttctcattcaccgcatatatctcgactaccctcacgctagactacaagtttcaccttgagcctgtgaaaacgctcactacctagtgcacgaaagacatctcgctaaggcgaatgcttcccacctatgtcgggaagcttctgcgtatgactaagctggtgttgcctagtcgcgtgccgtatcggctgggcaatgtggataccttccagctgcgagatggatggcaggatatttgtgcccattttgggca

SEQ ID NO: 603469 - DNA, 534 bp, Homo sapiens
  misc_feature (37)..(37): n is a, c, g, or t
  misc_feature (47)..(47): n is a, c, g, or t
  misc_feature (99)..(99): n is a, c, g, or t
ggggatttggcccctcgggcccaggatttcggcacgnggacttttcncccataaaaaggattgagaccctgtcattgcaccattatagatggaactagngatcattaagtgaattaagcccaggcacagcaagacagaccatccacatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatagcacaaggttactacagtcaataataattgtgcattttaaaggtataattgaattgtaacacgaaaggataaatgcttgaggttatggataccccatttaccctgatgtgattattagacattgcatgcctatatcaaaatatatcatgtaccccatagatatatacacctagtatgtacccacaaaaattaaaaataaagtaaaatttcaatgattaggaaga

SEQ ID NO: 603470 - DNA, 187 bp, Homo sapiens
gactgactatcctagagctggtactaggacacaggtctgcagtgcggaatattgccgatgctgtcccgcaagtctgtttggtgccatcactgggccggcacgccgtacaagcctctagtcatgttgaccaccgaactgtcggcgcactatgctcgagagcattatgactcccctcctactggtcctg

SEQ ID NO: 603471 - DNA, 374 bp, Homo sapiens
tcatgctcagtgttcataggtagattctttgggggctttggtggcctaccctttgtgaggcactcatttttcctaaagtgttatatactatatgtttattttttttaattaagaatacatatttctttttctgtctatagtaaaaaacaaagtttttactgacacctgtaattctggtggtatagcacagagttccttccagcctccttcctttttatatttgaaactgcctattcaacattaagaaatctgctctggccacgcaccattgttcatgcctgtaatcctagcactttgggaggccaaggtggatggattgcttgagcccaggagttcgagaccatcctgggcaacatggtgaaaccttgtctcta

SEQ ID NO: 603472 - DNA, 878 bp, Homo sapiens
agcggggcttcgggccctgcacctgtgactctcggccgcgctcgccctcggcccgcccggcgccgcaggccccatggccccgtccaggctgcagctcggcctccgcgccgcctactccggcatcagctccgtggccggcttctccatcttcctcgtctggacggtggtctaccgagagccggggaccgcgggcatgggagggctcgcaggggtgctggcatctgtgggtcctggtgacgcacgtgatgtacatgcaagattatgaggaggacctggctcaaggggctgcgcggcttctgtctgtcgtgggcggtcctcttctcggcacgatctgccatcgcgtgcgctgtcgtgcaccattccctcgtgactggcgcagtcaccgcggacagtccgagagcctcaacagtaccccgacgcaggctactagcgctcgtccagacgatctcggagcttcagtgttccgttcgaagtggagccgttccgtgctcagccgtctatgcccaccggttaccgggctgacttggctgagatcagcatcctcagagagtttctgacccagggggtgagagtctctgcagccatgggggggccttaggacctggactcagcctctgagatgtcgggagaggctactcggcatcgccctggtgagcccgagaactgtggctgaaaatacagaggaggacgagtgtggtctcccaggaagctgtgctgggcgtccctttcgacggaaacctgagtgtggtagagcaggggatcctgcgatgttgctcctcgtcagcctgggcagagggcagcttgagaacttgttccattgactctgggtcttgtgcggctttaatggagctcttaaaatattcgagggagaagggcac

SEQ ID NO: 603473 - DNA, 301 bp, Homo sapiens
ggccggaagtcttctccctgcacttcgtgcaggaaaatattcttatttggaaaaagaaaactttttggataaatttttgaaactttgagcaagctatcaaaagttgtctgcctcctccttctccccagccccaaaatacacagacttaacaacagaaaaatataactgttatcctatgttaatttatgaaagcagataaatatggggtatataataagataatttcattatttaattcaatgaattgcttgttttagtgctctgtaagtatttgaacaagtaaactttttgagttaacaaa

SEQ ID NO: 603474 - DNA, 150 bp, Homo sapiens
  misc_feature (8)..(8): n is a, c, g, or t
tataggcnaagagagttgatcacttccagggtctctgacttctgtgacctggaaatcagcctggcttgggattgcatgttgttgcatctttaattatttgaattattctttgaataatcttctatttgcttgaatctgagccgacgagag

SEQ ID NO: 603475 - DNA, 348 bp, Homo sapiens
ccccttggtggagggttgccgctcatgcgccccgcgcgcggactcatggtacgcgggcacctggtgctgggtgcagtagctggcagccgctgttgacgtggttgaggactttctgcttgagctgcgccacctgctcgcgcagcaggctcgccgtggacgccagctccgtgttctgactcttgagggtcttcactttctcttccaggcgcgagatgcgctccagcttgcgcttgcggcacttggaggcggcgatgcggttgcgcagccgcttgcgctccgccttgatgcgctcctgcgtgtccatgtcgatgggcgacaacggcgggctctcgccgaagctcggcacgt

SEQ ID NO: 603476 - DNA, 113 bp, Homo sapiens
caaagagacacacggtgaggagatcgggttagtaatgcagtgtagcaaagaccagtgagcgagaacttttgcagtagagctgtattacgaattccggaatgggatttaaatca

SEQ ID NO: 603477 - DNA, 213 bp, Homo sapiens
cacacgccgattgggttgaccagtgatttaaagatgtgggtagagaagtcccgtcgtgcgcagtggtaacaaatccgactaggaaccatgaggttgcgggtcggccctgcccttctcagtgggttgacgatccggtgttgccgcgagctgtggtgcaggttgcagactcggcttggatcacgcgttgctgtggctatggctccgattagaccc

SEQ ID NO: 603478 - DNA, 122 bp, Homo sapiens
tggggtttttcccctttttcccctttttttttttccccccccttttttcccttttttccccgcccccccctgttttttgttttggtttttgggggcccccccttttttttttggggccccca

SEQ ID NO: 603479 - DNA, 113 bp, Homo sapiens
aattttcaatggcaagcacattttcaggtccagtttcttcaagctttttcaaagcaaagtccttattttgaggctgggtgcagggcccacgcctgtaatcccagcacttcagg

SEQ ID NO: 603480 - DNA, 439 bp, Homo sapiens
tcccccaaatggaactcctagttacaaagaactttaccaactcagaattgatataattttaacaactgtctatcaaattctggggcttcaagcatatacatgtttgactcttcaaaaaaagaaagagagagagagaataataactctcgagctgagtggccaggcacggtggcacatacctgtaatcccgacactttggaaggccgaggtaggcgtattgctttagctcagaactttgataccagccggtgctgcctgttcccaccctgtcgctactaaaatacaaaaaattagctgggcatggtggtgcacacctgtagtcccagctactcaagaggctgaggcacgagaattgcttgaaccaaggaggcagaggctgcaatgagctgagatcacaccactgcactccagcctgggcagcagagcaagactctgtctc

SEQ ID NO: 603481 - DNA, 799 bp, Homo sapiens
  misc_feature (29)..(29): n is a, c, g, or t
  misc_feature (775)..(776): n is a, c, g, or t
agaggattccgtcgttttcaactgcggtncaagctatcctcccccactacaaacgcatcctccaaactgctgatctggattccacccttgtccgccagctcccagaatctcttctccacatagccacccaaacaatactttagaattgtgtgtcagctcatggaactcccctgaataaaacctcctgatagattcctgtcatactctaattgagatctgaaagtgctagtggtccctgcccgctggaacacttgctggacaccagcctcttgactgtccctcaaatacaccaagcacctacaagctccagggccttctcacgaatgctccgtgtgacccggatgctccttctgactggagtgctccctcctagggtgctccctctgaccaggataatctcttcacactcattcttggcattttctctttcacatctttcaggtcttttctcaaaacccatcatcttacaggggtcttccctgactgcctgatctaaaataacagcccagtcacactttcatcccagtaccctgcttttctttttccctgcagagccagataacattaccttatgtatctttgtctattatctgtctcttccactggactataaagtcctgtgagggcaggagatttgtctttttgggtacactgatgtcatcccagagttcaggatagcacgaatcacacacccatcagatgagtgagtgaatgaataaatggatcagataatgaatgaaggaatggatcaactggctatcaccgcagttgaaanncgcgggatcactctagagtcgcc

SEQ ID NO: 603482 - DNA, 1003 bp, Homo sapiens
  misc_feature (979)..(979): n is a, c, g, or t
ctgccgatcaccgtttattctgttgtttcaaggccaaagcgcgctcggcatttgttaggagcgctcaagtctgttatcggaggaagtgaacggcaaggatttaggacacattccctgtgttcattggactgtcccggctgcttgtcccttttcctcttcttcttctttgcatagttatcccacagcggaccagtccggggtacgagttgcatcgtgaagtctgtcgtctccttcacgggcgcatctctgtagagatttgagcttagctcttctcgtggactagtgctatgccacccttcgcccaagagatactaggttgataggctcgcgactttcttctcagcagagcatctcatgctacacaccatcttgctactcattgtccttacatataccaacactgatatgcacttaaggaggttatctcttatgatgggagctctctctctgtttcttacttgccttgtttggagcacctgatggctcttgaaactatgagagtgagcccgacatacactcttgggagcgattacctgttgtgacttgttgggtgtgactattagccagggatgccgaactgcaccggggtgttgtaatgtattgacgctggagggaccttcatgcgggaggggaaccctggaccatgggaaccatttgactggtcacacccttgtggaggatacggcgagcctgaaatccttcccgctagtgaaccgggtaccactagggtcgaccttaggtgggagccctaacccctcctaaccggatgggggagagttaacctagacgtgccaagcgatccggcgggcacaccgggagtatattctgagaggttgcggaggaagggggattccctggttagtggccctcttccgcactggaagtgcggagatgtgtctcccgggaggaacggggaatacaccccccgacccatgcgtagaggggacgccatgacacggcgcgaacccaggccctttcnaacatctcaacaggacacgacacg

SEQ ID NO: 603483 - DNA, 106 bp, Homo sapiens
ccctgatgtatgaaaaatgaaagaaaaagaaaatgaaaagataataaaaaaaagaataaagaaaaatgaaataataaaaaaataataaataaaattaaaaagaaaa

SEQ ID NO: 603484 - DNA, 846 bp, Homo sapiens
  misc_feature (247)..(247): n is a, c, g, or t
  misc_feature (348)..(348): n is a, c, g, or t
  misc_feature (365)..(365): n is a, c, g, or t
  misc_feature (435)..(435): n is a, c, g, or t
  misc_feature (472)..(472): n is a, c, g, or t
  misc_feature (526)..(526): n is a, c, g, or t
  misc_feature (545)..(545): n is a, c, g, or t
  misc_feature (564)..(564): n is a, c, g, or t
aagttgcataagataatgctttacatttcacatacctatatttatctgagtgctgtctaaaactgtgtgctagccaaagtaatgctatgaaatcattgcagaattaacccgtgagttaatgttaaatgcactgttatgccatgtgaagaggcatcgactttgataccaccatcatgttcagaccattttatacatttcagtggccttttttttttttaagggaaaaaaaagcgcaaaaccaagtacntagtgacgatggcttttattgggacaaatagctttatattttcattaaaccatgcaaaaaatactacatctttcgggcacataacggtctccttaaccacngaacagttcagccattngaataaatggtacatggtaaagcttatagtagctgatggtatatggatggtatggtatactatattaaangtgaattgtaccccttcattttaaaaggtcatgtgtnctactgcctatttagattactggggtggggaagggtgttggtaagcaggatttnaagtcctctctctctcgangggttatgaagatataggntatgctcttactaccaagctcaggattctgattttaagggtacagataggttgcgggagttcattcgggtatacttgactggttgatggaggggctggaatttgggaatccagggcttatggggggtaaaatatccgataccggccttgggggctggcctgttttggtgccccacgttggtgctgtctatttggaggggggcggggaaaagaaagagtctcaaataagggggggggggagaccggtaaaaacgacggatttatggtgtgcaacgtctgaaac

SEQ ID NO: 603485 - DNA, 791 bp, Homo sapiens
ggtccctgtgccctggcctgggggaggggaacgcggaacatggggtcgggaacacagccgctcccctctgctctgcaccccactcgtgggggaacacagccgctcccctctgctctgcaccccactcgtgggggaacacagccgctcccctctgctctgcaccccactcgtgggggaacacagccgctcccctctgctctgcaccccactcgtgggggaacacagccgctcccctctgctctgcaccccactcgtggggggaccacggttgcagcccaccgcggacccccctggtgctccaggttgggtgagtctgagccggaaggggtacgtggtgggcgcccctcattgtggctggggagacctcataccccatcgcccacccccgtcctcctggtcatttcctcccagacactgttttgccccagcgcccttcggaatcacagtcccgccgtgtcttagaaactgctttggccgatgcaaacagccccctacccgtccccctcgctcacacggtccctctccgaggccgaagaagaccttctgttcctgtaaatacagccagcaagtgcaaacctgtgattttattttccacgtattcctgaggacggactgaccgtctatgtttttcagcccttcatagggggtcttcatcgggagggggtggggtggacttaagagtaaagctgcacttggaataagctcgtggtcgctgtcagagcccctctctcaatctgtgacctgataatgtttctagaaaaagaaccaggccaaacggaggaaccactaca

SEQ ID NO: 603486 - DNA, 148 bp, Homo sapiens
acatccttcatttcttcttcctcatcagaaccgaacatcttcaagttacaggttagtcttccgactcttgctctctcttatatgctattccctatctttctttgtcttcctttctcttcagcctacatcatcgattactatctttatc

SEQ ID NO: 603487 - DNA, 707 bp, Homo sapiens
gtggggatctggctactgtggtgcctgcatgaagacaggggcttggtcgggtgcctgtgacgtacaagtaccacttccgctgttcacggtaaagtccgccgatcagaagactgaaggagttgaagagaccagtagacgactcctgctactgctttgagagcatcactgggcctatagataaagtggggttaatgaaaagaaaataaagaaatatataataaaaaaaaaaggagaatgggcggcgccgcgactggagacctatggagaaacgagcctttgagaacaccaaatccggatgaggagcgacgcagggggcgcccacagtaggggcacagggcaacagggggccaaaaagcggggacccgagaggagaacccgggggcacaatgaacaatagggggcgaagggggaatcgtctgcacagccaatatataacagacacgcgccaggggggaggcaacccgcggaagcggtctcacagtgacacaaaaatctccaaaatgagggggatactgagggggagccacgcaaggggggggagctccaagcacaacagagggggggtgctcccaagggaggagacgctcgcagagtatctcaaaatgttagccgccccgaaacaggggggaagtcccataacaaagaaaaagcagaaagcacagaagaaggcagaagagacccaaactgctcgaccgggcaggggtgcg

SEQ ID NO: 603488 - DNA, 295 bp, Homo sapiens
taccccagaggagattgccattgcatctgtcactgcccctgcgtcgcactgtgcccccagctgtcccaggagtgaccttctgtctgggggtaagagcgagaagaggatcgctcaacctaaatgccatcaaccgctgcccccttccccgaccctgggcggttaccttcttcctatgggcggtgcctgcaagactttgaactaatgcctggggagggaacggggaaatgctggggctgcaataggagttataagcgggctgaggtgaattggttcaagcaacggcaagattaaggca

SEQ ID NO: 603489 - DNA, 115 bp, Homo sapiens
acgacgggttacattcactactgacacaaactacgatagcgccttatgaaacttagcggtcgaaggtggatttagcagtaaactgagagtagagtgcttagttgaacagggccct

SEQ ID NO: 603490 - DNA, 117 bp, Homo sapiens
ctgtgctcggaaacaggttgaaagtggcagtgaggctggccttgtagtggctgagacactgcgggcatgtgttgatgctgatagggagtatgctaggaggaccctcgcggtacctga

SEQ ID NO: 603491 - DNA, 428 bp, Homo sapiens
  misc_feature (270)..(270): n is a, c, g, or t
  misc_feature (272)..(272): n is a, c, g, or t
  misc_feature (274)..(274): n is a, c, g, or t
taagaaggaggtttgcagaccatggcaaagactggagctagagattcgctggccttgaagaagcaagctgtcatgttgcgaactgcctatggagaaaactaaatggcagggaactgcagacggcttctagaacttgagcgcagcctgcagctgacaaccagtaagaagccagggccctcagtcacacaaccacaaggaaatgaattctgccaacaacctgagaggtggcctccagatgagagacccccccaaaaaaaaggggggggggtncncncccccccccccccctttttggggaaggaaagccgttttgagaagagccctgtgatagcagttttgtgagaccctgagcaaagaaaacagataaactgtgcgtagactcctggtctacagaaactgtgagataataaatgtgtcttaagataaaa

SEQ ID NO: 603492 - DNA, 188 bp, Homo sapiens
cgagtggcctggctgtaattcactcgccacatgccagctcatttttgtatttttagtggagatggggtttcaccatgttggccaggatggcctccatctcttgaccttgcgatccgcccgactcggcctcccaaaatgctgggattacaggcgtgagccatcaagtctggcgagtgaaattacggcca

SEQ ID NO: 603493 - DNA, 1064 bp, Homo sapiens
aagagatgcttagataccctatcatagaagagcttatgaagatgctcatgatggatctgtcatgatcaatctactgtataatctgtttcccaaatcgtggatgcattttgattagcagacgtaagatatcgatgaaatagtaccatctcgagaggctcgaggcgattgacaccgattgaactattgtgcccggcgtcatcctatgggctcatcaccctcccgtggctacgcatcctatagaataagaagacgaagtgcgtagcgagttgctcacgtagcgatgtgaattcttggggactaccaatggtaggtgaacttgagtgattgactatgcagagtttgtgcggactaaatcttgcgaaatcgatacatgtcgttcccgcgattatgaccttaaaatgcatgccgaacgtgacgactccgtgacgtacgacaaatcgactcagtatctcccgcattagaggtccctgcataacgctatacataatgtacatacatcaagagttattgaaggcgataagatgtctgaaaaataaagcttaatatactggtgtcaattccggtcagtctgaataactcatgttcatcgtgtggtaccgggagtgtagtaaggtcagagatctgatgttctgggtatcatacgagatgattagctgcccgatcgtggtagagtgtaatctaccctaaagaatctttgtaaataggtgaccgatatattaagcctgatatgcatagaagaaaataaggcaccgtggtaggattcatagatgtcatgaggagagtattagctggaaggaaggacaaaaaaagctaaaggaagcgcaatatggagtgggtagagagatggaagttagggaacagcgtatgaggtaatgatcgtaaaaggacagtccaagacattggggtgtattagagaacaaaaggggggggagcgggtcatacaggtgcgtcgtgataaaacaaaaaggagagagcgcgtgtgagcaaggatggctcaaacaaaaaggaagtggagtagaggaaggcggaggatattgtgtggagagataggaacctcgagtgga

SEQ ID NO: 603494 - DNA, 215 bp, Homo sapiens
gtggagaggtgattggtgtctctggaagcccaccagcgttccagccgcgagcccttcaaggcctccagcacaaagggtgcgcatggtgatgtctcgaggtggggagctagtaatggtgcccagtgttgaagcaattccctggatggacctttgcgttgtgcttgtggctgacaggctcctgagtgctatgacgtgtggacggccctgcaccgtga

SEQ ID NO: 603495 - DNA, 463 bp, Homo sapiens
  misc_feature (379)..(379): n is a, c, g, or t
  misc_feature (433)..(433): n is a, c, g, or t
taaaatcaaaattaactatcatgtcatgaaaagatatggaggaatcagcacattgctaagtgaaataacccaatctgaaaaggctccaaactgtatgatttcaactatgtgacattctggaaaaggcaaaactgtggggagagtaaaaagattggtagtttgctcaggactggggagggaggagaaaggagggctgaacaggattacgggagattttcagggcagtgaaactgatctgtatgatagtattaatataattgtggatacattcattatatatttgtctaaacccatagaatgcacaacaccaagagtgacatctaatgtactttggggtaacaatgacgtgtccaatgttgggcttatgggttgcgacaantgcaccacttctgggaaggtgtttttatttgacatgccctgtttgccccgggcnggttgggtccgagtctacggggagaagggt

SEQ ID NO: 603496 - DNA, 125 bp, Homo sapiens
  misc_feature (24)..(24): n is a, c, g, or t
  misc_feature (89)..(89): n is a, c, g, or t
agggggcccccttattcttgttgnagtgggggggccattctgttggggactttccccaaccctgggtccattattaacttctggccagncttgtttaaggaaattgttgccgccccttggggggg

SEQ ID NO: 603497 - DNA, 163 bp, Homo sapiens
tgaacatccagtgtccgcaggggggtcggcagtagtaacctgcaggcgggctgaagttcactacagtggtacgtgggggcacaatttgcgctgacgagtggcaaaattctgatgccattgtcttctgccgcatgctgggttactccatatgtgaagggccctg

SEQ ID NO: 603498 - DNA, 188 bp, Homo sapiens
tactatggaggtacttcacttcctcacaacaaacccaattaggtagagcaacatataactgtcccaattttactggacacaggttcgcagaggattcctcactggcccagggcatcaatctggagggcataacggaaagcgtatggcagtagcccagtccacgtattccatctgaacccggtaccacc

SEQ ID NO: 603499 - DNA, 215 bp, Homo sapiens
  misc_feature (194)..(195): n is a, c, g, or t
  misc_feature (198)..(198): n is a, c, g, or t
attcgagccggaccggaaggtagctgttactgtagtcaattataagatgatatatacattattttacacacatataaaacaacttttcattaacagattaaatggatgatataaactgataaaaaaagattttaaaaaaaactgaaattaagtatctttgtacccttcaatacataattaagtgcagtacaacnnccntccggtccgagcatcga

SEQ ID NO: 603500 - DNA, 515 bp, Homo sapiens
  misc_feature (181)..(181): n is a, c, g, or t
agtcatttaaattatcttgcatccaagtttcgctgtgtaatagtatatgtatcaaatctactgattagttttatcttgtgcctcaggtttaagcaagaaaagaggccaaaaaatgtcttcgtttctttattctgccttatttatactattttattttttctttcttcttcttttaaaaaanatttgttaggtggttgattctccaggccttttatctttctgtctcaagggggcaaaatttcttttctcccattttgccttttttaattgatcagtttgttcattttcagaacctaaacttctaactttatgataatatttgtcaccttttaatcactaaacattaaacttacaggtttttgctggtctcctttgtagatacactggtttcttgtttagaatttgtttaattctatagcaggcagtacttctaggaattcatctttcagatctatttggccttacacacagaaatttgcatacaaagatttttttccaccatattgtttgaaatt

SEQ ID NO: 603501 - DNA, 885 bp, Homo sapiens
gcctctcaagcttggcgttcgtctggtggggttacacgcgggttcaacatgcgtatcgaaggagtgttattcctgttcggtggcccatctatcctggacacggcatgatgttcgtccgcaatcgattgcaacggtcgtctgcaagattctctgcataactctagaatgtcatacacaaatctttaaagaagaagcgcaatcctcgcaaagttaggtggaccatagcatttccggaaagcatgctggatgataggagcgttaccagtcgcgcataacttgcagtatctggaatttgacaggaacgtataagatgaacctaatcaaagtaccagcgagagctatggactaaaactattgatgcgatgaagcagcagtcgaacgaaattcaaacatgaagcgccaagcctaacatttactaagtgacacaggacttcgaacgaaaacctcacactgagctacccgacaagttcacggactatctacagaagtcaacgcaaatacagtccatcttatccgagcccctcttgcaggcaacacgggaaacagttggaagatgaacatggtacagcagttacgaagaggatgtggacatggaagatgctccttaaataatctctagtaagcatggtctttggatgtacctttgaaaatgccctttggatacttggaactgctaaattatttcatatttcacataacggtccttaactgccaagcgattacagagacattctttacctgcgcttgccatctacctaagtatccgactattacggattgttgagattgcctctcagggattacatcttaactggtacgatgttcttcactgaaagtccattacccattctacttgtcactattgaactgaattgtggacgtcaa

SEQ ID NO: 603502 - DNA, 294 bp, Homo sapiens
  misc_feature (139)..(139): n is a, c, g, or t
catggacgcaaactcaagggggctttcaagcccgcgagcctagcccaggcgcatgacagatttgcgacaggaaggcctgtcaatccaaagcgtcaccataaacttcatggagttgacaccgagcctacatagcctgagnttggacaaacaagtcgaccggccggtaagtggccggcactcggagattcgccatgactcagatcgcccgcatcagcgacaccggcaatgaacgccgtctgcaagccgaacgcctggttggcgcaaggctttgcaggaagcccaggcgattcagag

SEQ ID NO: 603503 - DNA, 453 bp, Homo sapiens
  misc_feature (422)..(422): n is a, c, g, or t
caatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttgggattgcttttgtcaagccactgggttgcaagttcagatgggtctttcttgtttttcttaggctaattgtaaggtaaaattcactttgggtaatttattgtgtcacataggattggaagttttttctcttggctaaatanttattccccatttttccaaattttggggggg

SEQ ID NO: 603504 - DNA, 1765 bp, Homo sapiens
atgcaggtgtcagcatgatagatgctgtacaaatttatggcgagacgtaaggagcagtttggctggcctgatgagcccccagaagaattcccttctgcctctgtcagcaatgatctgcccttcagaatctgaacctgagcaacggtcactgggagatagcgactcagcgtgtcccccactacgaccaggtggaactgtcctggagaggctgggtggtgagttgcgtttagaagcccgtggaaagctgctttgccgataggaccatatcatcgaggaaggagagaaacaagaatgctgctcaggagctggccactttgcatgttgtctcctggcagcacgcgtgccagttgtccacgcagcagtccaatgagccttctggccagtctggactaccagccgctcggcgtaccgactagcactgaggatcaggccttgcggagcaaagctgtgcaagtgtctcagaccacagtctagcaaagagggcaaggatttggaccctgaggtgttccagaggcatagtgactcacagctcgctccattgccatcatgcggccaccaataagcttgtccactttactggagtcaaagctgcgcgcagatggaaacagactgttcattatcctagatgtgctgctggagtctagagataggggcctactgatggggcccacttgaactccttcccaggaatggttgacgggacggaccgaggaacatggcaggagaatgggaagacataccactgtgtaccttgaaagctcgtcttcaagccagaagtgtttggcagtgagcgaccagaagataccatagcacgtgagctggtacacccacgacattactagccgatgataaccacaccaaataaactgtacaaagtagaatatacacatatgcacaaatactccacacacgaacataatcacttctcttcacttttcttcttattatatccgaaaaaaaacaaaaaattaacctaaaatacaaccaacaagagatgaggactaaacaagatgagtagagcgcgcagacacgaggcacacagacgagcaacgactgaaagagacaggagtaaggaaagtacactggggaaacagaagagagctagaatagaagaggcacaaaaagacagagcgagaagacgataaagaagcaggcaagagagcaggaagagcagagatgtgaaggaagaaaccgggcagaaagacagagagccagcacaatcagagagaacaagacaacacgcagataatacaatatccactaacaacacctaacaaaccacaaacaactaaagcaccccacatacaacccaaacaataacttacaaacatcaacaaaatcacacaaactcacacacaacaacaacacacaacaatccaacaatacccacaaccgaaccaacaacacaaaaagaacacaacaaaaaaaaacacacaacaaactcacccacaaaaataaaaactaaatagacatataacaatataatgataccaaaaaataacaatccaaaacaacaatcagaacacaataacaatagacaaaacataaacatcatacacacaatttccagatactgcataaaatataaataatagtaaatacatacaatacgaaatatacaaaatacaacgcaatacaaacctacaacaacaaccaaataaacaaacaaaataataataaaaatcaacaaataatagaaacttaataatatacataaacaccataaatacaatcgaacaccaaataaaataacgacaccaaaaca

SEQ ID NO: 603505 - DNA, 347 bp, Homo sapiens
gaccacagggccaaatataaatcctaatacttaaaaatatgtgtgtgtgtgtctgtgtatgtgtaaatgtatagatatatacacacatatatacacatacacatatatacacatgtgtatatatgtacacgtgtgtgtatatatgtatatattttttttcttcgaaaagatgtacaaacagttaaaaaaaaaaaattcagacagtacaatacgggatgtccagtgaataagtctgcctcccacactggcctccttctgcaggcttcaccttaagagaaaatgctgttactaggttttgtgtaatttgccagaatatcctatgttatataacatgtatgtctatactt

SEQ ID NO: 603506 - DNA, 838 bp, Homo sapiens
ggagagaactagtttcgagttctccgtgtttttttctttttggcccacaaagggggtaaagggggtgcctatggggtaaccatcacgggcccatattttcacacaatttctaagggggaactcaattcctagtgacgactggtgcttgaaccggcgtggttggactccaaaagatttcaagagctttgaccgacatctataccccgggatacgtgtaccggatgacagagcggggccttgcggcctacaacaggctcgcgggaaaactgcgacactcgtggcacaacacaaaccacaagtggggcggacacagccacagagacagcgggcccaaacacgaccctgggaggcaccctcaataacataattcgcacacagaggggggccctcaccacacctcgcagaacaaccaaacccatcacctcacgaagagaggccacacaccgacgtcaccagggcaaatcctccgccaacgggcatcagccccccgtgggcctctcaccaacgcagaacaccatcccagttgggggcgcagcacaccaacactcgatgccagcgacagaaagggaaaacaaaacacaccaaagccacccagcgaccagcagcaccacagcggaagaacaaaaccacgcagcgagggagacaccaagaccacccacaccgtgcacgctggacacacagcaacagacggccaaacaagcaacgataacaaagacgaggacagagcgaagagcgcaacaggactagaaacaccgcgcggccccagacgggaaacctgagccgaaaaccagcgagtagcatacgcgctatcaacgcgagacagattggaagacacggc

SEQ ID NO: 603507 - DNA, 171 bp, Homo sapiens
atcaccggtgtcggccaggcgggtctcgaacggctagcctcaaggtgatccatccacctcagaccatcacaagtggtgacgtgggattacagggtgtgagtaaccataccggccatgggaagtctattatctgaagagagtagactcaaggatgtgtgggggataacatag

SEQ ID NO: 603508 - DNA, 196 bp, Homo sapiens
cgacactgtactcagcctggtgatggagcagactccatcagaaaaaaaaaaaaaaaaaacctatctctggcaagtctctccctttttcttatgcctctccggacccctttttttcccaaactgggactcatactataagtaattttataattggctggtcccacccttaacagcctggacccttttcctcttggtc

SEQ ID NO: 603509 - DNA, 170 bp, Homo sapiens
ccagtatactctttcaccacagcaccaatctcatcgggtgatgatagccaaggtgggcatgagagtgtcggaaggagtgatgagatgtcggaaggggaaatgagagggcgatgagatgttggaaggggcgatgagatgttgatgttggcaggagcgatgagatgttggaa

SEQ ID NO: 603510 - DNA, 149 bp, Homo sapiens
ccaaccactcactatacagacctagcaacattaccaataagatagcgtagaattgaactgccaatactatagtaccgaggaagatgaaatataccagatatatagcaggctaccctatactctgcatatgatactagaatacttcaggg

SEQ ID NO: 603511 - DNA, 335 bp, Homo sapiens
ggcaagctatcacggttcaatgtccggagagtatatatgttgaagaggatagctattagaaggattatggatgcggttcgcttgcgttgagggaaatacttgatggcagcttctgtggaaggagggtttattttttttgtcatgtgcagaagaagcaggccggatgtcagagagggtgccttgggtaacctactgggactcacgcagtgaacagggggctattcctaagttttatatgctatatgccattattgattattaactgatgagtattgatatggtagtatatggttataggttcatatgtccggacgagtatattatatgaaccggat

SEQ ID NO: 603512 - DNA, 223 bp, Homo sapiens
gcgttgtagctagctgatagtgcttcgggcacaattaaaagattctctctgctaataggataaaagccagctgtgtatggcctgtgttcttaaatgtcgattgtatttattccttggtaatttattcatactttacgaccaccttcctcttccctggaatccttatccctagcttcaccaacaaatcagtcagcagcagacctaccgacgctctacatacgtc

SEQ ID NO: 603513 - DNA, 461 bp, Homo sapiens
atctagaggatcccaccatagagctctccgctcagctatagtgagcctgactaccccctagatctactgtgcttcctctgttcacgtgctcatctaaatagtgggagacaccaacagatccctgcagcactctccagatcctcttggctgtgccggccttttcggcatcctccttgatttccatagctcctccacctgcagaattctcgttgcaggccgagctctagcacgaccctgtcaccgtcgagcccagcatgactgaggccctgctcagtcacggtgagtcacgcccagtctgctccatacccctggtgctgtggatgcggactcttggacaagatttgggccccatcgtagaaatttcgatgactgtcataagagagcctgatccttgtgacttccgtggctttgtacagatcttctctcatcgtccctattttaatcatctcaagatgtaccag

SEQ ID NO: 603514 - DNA, 284 bp, Homo sapiens
ggcctggacaagcaactgctcgaactgctgaaccagcgcgcccgcgttgccgagcaggtcggcgagatcaagcgcactgagggcacgccttcttccggccgatcgcgtcgccccaggtcatcgacaagatccgcgccgccaaccgcggcccgctgaaggcggaacatgtgtcggccatctggcgcgagatcatgtcggcctgcctggccctggagtcgccgcagcgcgttgccgtgttggggccgatgggtaccttctgcgagcaggctgccctcgaatatttc

SEQ ID NO: 603515 - DNA, 320 bp, Homo sapiens
caagaacaccaatgaagccacctcctgccagatcactaattccacagcaacaagtcaaatcgaaagtcagatatctacagtctagcaataatctccttagcgcacaatgtagcagcacaagggaagtacattgctatagtatagaccacctgtggaaaccaaggcgccttgagacagagaaactcagaccagctataggagctcttggacaccaattgaaccgaaaattagtatagcatcaagtgacctcctggtcccaaaagacttgagaacagaaagccagatcattatatcccgcacatataatgccaccactcata

SEQ ID NO: 603516 - DNA, 710 bp, Homo sapiens
tgttttatttttactactttatcaaaacatgtcccttaaggtgtgtaggattcatttttaaaattctccctagaaaataatatacaaaggagaggcatattatatccccaatcacacttctggaagatagcttcccggggtcgagaagggtcttctctcttctttatcacgtggtagttatgggccttagcatgtgttaagatgtgagattatcaggataagtgtgactgagcaaacttcttattacaaccatcgaaggggcacacatagggccgtgtctccggatagtggatcgcacatgtgttgtgtgcgcaaatttgaagctccaggtgaaacagcgtttcccacagcctatcgaacggtgcacgtgaaggggcttcatcctccagtattgaaccagttgggggttcgttaagtttggaactctcaacaaaagcttgccactttctgcacagacgtggactcgtgggcaccgtgggtgtcgccgatgttttctcatggccgaggttctccctgaacatcttggtgcagcctttagtgagggcagctatggtcctgtggagcatcactcttcttaaattatcctgggttcattctagccaaattctgcccgttgtttcgggatctggaaaaggtcaatgccagggtatacccccggagagaagttcttacccggacaattttccggaaaacccggaaggagagcacac

SEQ ID NO: 603517 - DNA, 531 bp, Homo sapiens
aacggcgtacacctgtgcgacgacgaatgcgcaggctggcagagaccggctcggcggtggcgttctgcccgacttcgaacttcttcctcggtagtgggttgttcaacctgccgatggccgagaaacacaacttgaacgtgggcctgggcaccgacgtgggcggcggcaccagcttctcgctgctgcaaaccctgaacgaagcctacaaggtcatgcaactgcaaggtgcgcggctgagcccgttcaagtcgctgtacctggcgaccctgggcggcgctcgagcgctgcgcctggaagacaagatcggcacgttgcaaccaggcaccgatgcagacttcctggtgttggattacaacgccacgccgctgctgagctaccgcctgaaacaggccaataacattgccgagacgttgtttgtgctgatgacgttgggggatgaccggacggtgttgcagacctatgcagccgggcagctcgttcaccagcgctgatctcagagcccccccacgaaaccaagactcaggtggtgtg

SEQ ID NO: 603518 - DNA, 223 bp, Homo sapiens
cccccccccccggggggccctttttgggggaaggccggggttttttttggggtttaaaaaacccttgggttttttccccccccggggggaaggggaacggccccgggttttttttttttttttttttttgcccctggttccccccccgggggggggcccccttttttaagggggaaggggggggggtttttttttaaccccgggcgggggtttggccccccca

SEQ ID NO: 603519 - DNA, 274 bp, Homo sapiens
cttgagagataaccaaattgcggtaatttgtccaaagttgtgttgactgtctgcctcatgagcgttgaggcgacctgacagtgtgctgtgacagatcaggacagcacctgaccccaggttgcagggtggtcctggagctgtctctgtggccgtcgtcaatgggggtaaccttgactcccaaggaataccatggggtactccttgggagaggagacagagagtgggtgacgggttcttgggcttggggccacagaggccagccccatcaagacac

SEQ ID NO: 603520 - DNA, 1004 bp, Homo sapiens
ccgatccaacacgtggactacacataccaacctctagctatacgtgtaacataccactctacagcttcaggtgaattgtaatgtgactctcgtggcctgaatgctggtgtatgattgctgtctatgaactagaagtctgtcgcacccatgttcactacacttggattacaccactgtagagattcggtgttgtggctgaataaaaactaagcgtatgcaatagggatattcgaaaaatgcgcaatgaccacgctgaataaacaagattggagcaaatgatgaagattaagctatgcaagaagtgaaacatgttgaatagtgagttatactttgtcgtgagcaaataatgactatggtatgaggaacaatcaagaattatatttagaagacgattgtggtttaagcgtagtggagtacataagattaaaaatcttaagtttctctcttctactttttggggtctcaatcagaatatctcgcgtcctttaaattctccccatttgattgcatataatcgcgattaagtcccaggcacgttgatcaaagtccttattagagatctatctataagagataaaattaccttgaatagaaacgagagtaaaaaaattttagggggccgcgactaggtagtgcctatatatccgcatggcagggagcccaaagaaaatgccgttggtacgcctcgaattatcccgagtaccataggggcactcccaatagatatgtaacgtgaaactccctccacaagcgccatagtgtggaggccagttctaatcaccccttagtaggactggagacctaactgtgcggtcacttagctagaaccactgtcggggccaatggcatcccctccacgtataaggccggtggcggtccagtattttggccctgatacctcgacaagttaattatgcccggtctctgcgtatcaattcaaacattgtcattggtgtaccctttggttggttcaacccccgatgcaatgtgttttgccctttgca

SEQ ID NO: 603521 - DNA, 455 bp, Homo sapiens
tatttatcgttctgaccatagggctagtgtggttcttgattttgtatgagaaagccatcgtttacagatacaggtttgtaaaagtgtcgccaggttacagacttacaggtttttttttttaacaccaaaagttcaaatgctgcaaccatgacaagtcagcatcataagggcatcctcggtgttccccgagaaacattcttatcaaagatggcaccacgttcaaagagacgctacctcaccgatcaacgtgtggcagggtggcatttccttttttcagctatgcaaagtgcattatttacaaaccagctaagtgcatggaaccacagaaccaacacgttaggaattccagaaacaaagtggaagacagaagctttaacaacattgggagagtgccgtgtgcacttccacgggaaggccgtggccagagaagtaataacatcgtcaaacaataaata

SEQ ID NO: 603522 - DNA, 1081 bp, Homo sapiens
  misc_feature (1081)..(1081): n is a, c, g, or t
tggtggtcacctgagtgacttatagtctcgtggctgccagcaggattccactgcgaagctgtggctgctgtaggaggcggatgctatctttctgggcctggctctgtggcttgtgtgctactgctggctgcaacctacactgctgctgtggagacccaaccctgaacagagtggacaggacccagagtctacttacctcagcaggggtatacagctgcctcagaccctactgtacgtcacagaacctttaattcccaaggtgtaaggctgatggcgtagcttcgccagtggaagggacgaaggtgaacggagtcctcttgaaggcaggatcatgacccaggcccagcgagaggatgcgagagtgacgtgctgggcaggaaggcaggcgaggggagtaaaccctaaacgaattggtgtctgtggatctccactgcatctacagcaacgagtaggggatgccttctgctggggccgtgggatccacgggtatggtgctgaggtgggggcaccagggactgccttcagggagttcacagtgaatacgatgagaagggcgagcgccctgcaggatcagactagccccaattacgtacagaagacacttcttgggaggaagagaaggactaccttgtacttttaccccgcgtgtgcaccggtattagctgtgtgccccaaaagattcagctccctccctggccactctaaaatgattggtatagggggctttcccacccccttaggatgccctaatctaggctagtaatgactcaagggttctggttcactatgaattgttctctctcttgccccatctccatttattccagtcgtgcagcctaatttacacgcttgctgatatagatgcaaggaacgcgtccattcctggaacctggacaggaccggacacgtagctcagtcctattagacgccgaccggaaaattaaagcgagaggggccaacatgtggccgcaaacgtggatataagaggccgtgtgtcagaggacacacatgcgtggcgtaccaatatttagcacgaactgaaagtaacaatggataataaacgaaccgtgttaatataatn

SEQ ID NO: 603523 - DNA, 894 bp, Homo sapiens
tgcggctcgctggcgatctgccgcagcgttgtctttccacgctgccactccgatggcgaacagctcgacgccgataagcccgggcccgcgctagacacgatctgcacgctgtcctggaggcctcccgtcgtgtcaccacgatgacacacctgcgacacgcggaggcagttgtgacacctgtcgctcccggatagcccaacagggacgtgtccagcgagaggatgtgcttgatggccctggagacggcgtgtgaggacttgccgggtcgcactagctcaggcgaggacccggtgggacagaggacccgtgctggccgtacagaggagaccctgtttcactctgatctgagagcacgtggactggcggtggtcatttccagtcgtgtcttctgctcgtcgcctcgtgtgacagtgctagccatctagagcattgcgccgggagggcatgctgactgcgcgccatcgcgcaaaattggcggtcgtcatagaggcgtatgagaagttggccagccctcatcgggaggccatacgatggggacattcaaacgtggtcttgcgaagggcaaatgcttcagtaagcttcacgagccgggatggcctccgaaactaggccagcaattcgctagccgaggggttaggcagttgcacgggtagcctttgccttgattgctcaccggggaccgcttggaaagcggaccgagccgcgtcttgcaagtcaggccgaaacgggccgttatgggtgactcaggcgaaacttggcattgggcccatggcccggggtccattgggatgccctggtgggaccaggcggactttggattacgggcagcaacgagccttgcaagcaaggtgccgaggctttgggaagaaccattgaggccccggcaagcgagca

SEQ ID NO: 603524 - DNA, 312 bp, Homo sapiens
acccatgcctgctggaaatcaaaaagcggtttgtgcctggtcgctctgtgcccatgcggcggaatctcaatgatcgacagcaccccttaaaggccggctgcgttggctgttgctaggaggggcacatggagtgggccaggagggggcccttctccagatgatgtccctggtgggggcaggaggtaccctcgctctccctctcctgggggcatttgagtctgtggcttttggggtgtcctgggctcccccatctccttctggcccaatcttgccttctgccctgaggccccgggttctgtcaggggtccctaa

SEQ ID NO: 603525 - DNA, 789 bp, Homo sapiens
atgtgggaactgcggtcagcctccttttggagggccatatttgctgagttctttgctaccctcttctatgtcttctttgggctgggatcctcactgcgttgggcccctggacccctacatgtcctgcaagtggctttggcctttggcctggccctggccacactggtgcagactgtgggtcacatcagtggagcccatgtcaaccctgcggtcacttttgccttccttgtgggctcccagatgtccttgctccgtgctttctgctatatagcagcccagcttctgggagctgtggctggagcggctgtgctgtacagtgtcaccccaccagctgtccgaggaaacctagcactcaacacgctgcatgctggggtaagcgtgggccaggccaccactgtggagatcttcctgacgctccagttcgtgctctgcatctttgctacgtatgacgagaggcggaatggccgcatgggctctgtggccctggctgttggcttctccctcaccctggggcacctctttgggatgtattacactggcgcggggatgaatcccgcccgctcctttgctcctgctatcctcaccaggaacttcagcaaccactgggtgtactgggtgggcccaatcatcggcgggggcctgggcagcctgctatacgactttcttctcttcccacggctcaagagtgtttctgagagactgtctatcctcaagggagccagacccagtgactccaatggacagccagagggtacaggggaacctgtggaactgaacacccaggccctg

SEQ ID NO: 603526 - DNA, 357 bp, Homo sapiens
ggaaaatgtattgaatccaataggaagaagttgcagggaaccaatattgcaccactgcactccaacctgggcaacaatgcgaaactctgtctcaaaaacaaatgcaaaagtaacatgagaagcaaaagaaaagataattagggactcggaaagacaaagactgaaggatcggtggcaatgatatttggggaaaaaatatgtagatgaaccacagacaatgacccagactgaaagaatattcgcgcttcgaatgctcaccaaactatcatcaggaaggttctgaaatagatatgaaggcatgcaagctatttcaccagacactacattgctagctctagccatgtcggactttaccct

SEQ ID NO: 603527 - DNA, 212 bp, Homo sapiens
tgggcgacggctgagcactttgccaggacagagagatatcttcggatgacctagtgcgccttagagagtgtggcggagtatccatatggtctccaaggtgtgtatatggttgccagctgcgatgacagcttcaaatattgttgagatgaattctaagccaccaccgggagcgaacgcagcctctgagaaggaacgcagctcatccattgcag

SEQ ID NO: 603528 - DNA, 347 bp, Homo sapiens
acgatcccttacatatggcaaggcaagatagcagatgtagaaacaagcgccttcactccagctgagagaacaaaaaatacaaagccagcaatatcttagaactcacatatgaggaggatatatttcctaggggcacagagaaatttaaaaaactgtgaggaggtggtaagataactgaacttccatatccttgattctgctgtctccaatctacccggcaccaagtgcatggaaaatttctgcctgactcagggttactacactggaaagagtaaaatcaaggtggataactagcctccccaccttcttgggttccctggcaggagacttggccttgccatatgcaa

SEQ ID NO: 603529 - DNA, 257 bp, Homo sapiens
aatataactgttaatagggctccagaacttgtgcgtggtgaccagcttcgaacctaggcataggtattcttcggtgccggaaagtccccagcggcggcgcaagcgaaatgcgatccaaccctccaaggcagcgcggcattgcggatgtcagcggatctcgtaaagtgagtccagccagcggcgtgttcagctagtctttccacaccagttactcaaggacgatccctatgccagataactctgaagccagtcgacgc

SEQ ID NO: 603530 - DNA, 649 bp, Homo sapiens
  misc_feature (271)..(271): n is a, c, g, or t
  misc_feature (299)..(299): n is a, c, g, or t
  misc_feature (303)..(303): n is a, c, g, or t
  misc_feature (388)..(388): n is a, c, g, or t
  misc_feature (390)..(390): n is a, c, g, or t
  misc_feature (419)..(419): n is a, c, g, or t
  misc_feature (454)..(454): n is a, c, g, or t
  misc_feature (550)..(550): n is a, c, g, or t
  misc_feature (563)..(563): n is a, c, g, or t
  misc_feature (597)..(597): n is a, c, g, or t
  misc_feature (604)..(604): n is a, c, g, or t
  misc_feature (615)..(615): n is a, c, g, or t
  misc_feature (632)..(632): n is a, c, g, or t
  misc_feature (645)..(645): n is a, c, g, or t
taccctttttctccttaggccaagtttagcttattcttatctttccacccaaacacctacacaacgtttaggcttcctgtaagtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacagttttttgtgcagctcaagaaaactttgaaaagaacntgctttaactgaagcattggactctgcngctntctgtgtaaggcccgtgtactcccactggcagggtgaggaccaaaaatctgaaactcttatgaatctgacatattatatgggaantntatcttgtgaccggcttcaagtgcatggncttaaaattccatgaggggctaaatgtggaggganaggtggatttaaaagaggccagaccttaaccaaagatgcctggggatacagccattctggccccccctggcccaaggaacccccaaaaatgctggncaaaaaccccaancattgctgatggctttctggcatggccagcaggnccagggngggtggctttntggccccccctttggcnccccaccttttcnaaaa

SEQ ID NO: 603531 - DNA, 221 bp, Homo sapiens
tggacccgcggtatgtttacgaagctgtttgtgccggtgctgcgcacggaggtcggcgctaatcggccagctggctcaggatgcatgctgtggtctgggcgcagaaggccttcccgcgcccaatcctgcgttccccgcgaaggagaatccgtgtgcagtgtgattcgggtgccggaaacccccagcaaagcaggaggacccacgtaagagataagcgcgtg

SEQ ID NO: 603532 - DNA, 423 bp, Homo sapiens
atggctctatttggacgctggagggtggggcggttcttagagctaagcttggggcagggtcctgggtctgggctgggacgactcagctcagaaatagtgtttgcttatcctctggcgactatacgggcccctccctggggttgggggtgtgacaggcacagaagccgacccaggcggtccctgtgagcccaggggcaggaggatgcctgggactgcatctgcttacagaggggcctggacagggagggggccagaccacagcgggccctcctccggtcattgtgcgggcctctgaggctgtggcaggtgcgcggtgctcacagctcatcgtggtgccgggtcaggtcctcgccatagttggtggcctggctgcccacaaacatgttccaattacccaggatttccgctttgctcaaccaccag

SEQ ID NO: 603533 - DNA, 402 bp, Homo sapiens
gtaggactgcggtagtacgttacggatactatacatagttcactacggaataggttatgttagtcgttgtcacggtagaactgctattattcatcctacgtgggtacttgaggcgtatgctaacgattttgcgtagctgggtttggtttaatccacctcaactgcctgctatgatggctacgattgagagagtgcaggagcaaggcttcacgtttaatgagggcagagatttggtcatcatgattgagatgggggctcagtttttgtcatgtgagcaagcaacaggccggatgtcagcaagggtgccttgggtaacctctgggactcagaagtgaaagggggctattcctcgttttcattgctatagccattatgattcttcatgatgagtattgattggta

SEQ ID NO: 603534 - DNA, 349 bp, Homo sapiens
  misc_feature (302)..(302): n is a, c, g, or t
  misc_feature (314)..(314): n is a, c, g, or t
  misc_feature (319)..(319): n is a, c, g, or t
  misc_feature (324)..(324): n is a, c, g, or t
aagtgtttaaactaaaaaccacaaacctggactctaacaagggtgtcaagaatttggcctgggtgaactaagaccagctcctctatcagcatttttggtgtctcccagtgatcaaaaacagagtggttgtgaaacctgttggcccagttggtttcaaaccaaaaacattcaaaaagtttttagctctatatttgcatggtactgcgtaaacgaagaacccctctgaatcctaaaacccctcttgcctctcttccaagaaaaagggcatgggccccgtgaagcctcagtgcccgtttggcctnctgctctcactnacaanaaaangcccttgcgttgcaaaaaaaaaaaa

SEQ ID NO: 603535 - DNA, 945 bp, Homo sapiens
agtgaggagcgcctcttcctggccgccatcccatctagtgaagtgagggagtgtctctgcccggctgcccatcatctgagatgtggggagcacctcagccccgccgccccgtctgggatgtgagtgagcgcctctgcccggccgcgaccccagtctgggagtgtgaaagcgagcagcctagtctcgactcgaagcaaccgcgcggccatgatgaacgtaatgtgcagagcctctcgtgcgcaattagaacacagggcgagaaatagatggagaaaatgatacgacgacaatccacatatagttgccgctgtctttgtgtaagaaagaagtaagaccatggcgacgactagcatgttgcagtatctttgtaactaaaacgaaaaaattcttatctagcgcaaatgacgagaatagctagtcgtacgtcttgaagcaccatataaccccacaaaacccagatgctcttactttgaacatattgtctgctagtagtacacaaatacaacggttaaaaaaagggatataaaaggtgcagatagcaaaaggatcgatgcatacactgtataacaacaaagaacttgcataatagtaaaaggaaagagatcgacaacccgattacatggatggtcagaatccaaacaaaacaaccccagttatatcgtcacagtaacccaatgggtatctcaacatacactaaacttgtcgtgaacatggccctgtcagggggacagactcagacgccataagcggaaaaaacaaaaacaaccatataggatacaaccatgtattatacatcatagacatgaaactaaaacatccaactaataaggtacaatattgaaacatgtaacaaataatcaccacaaatgcagacaaaacaacgcaaataaatgaatcaaataaaaaagacaatatcaaaaagaaaacaacaaaacaacactcagc

SEQ ID NO: 603536 - DNA, 224 bp, Homo sapiens
  misc_feature (2)..(2): n is a, c, g, or t
angctgacccgggaggcagaggttgcagagagctgagatcatgccactgctactccggcctaggtgacagagtggaaactccatctccaggaaaaaaaaaaaacccaatttgtgataccaaatttaatcaactaaatttggagctatactggccttaactctatagtaagttttacagtactgtgctaggacacccactttttcaaaacagcaaatcacttgtg

SEQ ID NO: 603537 - DNA, 834 bp, Homo sapiens
cggacgcgtgggcagacctcttctgatttgtctagctgcttttctaatatctattcaccaagctcttccaataatagcataaggccctaattaatattaaacttttatcattataatacataggatgtcttctgttttcctgatcaaattctgactactattaaaatataaagaattgtccagaaatatataaaaaaagaatcacacattgatcttctttaaatgaaaatataacaattgtatggactaggatgattacagttgttcagttctgactgttatttgaagaaaaaagcaataagaagcctcagcaacttaacagaaggagctgccatttactaggagaaaagattgtggatgagagtgtagcaaaggtcagaattctgtgaagcttgagatgtttattataatgaattatcttttatactcactacaatttcctaacaattttggggtttatatttttgaaagagatatacctttaattttctttctttgtactattgttaggtaactttaatgtgcagattatactacagtgaaagttgccaatgacaaggcaaagtcacttacatcagaccaaagcaaagtggagccgggtcatgaacaaaggggatcttgtgtgtctgtccacgataagcactatcacaaggactttctattaaactcacaagaaatttctggccacccagcacaccagtttgtccagctccatccggtaggggtctcctatattaggacctatcttaaaaaatcttcaaaatggggcatttgaataagccctctaaaaaaattgtctcacaggcgtttctccccatttaaccgtctttttac

SEQ ID NO: 603538 - DNA, 155 bp, Homo sapiens
gcgtggttggcagtatgagagttgtaatggcccgacttttgagtgagggggaacaggggatcccaacggcttgcgctgcctttgcgcagaacccgggcgggcggccacagtcgaggccttgctggggtaggagaggcggtccccagtacaattgg

SEQ ID NO: 603539 - DNA, 607 bp, Homo sapiens
  misc_feature (607)..(607): n is a, c, g, or t
ttgttcgggtgactttgccatggacattgcatgcctgagcactgcgcacatcatagactacttgacctgcgtccctgcccggccccggcccgcatggctgagctgatccagaaggccaagctggccgacagccgagcgctacgacgacatggcacctgcatgaagcaggccgacagggcccagctgtccaacgaggagcgcaacctgcttccgggcctacaagaacgggcggggccgcaggtcgctggagggcatcttagcatgacagaagaccgacacctcgacagaagtgcactgataagactatcggagaaagggagtcgactgaaccattgaccagggctggaatgtggataatttaatagccatgcactatcagagagtaggctttattgaaagaggtgatactccgtcctgctgagtgctggggagacgaacaacatgatatccaaggctacagagcttgttagcagaaagtgaccaaaccatcgctgggtgtctactttgattcttggactaaaccaagtgctgcctgtaacgcttgtagcatgtgctgtcctagaacttcagcgacctattgcggtaaacacacatgcacgcgggtcgn

SEQ ID NO: 603540 - DNA, 759 bp, Homo sapiens
gggttgcttagctgtgagtgaggcggcagtgtctgagctgggggggagtgggggactcttatttttgttagtgagggacctgggcctgatgtgcccgacctggcctggcagggctctgccctggttggcctgtgcgtcatgtctcatgcgtgccgaaccagctcgggatggctgtagaggccagcgcggagggccctcgagccgtgtacgtgctgttggaggagcgcaggcaggacgactcggctcagctgctcagcctgaactctttgcttccggaatccgggatttgttgctgaacatagaattagaaaacggtccttgatcactgacagacttctacgagctcaaaagccaaagcactttaccccattacgctcaaagcactcccaatatcacatgcagggccaacaccaaggcaaccccagctacgagctctctagcatccgtctttcttgcaaggaggggctccagggacccctgacatgtcggtcattctttcttcaatcgaaggagttctttgcatgaggggcaacaggttaaatgcgggaccaggctgcaggagacagggagaaggcgtaagcggtcagaggaaacagtgccagctgaggggatccctatcccacagatctgcaaacctgcgtattcctgacgataccatgtggattggcagtattctgaatggaggcacaaattgaggccgtcaaaccccaggccagggtgccagggaggtgataaaggtgcagacccatctggagaacc

SEQ ID NO: 603541 - DNA, 586 bp, Homo sapiens
  misc_feature (520)..(520): n is a, c, g, or t
catctagaggatcccgggggagagggggtctcagtaacgtagactcggctggtgagaataagataaactagaagtgctggctcataatgtaagggttcaagtctgtaagaccgaatgagtagagtagatgcagctaagggtcaggaaggcttccgggaggaagtggcactagagctggggcaacagaagagacttagggagtggagagggaggccattctaggtccagggtaactagagtgtaagaagggtcttagagaactttttaaatgggaaaatggaagtcccaagggggcaagcaagggctccagcctagcactcccttttctctcccacatagcatgagggagaggggaaaggtaggagggggtgggaaagtgtggcacccagcctttccactccaaacctcgtatggcttcctggaggtgggcggtgaccaggatgtctcatgtaaggtggctccaatctaactatcaaaggacacgccaagggtgtggcatttgtcaagagctttaacctgnctatgctgatgcggggaggcgggggttacaccattcgtaacgtggcccggtgctggacatatgaga

SEQ ID NO: 603542 - DNA, 152 bp, Homo sapiens
tccccttagcactatcaacgttttaccttccctctacacttatcatctccacaattctaatcctactggactatcctaagaaatcggctggtcggccttaatccaaggcctacgtttccacactttctagtaaggccttatctggcgcatac

SEQ ID NO: 603543 - DNA, 208 bp, Homo sapiens
accccccccgggggggggggccccccccccccccttttccggggctgtttggggttggcctttccggccccccccattggggtccaaaggggccccaaaaggggggggaaaaaaaaaccaaaaaaaatttttccccccccccccctcccttttgcccgggggcccccccttttttttggggcccaataaaaaagggtttttccccgga

SEQ ID NO: 603544 - DNA, 298 bp, Homo sapiens
gccaagcactatatgagcatagtgctcaaatatctgctgaacaaaccaacctttgaagatgcttgagaaaacttctggatgaagcgaagattacgtggcccctattgaaagtcttgttcaggaagatgccaggtagttctgattaacatgttacagctatagcagaggcactgaatcagcggactactgtttctgtgtataacaaaaggtgacacttaattttcctcattctatacattaattttaaatatagtagtaatgcatggctttaatattacactttgctttggaatcattc

SEQ ID NO: 603545 - DNA, 960 bp, Homo sapiens
agcggatctgccggcgggattcgatggcgtgatgtctcacagaaagttctccgcgtactccagacatgggtccctcggcattcctgcctcggaaagccgcagccagcatggcagtcgtgggaagggtgatacgagcttccactagaggactgtacccgtaccatgctcggtgccagctcaacagaccttcctgggatagcaaggctgggcattgacttcacatcgtgctgggaagtcgacaggccgggatccaaggtgtaacaagaaggacggtggtggacggctgtgaacacttgtagaagacagcacgccatggtggttgtggtgcattagtgagagctacagtggaagagcgcaccttcgatgtcgctccggatccttcaatgatctgtctcttgcgtgacgcacaattccgtggatgaactggcggagtaggcgtgtactattacagaattctggacatcaagatctctatgcacatgaaggcctttaccaatgttactcgtcgaagaacatggccggatggactgatggcaagaatgccaggctggtagcaaggacttccgtcaagcgactggataggacagtagcgtgaccgaagtcagtccggtgtcaaattgcccaggggccagtattgcgcctgactttccgtcttgacgcccaggaatagaatgggccaccctgatggaagatcgcaggtgaaacggtagcggcacttgctggctcgaagcaagtctggactggtgcccgacgagaggcttgatgcagcgagggtacctgatggaatcctgaagtgattatggggccacggaatgcagtattgactccggacgtcaatcgcagggttgaccctgaaggggcaattgggtcttacaaaagggggtccaccaagtcgctggggcaccaccgacagatgggctgccattgcacagaaccacccgaggcccggcgcaaaggtgg

SEQ ID NO: 603546 - DNA, 192 bp, Homo sapiens
cttttccctcttttccctctacaaaaaacttaaaaatgtagcgcaggcatggtggcgtgcctgtaattccagcgactctggaagcttaggcaggaggatcacttgactctaggagttggaggctgcactgagctatgattgtgccactgcactccagcctcagtgacagagtgagaccccatggccgggtac

SEQ ID NO: 603547 - DNA, 394 bp, Homo sapiens
tgtgcctcgccagtagactggaaggtcccgaagagccagagagatctgtctgtctctcgcgggctccccatacagcaaggacgtctgtctgtctcactgggggctccccatacagcaaggacgtctgtctgtctcactgggggctccccatacagcgggaatgtctgtctgtctcactgggggctccccatacagcgggaatgtctgtctgtctcactgggggctccccatacagcgggaatgtccgtctgtctcactgggacctccccatgcggctgagacatctgtctctcgcgggttcccccaccagcaaggacgtctgtctctctcaggcccctcatacagctgggacatctgtctgtctcgggctcctcatacagctgggacctcgttg

SEQ ID NO: 603548 - DNA, 275 bp, Homo sapiens
  misc_feature (69)..(69): n is a, c, g, or t
  misc_feature (87)..(87): n is a, c, g, or t
  misc_feature (206)..(206): n is a, c, g, or t
  misc_feature (242)..(242): n is a, c, g, or t
atgctttggaagctttgttcttttgctcttcacaataaatcttgctgctgctcactctttgggtctgtnccacctttaagagctgtnacattcactgcaaaggtccacagcttcatttttgaagtcagcaagatcacgaacccaccagaaggaacaaactccgaacacatcctgggggcttgttggggatttcaccacatggaggnaaactagtgtttctgctactgcttcagtgagcgcanctaaatctgatcagcatggtccagggacagttg

SEQ ID NO: 603549 - DNA, 340 bp, Homo sapiens
aataatttgtaagttttaaactgtgcactgttctatgtaatatgattaactctcactctgtcctgctctgctggggatgtgaatcatcctttggtccagtagatgctacctgcctgttagtcacttggtgccatctctgttatctgattgaaaaacagtatgtatggggttggtactatttgtggtctcaggcatccactggtggtcttggggtgtatccctgccggtagggggactacttgtggactgtctttcccatcattaactgaccagtgtggagaaaggcatacatttcgtaggcagtaggttaagacttagcaagtgatgtggggctcttagg

SEQ ID NO: 603550 - DNA, 282 bp, Homo sapiens
catcataactaggcacagtccctatacaccctctacatattaccacaatcacaatgaggctcactcacccaccagcattatacaacagtaaagaccctcattcacacgagaaaacaccctcatgttcatacaccacccccacgcccatcctggttatgtgcgtactatttatgtgcgtactagttatgtgcgctactatttgtgtgcgtactatattatgtgggtactaattatgtgcgtactatttatgtgggtactacttatgtgggtactagttctgtg

SEQ ID NO: 603551 - DNA, 7226 bp, Homo sapiens
cgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagtgagttctcttgctggatttactgactgtcacagaacttccattcctgttcattcaaaacaagaaaaaatcagtagaaggccatctaccgaagacactcatgaagtagattccaaagcagctttaataccggtttggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacagaaaaaaaaa

SEQ ID NO: 603552 - DNA, 686 bp, Homo sapiens
  misc_feature (17)..(17): n is a, c, g, or t
  misc_feature (192)..(192): n is a, c, g, or t
  misc_feature (278)..(278): n is a, c, g, or t
tcccctcaactgcaganaccaactctcatcccgagatgttccaccaagtttgggcagctctgctctctctctatggccttctctttaactccatgaatcagtgccctgagcacagtcaactaactgcgctgggaatggacgacacagagaccccagagccccacctgggcctgtggtactttattgcggganagccgtccaccacggaagagttggcaacttttgatccggtggacaatattgtcttcaacatggctgccggctctgcccaaggagcntccagcttcgtgctaccatccgcacgaaaagtggggtctgtgtgccccggaagtggacataccgattgactgaagggaaaggaaacatgaactcagaactgaagggcgcccagacatgaaaacagacctgttctccagctcgtgcccaggaggaatcatgctgaaagagacgggccagggctaccagcgctttctcctctacaatcggtcaccacaccctccagagaagtgtgtggaggaattccagtctctgacctcttgcttggacttcaaagccttcttagtgactcccaggaatcaagaggcctgcccgctgtccagcaagtgaccagtgacttcacccgtgtcctagacagacaagataggagcccagcttcgagtggagaagccagcgactcctgccccctc

SEQ ID NO: 603553 - DNA, 521 bp, Homo sapiens
gaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttcta

SEQ ID NO: 603554 - DNA, 98 bp, Homo sapiens
  misc_feature (8)..(8): n is a, c, g, or t
ggctccgngggggtgggcggcaggtaacgtgtcattgcctctcacgccacctggtaggctggactacttcctcctcccaactgcggggtcccagaaat

SEQ ID NO: 603555 - DNA, 583 bp, Homo sapiens
  misc_feature (14)..(14): n is a, c, g, or t
  misc_feature (75)..(75): n is a, c, g, or t
  misc_feature (154)..(154): n is a, c, g, or t
  misc_feature (238)..(238): n is a, c, g, or t
  misc_feature (299)..(299): n is a, c, g, or t
  misc_feature (357)..(357): n is a, c, g, or t
  misc_feature (366)..(366): n is a, c, g, or t
  misc_feature (375)..(375): n is a, c, g, or t
  misc_feature (422)..(422): n is a, c, g, or t
  misc_feature (468)..(468): n is a, c, g, or t
  misc_feature (483)..(483): n is a, c, g, or t
  misc_feature (490)..(490): n is a, c, g, or t
  misc_feature (497)..(497): n is a, c, g, or t
  misc_feature (501)..(501): n is a, c, g, or t
  misc_feature (522)..(522): n is a, c, g, or t
  misc_feature (528)..(528): n is a, c, g, or t
  misc_feature (534)..(535): n is a, c, g, or t
  misc_feature (538)..(538): n is a, c, g, or t
  misc_feature (544)..(544): n is a, c, g, or t
  misc_feature (576)..(576): n is a, c, g, or t
aggtcccgggaggngctccagggtgaagctcatcactagcctttccagcagcactgtccctggagaccagaagcngtgggagccccttccctgtggcaccacggactcccaccaaggcacgtatcatgaacactgtacttgtaacacgtttatnacccttgggtgtatggggaatctaaagagcacctctgaaatccatacttgattcctttttacattgaggaaaagtgagattcanacacaaaataaccaagatgaccaaatgaaatggtggcctcgctgagcaaaagcacgaccanttgacaaggataaaccaaattgcctccctagcatttctgaaaacccattgggcttaanggaaaagantaagtaaanatttacttttttcaaatttcactctcaaattactcaaactgttgttncatttaaaaaaaacaagcaaactaatattgacacgagaactaaaanagaatctcaattcanacctgcnaagcccnacanagggggactctccgtaacccntttcangaagannttntggggnaataaaagccaaaaatctgatactttaaatanggtagtg

SEQ ID NO: 603556 - DNA, 85 bp, Homo sapiens
agcggggagcgcagggcgcagggctggacccggcgcgagctggctgagtcggagcgcagcgtcctttgtgcccggcggcgccacg

SEQ ID NO: 603557 - DNA, 272 bp, Homo sapiens
tgcgggggcgagaaggacccaagagcggttcgacataaaagtatcacgccgcgcggggacctcagcactcagtttacatggtgagaacatggtagagtcctcatgcagacaacgggtccaagaaacttgaagaagaagcttgaggggcaacatatgcttgaaaatcacggaggattttaaccctggaattaggacacggcggggggactcgacggggccaaatccggagcaaggggaaacccggagacagtagcgcggcagaaaggagcccg

SEQ ID NO: 603558 - DNA, 121 bp, Homo sapiens
gagacagagtcttgctctgttgcccaggctggaatgcagtggtgtgatctcagctcactgcaacctctgcctctcgacctagggcccggtctcttattcgccctatagcgactcttgatcc

SEQ ID NO: 603559 - DNA, 373 bp, Homo sapiens
aactcctgctatgctctccctaaagatctggtgatgagaggactacttgagctgaataatatggatctcagatactagtcataagcacatacatgattcagacaggtaatcacatatgatttccaagacccaatttttaagacactgtactcacgtagatctcttagctgctctgactatatggtctgaaaaggaaaacattttaagcctttggaagccattttggatggacatttcattgtgttctataattactcacataattgaatttccttcaagtcaaagtctgtataaaattaaattaagaaatatttttgaagttccatcaggcaggtgactttgtttacagctagatttgtgctgcattcacatg

SEQ ID NO: 603560 - DNA, 428 bp, Homo sapiens
  misc_feature (10)..(10): n is a, c, g, or t
gaagctatcnggtcatcaagtatcctctagaataggactgtatgtggtcttgcacgtgagcacaggcagtgctcgagactctgctgtcatctctgttgaggcgcacgctggctatcagggacatctcagtggattgctccggtgcgacataggagtgatacgctgtttctgttagagggaatacctcactccttttcttctttctcctttcctccccaaaaaaatcctccattcaccagcttatttgcaaccacgtgccaaaaccggcttttatatttcctttctttttttgtaaaggaggacaaaaaggtagatgactccctcaggttaaagagttgtgctattcaacaaataaacttcctcttccggttcttctctctcctcatctgtgagattcagttgaacattattgaaccggatagcttgcc

SEQ ID NO: 603561 - DNA, 353 bp, Homo sapiens
cttgtggtctcatattcaggtatagctctaagactcctgcagccatcttgttatgtcactggctttcctaggctgtggcttgagctaagtaaagaagccaaggagtgcagatctaagatcgcagagaagtaagtctcattcttaaaaacattgcaactactgttagagtccaccccatgaagctgttgcagattgtgtatctttgactgaattctactgacgtttgtgttgttcagactaaaacaaatgttgctagctaggtgggctgtgctgtctcagtaggacattgacagtcgccagctatcaccctctgcagaccttggacctgagtgccacatgcattatgagacccg

SEQ ID NO: 603562 - DNA, 497 bp, Homo sapiens
tgatatcacagcagttacataattaatggcatatttcaaaatagttataaaaacaattgtagttaacaataattaattgcttgtttcaaaatagctagaagatttggaatgcccccaacacaaataaatgataaatgtttgagatgatggctatcccaattaccctgatttaatcattacacattgtattcatgtatcaaaacaccacatgtagtcccagcaatttgggaggccaaggtggatggatcacgaggtcaggagttccagacgagcctagctgatatggtgaaaccccgtctctactaaaaaaatgcaaaaattagctgggcgtggtagcacatgcctgtaatcccagctactcaggaggttgaggcaggagaattgctggaacccgggagtcagaagttgcagtgagctgagatagcaccactgcactccagcctgcgtcacagagtgagattccatctcaaaaaaaaacaaacaaaacaacaacaaag

SEQ ID NO: 603563 - DNA, 1444 bp, Homo sapiens
  misc_feature (109)..(109): n is a, c, g, or t
ggaacgggaagcggtggaatcgggaggagccggagagcctctgtgtgaaagcgcaaggttgaggaccctgggctcgctcggaagtcacggaacacacgtacataactgntgcgtgtgagatgacagagaaattccgcaagcagtggacagaaccatgcacagaaggtgaagaatgagccgtggagcgcggctccaggacccgagtgcaggagatggctcgtcgcgagtggaggagctctccacgagaaaggcagtcgccgccgtaggtgagcaggtgctatcgcgcagcgatgcagatctcatcgagagtgagcgagttctcttcacgtgcatgtgacgctcgttggcacttggagacgtccctgtgcgttgagtatgcatcacgtcattcgagcagatggagactgcgcgctaccaggcacgagagggggttctgtatcgcaggtgtacaggaggagccgtagtttgggaagggcgggctgcaccatacgccaattgtggagtcgatgtcttccctttgttggtgaacgctatggaaaataacaccttgaggcctttgcacagagacggcaaaggcggttcttagcaagtagataggggtctagggcatccgtctcttgcggcaccactgccaactttgtacgaacgtgggacgattagcacttggggacgcataacagtgtaccaggcaaagttgacgcggatgagtggatctcgaagagccaagcgacgaatagaagtctcattacagaagtagttgacctagggagtacctagaacacagagctgaagagactgatgtgtccctgggacaaagccagacaggggcagcgcgtgtccaagaatcccctaatttaacatgttgcatgcgtgctctgggaactttctagtaccaagccgctgagacacttcgctattaggtccgagatgggacgagcgcctgtgaccatttcgtgtgagggagtatagacataaagggaccatatatccccagatattcagggaaatataagcataaggggtggaaggcgttcattgcagcaatgtctagcatgttacgtcgcggttacactagagggtttgcccactaaacaattaccaagagtacacataaaaaaataatggagcctaacgattgcatgcaagcatgccttcaacttgtggtacagcaaaagtacaacaagggtaagaggagcacactggtaaaagggcactcaaataagtgaaggaaaccagtgaggaagggagacaggcgtagacacaacgagcaacaggggcaagaagactgtcgacgcacctgcgaaacttacaacaaagagacgatgcagggaacgaaaagcagtgagagtcatttccgatctttccttcttatcgggctagatcgacctacaacgaacaaccaagcgacagcatgccaatcagacaagcgagccacaggcaacaa

SEQ ID NO: 603564 - DNA, 508 bp, Homo sapiens
  misc_feature (18)..(18): n is a, c, g, or t
  misc_feature (72)..(72): n is a, c, g, or t
  misc_feature (85)..(85): n is a, c, g, or t
  misc_feature (108)..(108): n is a, c, g, or t
  misc_feature (116)..(118): n is a, c, g, or t
  misc_feature (137)..(137): n is a, c, g, or t
  misc_feature (235)..(235): n is a, c, g, or t
  misc_feature (275)..(275): n is a, c, g, or t
  misc_feature (282)..(282): n is a, c, g, or t
  misc_feature (299)..(300): n is a, c, g, or t
  misc_feature (312)..(312): n is a, c, g, or t
  misc_feature (328)..(328): n is a, c, g, or t
  misc_feature (335)..(335): n is a, c, g, or t
  misc_feature (346)..(346): n is a, c, g, or t
  misc_feature (351)..(352): n is a, c, g, or t
  misc_feature (355)..(355): n is a, c, g, or t
  misc_feature (373)..(373): n is a, c, g, or t
  misc_feature (389)..(389): n is a, c, g, or t
  misc_feature (401)..(401): n is a, c, g, or t
  misc_feature (426)..(426): n is a, c, g, or t
  misc_feature (506)..(506): n is a, c, g, or t
ttcaacaaatcaacagtnaccaattcattgacttaaggagtaaacaagcagcttttataaacacaccaccgnaaaaaccaggaangcgcactccctgctcctcccccncctcttgnnncctgtatccagcagaaggncccagcaggaggctgaatccaagcactgctctcaggccactctatcctcatccctggatcctccagggaacaagataaaaaaaaaaaatcctgttttntttttttccaaaaaggagggccttaacatcaaccaaagtnacaaaanaaaaacaaaacacaggnnctagctgggcgnggtggctcacacccgnggtcccnacattttgggngaccnnggnggggggggtgcttgggtngtgggggttcaaaccngcctggcgggtntggcaaggccccctctctcttaaangtaaaccaaaatccgccgagcatcatatcacatgcctgtggtcccagctactctggaggctgtgatgaagactgcttgancc

SEQ ID NO: 603565 - DNA, 240 bp, Homo sapiens
ggcgcggaggacgcgcgcgcgggagggccccgccttggccggctctctcccttccccctccgtccccggacggcggctgggggggggggcttttcttggaaccccacaccctgagtgcccacactcctttttgtcaccgagctgctgaggcccctttgcgggcccgccgagcggttccgggtttagggtaccacagcgtcagagtttgactccctggaaaaggtgcgagcggttttgaaa

SEQ ID NO: 603566 - DNA, 334 bp, Homo sapiens
ggcagggagggaaaaagttggtttaattaaaaattgggcatttcctagtgacaggggccaaaaggttataaaacgggttttttgggtttaatgcccagggggaaaaaaagcttgcagcttttagcttttttttgatcgatgaagcccttttttattaaaattttcctttgttaaaggaggacccgtaactttccaaaggtggaaaaaaaacccttttttcctaaaaaggagtcaggcagggctccaaaatttttcattttttgtcaaagcaaaaagtaaaaactttaaaattgtttaatatataaataaagcaaataaagttgagtgttcccca

SEQ ID NO: 603567 - DNA, 286 bp, Homo sapiens
gtattaacaactacatcagtaatggcagcaaaacaaacagtcccatcataattacaggatcggatgcacatataacaatattagccttaaatgtaaatgggctaaatgccccagttaaaagacacagactggcaaattggatcaagagtcaagacccatcagtgtgctgtacccaggagacccatctcatgtacaaagaaacacataggctcaaaagaaagggatggaggttgatctaccaagcaaatggaaagtaaaaaaaagcaggggttgccatcctggtctc

SEQ ID NO: 603568 - DNA, 864 bp, Homo sapiens
tggcctcaagaaaaatttcaaatatccaaattaaaacacagtagcattggaacctgggaccttaccatctctttaagtaaagcgtggagtggatttctctactaaataacagaaacctcagtttttcactcccatggtaagtaacttttatttaagtaagtaaaatcgggtaggaaatcaccttggacttagcttccagtagtcattaccaccttttacggcacaattcacaagcatgttcccgggtgaatgggactgaaaatacatttggacaactttttttccttttatccccaattttggccagaaagcagaaaaatgctctatttttataaagaaagattaaatcctccaaggatattttaaaaaatatcaacctacatgcacttatagaaatgtaaaataccaatgactatttaaaactcgaagacccactatttggagtattttttatagacttaaatacggggtttttccctccttacaatctcaggctttctccatctttaaagcagcctctgtaactccctttggtccataggtgtgcgtgcctctcatctgggggaagtatccttacataccttctgtgccggatacttattaagggatgggtggctataccaggttgtttttttctttaaaaacgtcaaattctctattaattgttggaattcttcaaagcaggaattttaagaattgtcttcaaacaacggtagcctcatctcagaacggatggcttcacccgtgataaggctaaaaaaacaaaagaggggtatctgggcaagacctgtagacaggataagaggagagagttgctcgctggacgattgtgattgttcgtcctcacaggtctatacaaaaaaa

SEQ ID NO: 603569 - DNA, 471 bp, Homo sapiens
  misc_feature (10)..(10): n is a, c, g, or t
  misc_feature (27)..(27): n is a, c, g, or t
  misc_feature (54)..(54): n is a, c, g, or t
  misc_feature (83)..(84): n is a, c, g, or t
atttccaganttagataggcctcttcngaagtcaataaaaagaagaaaaaaaanccatttctccttgccatagtcaaaggaannaatgcttaagcaaaatgaaaaagaacatgaaaagcttctttctccgtttatggttgaatgtgtatctatttgagtctggaaataaactaatgtgttgataattaggttaggttgggcctcatgggaactcccctgtaactaaaagcctccagggtaagtttaaggtcctttcatagaaaaaaagccaaccatccccggattttaaaatttggtattctctcatgaatagaaatttatgtagacgccaaccaaatacttttacccccttaaaaagagaatataaccttttatggccctataattcttttgttttttaagtaagggtatattttgttgggaatatccttttgggggggtgaataaatcttttatcttgaatgtaataag

SEQ ID NO: 603570 - DNA, 107 bp, Homo sapiens
agctcgaatgtaccaacgcacacgtattgcccgagcgcgtgggtgcgacgctcaggacatgttccggcccatcatgtcggaggtattggtcgtcgtgattggccgag

SEQ ID NO: 603571 - DNA, 165 bp, Homo sapiens
acctagcgtactgtcataattttcttcttgaaacttgaggtggaggggtggatattaatggggtaacttgtatagcaatgtaaagagaacgggtcttaacttttgtcaccaaggctggagtgaagtgacatgatcatggctcagtggggcctcaaatttccctgg

SEQ ID NO: 603572 - DNA, 131 bp, Homo sapiens
  misc_feature (3)..(3): n is a, c, g, or t
ttntgtcagcatcattcagctcagcaaacttgcatgcatgtgagccgtgtggcaatccaatacaggtgcattgccggcgcttatttggcctggatggttcatggataatcacctgaacagtgaagccagga

SEQ ID NO: 603573 - DNA, 137 bp, Homo sapiens
  misc_feature (75)..(75): n is a, c, g, or t
ggggaggagacatagatggagagcacgactaggcacggaggtcagacaggcagccgggccaggattgttagtggnccagtggagagctgcaaacctggggacgcatgtggctggtcggcaagtgcccccaatgtctg

SEQ ID NO: 603574 - DNA, 275 bp, Homo sapiens
  misc_feature (1)..(1): n is a, c, g, or t
ngaaaatatggtcagctctatggtggtgataggagtgtgggagaacaaatcgattaggatgagatttggctgcatgtgattgaaaacccaaattaacagtgggttaaatgtgacataatttttttttttttttgagatggagtcttgctccgtccccaggctggagtgcggtggtgccgtctcggctcattgcaacctctgcacccaggtcctggttcaagcggttctccttcctcagcctcccgggtggctgggattgcgggcgcgcgccacca

SEQ ID NO: 603575 - DNA, 381 bp, Homo sapiens
ggaggagggggccacagcttaggtttggagctctggatgtacatacataattaggagcagggtgacgagtttttgtcataatgcacgcttgaacggtggagcgaaggcaagcaataagtatcacgtttgcttcagctcagccatgttattaatgtacggagcagatggtacagcctcactgatgcgatatgacgagacctcacttttgaaaggatcgccaatcctttaatgctctactaaacaatgtgctctattactcttatattctgatgattaaattatgtacgggcctgatattgtgagaaccatggctacaaagacgggctaccgcgcattattatagatcatccgagtgctaccctacactacctagccgccctt

SEQ ID NO: 603576 - DNA, 385 bp, Homo sapiens
  misc_feature (100)..(100): n is a, c, g, or t
  misc_feature (114)..(114): n is a, c, g, or t
  misc_feature (183)..(183): n is a, c, g, or t
ctagaggatccctgatttacgcaggcatggcacatgcagcgcgagtaggtctacagacgctacttccctatcataaagagctatcacttcatgatcacgncctcataatcattntccttattctgcttcctagtcctgtatgcccttttcctaacactcaaaacaaaactaaataaatactancaattctcagacgcctcaggaaaatagaaaaccgttctagaactattcctgccccgccaatcattccctaagtcctcattcgccctcccatccctacgcatcctttacataacagacgaggtcaacgatccctcccttaccatcaaatcaattggccaccaatggtactgaacctacgagtacaccgactacggcggactaa

SEQ ID NO: 603577 - DNA, 437 bp, Homo sapiens
gggttctgagcgtcctatgcttctctcttagcgttttgccagctcgtaggccatcggatgccgcgagtaccatgaccgtgggacggcagttcagccggcgactgtccggagaagtctttatcctcgtcttgaccactatgaaaaggggcatcgtgatgagatctcttcaagaagtattatcgcggcattttgcgtgaaaatgggaaacctttgagtgatagtttcaaaccgataaacaggacctgacctctttaaggatgtttgttttatagagagtgtttagttaaaaccacctagtaagcctaaagggcgtccaaggaactggttcaaaaggaaacggacttgtggaagtacaaaattttcccgatcaaggattccaaatcttaaaactggtcggaaccttttactgggttagtcccaaaaggcaaaaggccccg

SEQ ID NO: 603578 - DNA, 150 bp, Homo sapiens
tggttgggtggaagaggaaattggtgagaaggtctcaaaggtcacttcccagcagtttgaagctgaagctactgatgagaaggatgtagttgacaacgatgaagggactggcttcttcctttaaacgtggaaagaattcctccttgaagg

SEQ ID NO: 603579 - DNA, 262 bp, Homo sapiens
tatccctcagctggccccagggctacaagggagagaagggggagtcaggagctctgggaccctcaggactcccaggctcaacaggcgagaagggccagaaaggcgagaagggcgacgtgagtgcatcaacggtgctgtgcctgggaaatgccatggcctgggactggactggacacggacgagatcttttgtcatttgggcccaaatgggcagaatgggagaccctgtgctttgtttgggccttgggtggccacgctggatg

SEQ ID NO: 603580 - DNA, 126 bp, Homo sapiens
ttgataccactcaccaaggacagtatgattacgacggtagaaactagagatagacaggttatcaacgaaacttctcagcatcacagatgaccttgcatacaattgcacacactcagtgcagcaata

SEQ ID NO: 603581 - DNA, 115 bp, Homo sapiens
  misc_feature (78)..(79): n is a, c, g, or t
gtgaaaagccatctttgcattgttcctcatccggctccttgcccgccgcagtcgtctccggctgcgcgcctgcttctnncgtcgagagcttccggcaagctttattcagccagag

SEQ ID NO: 603582 - DNA, 196 bp, Homo sapiens
aaactccgtcgactaggctacagcctcatggccgagaacaataagtacacacagttatctagagtaaccatactagattaaagacatacaattactttcttctaaagacaattatccagaaagacctgcctttccctatgggtacttgacacataggtcccagacacaggctaatacgctgatatggtttcttacg

SEQ ID NO: 603583 - DNA, 239 bp, Homo sapiens
tatttttcctgatgttctcccttcctccagtccccgacctcccacaggccccagtgtgtgttgttcccgttcctcgtgtccgtgagttctcattgttcagtgcccattctgagggaaaacatgccagtgctttcgcgttcttcctcgctctcacccacctctcagcttatcgcgtcgcgcgcgcagtatattcgtctctctctccagtctctctcgcgacacacatctctcttttgtaa

SEQ ID NO: 603584 - DNA, 440 bp, Homo sapiens
acatgaaaatatttttaaagaataaatttctttaaattacaaaaaaaaaaaaaaaaaaaaaaaaaaaaaaaaaaaaaaaaaaaaaaaaaaaaaaaaaaaaaaaaaaaaaaaaaaaaaaaaagaaaaagaaaagaaaacaaaaaaaaaagaataggagaacaaataggaaagatagagaatagaatgagaaattaaaagaatgaggcgtaacaaggtgcaaaattgggaaaactgggaagagattgaaaatcaacgggatggggaaaacgccgatgtagccagttggaaaagtggggaagaaggcagaaattggggcagctggcgacagtggaaaaagggggaaagcgatgggggttcgcaaaagttgagatcctgaaaagaatgccgaaaaaggtgggcgaaatgagctaagtaggccaaccagtaagccaatagggaaa

SEQ ID NO: 603585 - DNA, 807 bp, Homo sapiens
ttcttgggaatacaaatgtctaacttgttatcaacggtctggctgcgtggtggtgtgcaaaactccgtacattggctattttgccacaactgctaacaccttgacatcactgtggaaataatgtcgaaatttgtggcatcaccttatgactactccgtaaactccgtcgagaggagtattatattcatcgaattggatagaagatgctcgcagataccaaaacacatggcatgacgcaatagcacctttgcttgtaacaccatagaataatcgataaaacgcacagtagagcagaacattagtctcgtagtgtcttcgttgaacgtcgtaattcgacaggcaatatcaagtcgctcacacgttgacttacagtctgtgtacgataggacctggaaggttttccatgggtacacggactgagatgcatgaggacaagagttgggtagctatacggaatgatcacaatacgtgttgcatctacaaaaatacccaatattaaagatgggtaattggcacggggtcgacgtttaataactcctcgcaattgtagtacaccactttgctaggcttgaaacgaatatttgtgagacaaagccagttgtaaacgaccctaaaccagtgcacattacgactccacgtttctcattttgctgggtcccaacaaggtgaactttggtcgttctcgttaagaacataatagtttggagttcccaattttggcccaaatatgtgtcttcgttgaagcagcggttcgaattacccaagtgcccgatcagaagagatgagcattgaacagggattgtaacc

SEQ ID NO: 603586 - DNA, 953 bp, Homo sapiens
ccgcagaaggggtcctggtgacgagtcccgcgtgctctccttgaaatccactacgccagcccgccgacctctgccgccgcacctgacacccgcccctctgcctgtgccaggaaattgctaataccaccaccatgccctaccaatatcgcagcactgaccccggtagcacaagcagggagctgtcctgacatcgctcaccgccatcgtgtggcacctggcaacggtgcatcctgagtctgcagatgtagtccactggcgagcattggtcaagcgggtgcagtccattggcaatcgacgaacaccgaggagaaccggcgcttctaccggcagctgcatgttggactagttgacgatcgcagtaaacccctgccatttgggggtgtctatcctcttccatgattacagtctaccataaggcgcatgatgggcgtccctttctcccccaagttagtcaaactcacaagggtcggtgtgtagtgcgcgcactcaaggtatacaacggtcggtgatccccctgagcagggacgaactggggacgagctaacacccaacgggttggattgggctggctgaccgctgagcccagctcaaataaggacggagcgtgacttcgccaaagatggcgatcgtgttgctcgaacaaattggggactacacgccccttcagtccctcgccaatacgatgcacaatatgcccaatgttactggtcctgttgatgccaagaatctagacccgtggaaatgtctttttgtggcccattcgaggaccgctgagtatcctaccttgattgcgggacccatgaacttggatcgcctgcgagaatgtgcaccgggaaaggggaggagctgctgctaaaggggtgatagacacgatttacttgatggccggtatccactgcttcccagccggttcatggatttccaaggaatcacggcggaagacgccaagcccg

SEQ ID NO: 603587 - DNA, 355 bp, Homo sapiens
  misc_feature (345)..(345): n is a, c, g, or t
tttgaaactggacaccttgctttacaccatatacaaaaatcaattcagtacagattaaagacttaaacgtaacacccaaaactataaaaaccttggaagacaaccaaggcaataccattctggacataggagggggcaaagatttcacaaaaaaagacaccaagagcaattgcaacaaatgcaaacattgacaaattggatctaattaaacttaagagcctctgcacagcaaaagaaactatcaacagagtaaacattaaccttattaggaatggggaaaaaattttttgcaaactatggcattttgatggaaggtcttaattttcccggcatcttttaaggganctttaaacca

SEQ ID NO: 603588 - DNA, 387 bp, Homo sapiens
ttttttttaaggacttttccggatgaggtattggaggtaataatccttcttttctttttaaatggtttctttaggccaggcatggtgggtcgtgtttgtaatcccagccctttgggagaccaaagtgggtggatccctttaggccaggagttcaagaccagcctggcccacgtggtgattccttgtctttacgccaaatattaaaattagccaggccatggtggggcatgtctgtaaccccagctacttgggagggtgaggcaggagaatcgcttgggcctaggaggcagaagttgcagtgagccgagattgggccccttccctccagcctggggggcagagtgagaccctgtttccaaaataaaaaataaaaaatgttttttttta

SEQ ID NO: 603589 - DNA, 124 bp, Homo sapiens
ttccaccaagaaatctactccacctaccaaagtccagtaactttatgagatcttctggaacagtgtacccaaagcgacctgaaaaaccaggtcctcccaccaccccgcagctcgctcctgagtt

SEQ ID NO: 603590 - DNA, 241 bp, Homo sapiens
  misc_feature (241)..(241): n is a, c, g, or t
attaatatgctttgaagtgtgtaagtcggaaataatctaaatccaagcaggctgattccaggaccctgctcttaaccgctgtataacagaggtgtaccatgtaaattagagaaacagagaaattatttttatcatatatatgcacatatatagagtatatacgtctagaaactcgagttatttcacatatggccttagatgaagagtttggggaacacctctatatatattatgcagcacn

SEQ ID NO: 603591 - DNA, 764 bp, Homo sapiens
  misc_feature (544)..(544): n is a, c, g, or t
  misc_feature (551)..(551): n is a, c, g, or t
tgtccttgtgtcgggttctcgttccccgggattcccccgagctgtcctgcagctgtgaccccttgaggactccgacccacttggagctgatcaccaaccccggcccaccaaaggccggcgtttctcccggtggcctggtgggttagacttacccttgcaccgtggccctaagccgtaagcgaatgtttgcacctctgcttgttttctgggcccttcggaaccctttattaccacgaggggcgtgaagtgaaaatccacggatgaaagttgtgacccacgcggagtctgctggttcaccccaatgagaggttcccctctacaaggaatctcgacggccgcgggaaattgtgaggaaagaattcgggcactgggtgctgtgatgagagaaggagcgcgcaccacaggcgccacgggccacacggaagattcagatcctgaccaccccgtatcaccgcgccgtcacaagcgacccaggccccgcctttctaagatacacccacaccccgcgtttctggaaagagcaccttgcctcctgcaccttttnttatatntggtcacgctgatccacagatagtattttagaaaagtttctcaaagttataaataatgtttttctgcccctaaaaaaaaagattttttgggcccggcgtggtggctcacacccgtaatccccgccccttgggaggctgaggtgggaggatcatttgaggcccggagtttgagacccgcctgggccaacataatgaacttcctttcccgggaga

SEQ ID NO: 603592 - DNA, 109 bp, Homo sapiens
agcgcttctgggtcaaaatccctgtgtagctgaagcgcgccaagccctgcattgtacagcccccctctcccctcaccacctaataaaggaatcagttaacactcaaaaa

SEQ ID NO: 603593 - DNA, 775 bp, Homo sapiens
  misc_feature (705)..(705): n is a, c, g, or t
cgaaactcctggatctcaggtgatccaccgcggctcgcgtgctcgccaccatgtgctgggattacaggcttgagtcccccgcgcccagccatcaaaatgcttcggatttctgcatatgttgaatacttgtgacaatttaaaaaacatgatcatgtctgttggaaggcaaagattgcaagaatcattgagaagttatgcaaggccaaacaatgttagaaggcagtcagggaactatgaaatcgaagtatttgggcacgtgaaggacgaagctataatttgcattcatgatccactaaacgttttatacatcatttctggtatataccattgtgttgtgttctcttcatcaaagggatagtagtggcatccaagaattagtcgcaccattgtgggaacgactgtttccgttgactcagtccaatatattctatgagatcagtgtgagatacccgtgggtccatacagcgctacataacgtaggggctcctgagtttcgtggcatggtagatagttctttgtagcatacctagcgcgtcgatcgagcacacatagaacacttttgttgaagagacactagactactcgcgcccgaaggtcttctagttgctgcactggttcagcacgacgtgatagctgtagagtagtaccaagtagatctagatactggccagcagtagtgcttgagtgaccaagagtcctttgttntccagtcttgagaacaactacatgtggaacacacacagatcgaagcagtttgtgaagctactgtgtgtct

SEQ ID NO: 603594 - DNA, 369 bp, Homo sapiens
gtcgacatataaacaaccagcccatatgctacatcaaactgaaccatcagaacagtaggacattaacatggatctgaatgacaagtcatccatgatataaacaaccagcccatatgccccaacaaactgaaccatcagaacagtaggacattaacatggatctgaatgacaagtcatccatgatataaacaaccagcccatatgctccatcaaactgaaccatcagaacagtagaacattaacatggatctgaatgacaagtcatccatgatataaacaaccagcccatatgctccatcaaactgaaccatcagaacagtaggacattaacatggatctgaatgacaagtcatccatgatgtcgacgcg

SEQ ID NO: 603595 - DNA, 126 bp, Homo sapiens
ttaatcaagcatgaaaattaaaatgtttttgtcaggcattaccaaagtggcacagaatgtgatatgccagcctggttttggggtcctttctcatactggattgatatgcataaaaccttctaaaaa

SEQ ID NO: 603596 - DNA, 2338 bp, Homo sapiens
cccaagcgggggtctcggtgcctgcgaagcggcagtggtcgctcgtgggcccagtgccctctacgtcccgtccgggtcccagctggggcggggcgcgcccagtgtttccgggatggagcggcccgggcgcgcggcaggtgcggcggcgcaactcgcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603597 - DNA, 2418 bp, Homo sapiens
  misc_feature (31)..(31): n is a, c, g, or t
gacaaggtggttgtgggtagggaggggccgntgggcaggagggagaagtctgccctgcctgccagctgtcatgaggctgggccacacaggcccaggccagggctaaggacttggtccaggactggctgagccctcacttgggatcagatctccagttgcagagtgtgaggggctcctccctcactgaccccaagcctgctcctctcagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603598 - DNA, 2333 bp, Homo sapiens
  misc_feature (38)..(38): n is a, c, g, or t
ggcgcaactcgcaggtaggcgaccgctggtcccgccgntgaggcccctccactgccgcccgcccggcaccccctccgggccgccgtggcccgcgccaaacctgagcgtctcggtcgggaactccggttaccccctcggggcgcaaggcggcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603599 - DNA, 124 bp, Homo sapiens
gttacgtatgtatcaaatgtcttcaatatagttacaactgattaaagttgatagacattgtatctatttaaagacaaaaaaattcttttatgtacaatacctgtctagagtctagcaaatatag

SEQ ID NO: 603600 - DNA, 180 bp, Homo sapiens
  misc_feature (4)..(4): n is a, c, g, or t
  misc_feature (58)..(58): n is a, c, g, or t
  misc_feature (149)..(149): n is a, c, g, or t
aganatatggggggagatggttcttttcaaatacttgaactactaccatgcagaagantgtttagaatgtatcccaactcccggccggatgcggtggctcacgcttgtaatcccagcactttgggaggccgaggcagacaaatcatgtnaggtcaggagtttgagaccagcctggccaag

SEQ ID NO: 603601 - DNA, 2331 bp, Homo sapiens
  misc_feature (19)..(20): n is a, c, g, or t
  misc_feature (22)..(23): n is a, c, g, or t
  misc_feature (25)..(26): n is a, c, g, or t
  misc_feature (28)..(29): n is a, c, g, or t
  misc_feature (32)..(33): n is a, c, g, or t
  misc_feature (90)..(90): n is a, c, g, or t
ggcatgtaccggcccgaanncnngnntnngtnngtcgcacgctggatccaggcccttcctgaaaagcagaggccttgtaccccccaggtngcgggcgggacagtgattccagccctttcagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603602 - DNA, 2300 bp, Homo sapiens
  misc_feature (19)..(20): n is a, c, g, or t
  misc_feature (22)..(23): n is a, c, g, or t
  misc_feature (25)..(26): n is a, c, g, or t
  misc_feature (28)..(29): n is a, c, g, or t
  misc_feature (32)..(33): n is a, c, g, or t
  misc_feature (90)..(90): n is a, c, g, or t
ggcatgtaccggcccgaanncnngnntnngtnngtcgcacgctggatccaggcccttcctgaaaagcagaggccttgtaccccccaggtngcgggcgggacagtgattccagcccttcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603603 - DNA, 752 bp, Homo sapiens
gccgtgctcccaccacaccacacccaccgagccctcgttacgcctcttctccgggagccagtccggccaccggcgccgcccaggccatcgccaccctccggcagccatgtccaccaggtctcgtgatccctcgtacctcctaccgcagggatgtatcgaggcggcccgggacaccgtgagccggccgagctccagccggagtctacgtgactacgtccaacccgaacctacagcctgggcagcgcgctgcgccccaagaaccagccgcagcctctaccccctcgttcccccggggcagggagttgtactgcacaacgacggctcacctctgcccggggccgccttacagaaagaccacgcgtggcccgggggatagcaagagactcacttggcacaggacctccggaggggactcttacctcgcactggggcccgatagcctatccacataccagtgagtttcaacgaaactacccccggcaagccaacggagaagggtgacacgcgggccacggaagcctcgacacgtgacccggcgtatgccgccccacacatacactcggcaccacgggtgccgcctacccgggacaccgcagccgaacgtacgaattccgtggcctgggccggacgcgtcgaagtcaagcttccacgcgccccacggcccaggactcgccgccccggggggcaaccatcataccgagcgcaccgaaacatgcgagcacacggcccccggacaagctggccccaagcta

SEQ ID NO: 603604 - DNA, 291 bp, Homo sapiens
gaacttggaaactaaggttactcgtgtgcataaaaatctaaatgaaagggtgtgtccatcaatctgatgctgcaccttgatggggtctttgtggatgggcaggagtttcagtgtgttgggtgttgctccttcctatgtgtcttttgaatctgagctgacatttgctgaagcaacctgtcataagaggcatgcaaaggcatagcagctgtgagttggacagtcagtaatgtgtgcattgtcttatgtgtgtctcagtgatacacggtcgtctgcacccgcttcacacaatag

SEQ ID NO: 603605 - DNA, 2364 bp, Homo sapiens
  misc_feature (38)..(38): n is a, c, g, or t
ggcgcaactcgcaggtaggcgaccgctggtcccgccgntgaggcccctccactgccgcccgcccggcaccccctccgggccgccgtggcccgcgccaaacctgagcgtctcggtcgggaactccggttaccccctcggggcgcaaggcggtcagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggaggtgagcacccggcccctgccctgtccccacggtcacccgtgcactctccccctgtgccttagcgtccccgggttgtcgggagcctggggcacgcgcagcaccccggggaagagggggcgttcctcgccggtctccatccttccaccctccagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacggtgccgtgggacggggctgggcgggccccggtgcgtgtcccgggggcggggccgacgggcgctcaggtctgggccactttcatccccatttcaagtcccaggcccgccccgtgggaaggaggatcttctagggggtccgggggctccccaaggagccttcctgcagccgggtcaccacctcccatccacagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603606 - DNA, 476 bp, Homo sapiens
  misc_feature (189)..(189): n is a, c, g, or t
  misc_feature (203)..(203): n is a, c, g, or t
  misc_feature (241)..(241): n is a, c, g, or t
  misc_feature (249)..(249): n is a, c, g, or t
  misc_feature (280)..(280): n is a, c, g, or t
  misc_feature (293)..(293): n is a, c, g, or t
  misc_feature (301)..(301): n is a, c, g, or t
  misc_feature (303)..(303): n is a, c, g, or t
  misc_feature (375)..(375): n is a, c, g, or t
  misc_feature (398)..(398): n is a, c, g, or t
  misc_feature (429)..(429): n is a, c, g, or t
  misc_feature (440)..(440): n is a, c, g, or t
cagcctccaaaagtgatgggattagaggcatgagccacaaagtgctcaaaaaatctattaattaaaaaatgtgtatgtagccgtctttaatctaccatgtccattagcagataaatactataagcaaaataacagcaatgaaagaaacatagagtagatactctgatttatttaataaaaatttgaaantagaccaaattatnataaaaaaaaaatctgttactattgaggatgagggttngtgtttgnaaaggggcagaagtatcactatttttagtantgttctattttcntacatggntntaagcaaatacatgtgttaagctatccatatttaatcattgtacttttctgcatgtatgatatatgtcaatnaaataaattatatacagcaaaantagacaaaacccccaagaagacatacatgantgttaaacctngagggggaatttgaatataagtaagtcctctgaatg

SEQ ID NO: 603607 - DNA, 1995 bp, Homo sapiens
cccaagcgggggtctcggtgcctgcgaagcggcagtggtcgctcgtgggcccagtgccctctacgtcccgtccgggtcccagctggggcggggcgcgcccagtgtttccgggatggagcggcccgggcgcgcggcaggtgcggcggcgcaactcgcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603608 - DNA, 570 bp, Homo sapiens
ggagaactagtctcgattttttgcgttgtttttctctcgggtacaatattcatttgattcttattcagacgtatttccaaaaaaagcaggggggtcgcggttttcctaaaaagtatggcctttactagaattctcagtatatggttttttattaaaatgccattacatggtattgaccgttggatcggcctacagtacaaaagttacacgcactggggcgtatggtccacattctacagggtacaatctctaggccggcgacatcccgtgctggggcgttccccgacggtgagggagggcagggaaaccgtgaatccggtggatagagcagccgtgagggcatggcgcggagccagggaagagcctcgtgaagtggggagccgtggagaatggacggaggaagggagtcggcattgcgaaacggcaggcacgcagaaagcacacgtgacaggctgtcgtgaaggacaggaaggacagacatctgtgggaggctatccggagaagcacatcccaccatccccttccaaccccgaggagtgccgtgttgcgtgccctcaaagagtgggagat

SEQ ID NO: 603609 - DNA, 126 bp, Homo sapiens
  misc_feature (91)..(91): n is a, c, g, or t
actagacgtacacagaccagtcagatcatgcccatgagagacatcgcccttggcaacaaaaccaaaccttttgtgggcgtcaagatggtangtgcccaccagtcagatcctgtgttacgtctaggt

SEQ ID NO: 603610 - DNA, 1827 bp, Homo sapiens
cccaagcgggggtctcggtgcctgcgaagcggcagtggtcgctcgtgggcccagtgccctctacgtcccgtccgggtcccagctggggcggggcgcgcccagtgtttccgggatggagcggcccgggcgcgcggcaggtgcggcggcgcaactcgcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcggggagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603611 - DNA, 933 bp, Homo sapiens
gcatgtatcacccccgtccggtcttctccacccgaccccgctccgcccgggcccactcccagcccctggccctccgtgtacctcttttgcatggccgagcggccggcggaggctcagtggtcctccgtgcgtcccagaacttcgcccgcggggagcggagaagccgtctggagctggagctgcagatccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603612 - DNA, 89 bp, Homo sapiens
attccaacaaagggttttaatgtagatttttttttgcaaccccatgctggtgattgctaaatgtaacagtcttgtcgtgacgcttctgg

SEQ ID NO: 603613 - DNA, 1940 bp, Homo sapiens
cccaagcgggggtctcggtgcctgcgaagcggcagtggtcgctcgtgggcccagtgccctctacgtcccgtccgggtcccagctggggcggggcgcgcccagtgtttccgggatggagcggcccgggcgcgcggcaggtgcggcggcgcaactcgcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccaggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcgagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagggggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcaaaaaaaaaaaaa

SEQ ID NO: 603614 - DNA, 114 bp, Homo sapiens
cctataggagccttctcggagttgctggccaggcaggcggagcatgcaggctgagctcactgtatgcccgagcatcaccaccacaggacagtccttttctgggaacgtcagcac

SEQ ID NO: 603615 - DNA, 723 bp, Homo sapiens
taagggatggcgagtgctgcagctctatcagcagaacctttctctccgtgtgaggaagagcttttttccggccctttccttttttttttgtttacttttccccttaatcaggaagcactgattgaaagccaatcagagagagctcgccccgcttttccttcggttcccgtggctgtccagagtaaaaaggtgatgctgagaaagagctgagttagatggaagttaaaactcttgtgatagaaaataacagccgaaaacaaacaaaagggggacatagtgacaatttctccggggtaatttgggcgtggaaccaatttccattatccagaagcgtgataaaaacgcttggggaaccatgaccaacaacatggattgaaagtgtgggaaaccagttgaaacacagtaaaaaccaacggggctaaaattaggaccacttctcttcatctacaccggggcatggtcacgaacgttgacctattgacaattatatctcaatattttggcatacgtgtttcataattcggggatatgcctgccaacatttcgtgctatcctccagaaataatgtgttcacgacagcgaccgccggggtgcccacaggcaacagcaacttttcacgtttccacggtgtccccagggcagttgagggcaaattctctaccttcgtcaaacatcggtggtgggcatgtgcgaattcaacttttcctttcctctgacgacctt

SEQ ID NO: 603616 - DNA, 528 bp, Homo sapiens
  misc_feature (1)..(1): n is a, c, g, or t
nccagaaaattaagtgtgttaccactaatgttatgcaagattgccctagttttccatagggagaaaataaagtccatttacccattattgaaaaaattcattattttttaatatccgggctttttctaaagtacaagaaatagctctagcaagctatgggtcatcaaataagaatgattatcataaaagtaaatttaaagtctttttaatccattgtgtttaatctggacctggtcctctaaattgaaaatgaactcatgaagtataaatgggcccaggcactgtggctcacgtctgtaatcccaacactttgggaggccaaggcgggtggatcactttaggtcaggagttcaagatcagcctggccaacatggcgaaatcctgtctctattaaaaatacaaaaattagtctggcatgatggcgcatgcctgtagtcccgcctcctcaaaagactgaggtaggataattgctttaacccaggaggcagaggttccagtgagccgagattacacctcaaacctccagcc

SEQ ID NO: 603617 - DNA, 1176 bp, Homo sapiens
agcgggggggcgcctttggagaatcggcgggctgcgctccgctggggctggtcgcggagtggggggaggggatgtctggtcagtgcgagatccgctgctgcttgaggagaggagcggtcgaaccagcagcaccactggattctcttctgtttggcaaatctggaacactggaatgatggaaactgtgttctcttacaaagtagctcaacagaagaaccttgaaggctatgtgggattgtgccaatctcccaaatcaggtatacagaaaatcggtgaagagaggttgtgcattcacgcttatggctagtgggtgaagtctggactgggaaagctcgacattaatcgagctcattattcctcacagaacttgtattctccagagtagtccaggtccttctcatagaagttaataaagactgtacaggtgtgaacaatccatagttgtgatcaatggaaggtggtgtgcagttgctgctcacaatagttgatagcccaggatttggagatgcagtggataatagtaattgctggcaggctgttatctgactacattgatggtaaatttgaggactacctaagatgcatgaatcacgagtgaacacgacgtcagatgcctgataacagggtgcagtgtcgtttatacttcagtagctccttcaggaccactggacttagaccattggatattgagttcctgaagcgttgcctgacaccgtgaatatcatcccacttgttgccaaagcaaacagcatctgcaccggatgaatgccagcagcttaaatgactgatactgaaaggaaatccaggaacctaaacttaccatattcgaatttcagaaccagatgatgaacaaggcaatcaccttgtcacagactcaggaccgtacccttgctgggtatggtacaataccttccctgtgaaattaaagggcgacaggcgtcgcaaggaaggggcctatccttgggcggatgtgcacctgtacacgtggccacccatggtgcatttgcaccctctatgaaaatgtttgcatgaacagccagttccggagctcacaagctgctacacagtccctttcaaacctacatacacgactgccatgtgcagctctcggcttgctacaccacgaatgccccgtatatcccttcgtcattttcttaactgccctttttccaccgt

SEQ ID NO: 603618 - DNA, 167 bp, Homo sapiens
caggactatgcactgtagatcgctcactgtctgctctattctcgcagaaagagtgatggcagaaggctcagtcagagctccactactgctgctttcaccggactcttcatagtctgggttgcgtgggtgggcagagacatctcggtgtcgcggcaggtacacctgca

SEQ ID NO: 603619 - DNA, 525 bp, Homo sapiens
atttctcatcacttcttgctaagactgacagcaggtaattgtaatgcagatagatgcggcgatccccaccttcagtcatgtgatgccaaggcccccaacacaccatgtgcagaagagctggtggcagtgaatggctgatgctttcttggggagctgggccatcttcttcggttttaccttcctgaggaattcacacggcttccagcgaggggggaggttgatcacttttttcagattagtaatgcctgcgacatactgtggtcccaaagtatttttcatatgttgttttgccatggaacctggccagacactcagtgttgctcattgaacagaaggttttgggtttcagactggaataagcagaaacttgtccgggcagtcagatccatttctcccaaagtttagcctgttggtggagcaacacctgtttcaggcgttccaccttatccatccgagacaccacggcatgattcggggccatggcaagatggcagcttctagcctcagtcacaggcttccgtttgc

SEQ ID NO: 603620 - DNA, 321 bp, Homo sapiens
  misc_feature (213)..(213): n is a, c, g, or t
  misc_feature (249)..(249): n is a, c, g, or t
  misc_feature (260)..(261): n is a, c, g, or t
  misc_feature (267)..(267): n is a, c, g, or t
  misc_feature (273)..(273): n is a, c, g, or t
  misc_feature (280)..(280): n is a, c, g, or t
  misc_feature (286)..(286): n is a, c, g, or t
  misc_feature (295)..(295): n is a, c, g, or t
catttaggtaccgtgaagcctttcgcgtttttttacggtgcatgatccgatattttgatttgagagagacactccattctcgaaggtacgtaagaagacacatacatctaatatcttttctcgtcgcatctctcttgtttaacatttaatactggaattaacttttatgcaaggtgtgggaccatgattcaattctatcattttatattctcnaatcattacccagtattttaataccataaatggacnatccctcttgnnttgtgnatttanacgtacnctgtantagataaantacactcatttctgtgcccatttcaa

SEQ ID NO: 603621 - DNA, 1425 bp, Homo sapiens
  misc_feature (124)..(124): n is a, c, g, or t
  misc_feature (453)..(453): n is a, c, g, or t
  misc_feature (603)..(603): n is a, c, g, or t
  misc_feature (700)..(700): n is a, c, g, or t
  misc_feature (726)..(726): n is a, c, g, or t
  misc_feature (1002)..(1002): n is a, c, g, or t
  misc_feature (1047)..(1047): n is a, c, g, or t
ggagagatctcaggctgacctgatgctggtgctgtagtcgtctgtcatgctggtcgtcggatgaaataacgaagctggtatctcctggaattagggacggatcccgaagaagacagtagccctntcgtgagtctatcagcatcaactgagggtagatgagacccacagtgaattccgtccggtagtatacacaaccagtggctccctgatgagcgcacctctaacgaggactacgcataagaggtatatcgatgcgcaacattccgtctaaggggtataccctgcgaggaccatctttcacgattgaagagacccgattagggctctatcgaagcccccgcatccagcagggagctcgttgggctgtccaagtctatctcggttcttggaaaggtgcgctaggacatggcagttggcctagtgtcggccaatgaggtcgcatttaacctagtnggcccatttggtgatctgctacacgtgggtagtcgcgaagagacgctacagctccccgggtgagaaagtggagtggcgacaataatcgaccgcagggtgggcggtataccgctagccgtcgtggcactattgcaccgtgacctaccgtcnaggaaacttggcaagtccccttgatcccaaacacgagacacttcagggtctgccgacagcgttggcacttagaggctccccgttgtgtcgcgtcccntagactcctatcggttcccaggacgngtgaagtggccttctttccaccaagaaagtcctcaaggggctagggggtcatagtgcgcgggtcaacccttgtcttacctcctgtgcgcataaagcggtccacggaaattgactgcgccaagaaccggtcgcgctaagcgtgttcggttcccctcaggagcgcctccgcgttttaactggggggttggggggttacctaacttcctctaatggccattttccgcaaaagggtgccaataagccaggattgtaaaacccagacaagcttgcgggaanaacggtaaaaatgaacactccctttgtgttccccgcacactgtgntgtccagctcggaagtctgggaaaggggcactcccccgcaaggcttcggacacggcccatttcctccttcgcggttcgggcggtggcagagccagactgggttagcgttaaccctgtaacgacattttgttccccacgtaaaacatcgtgaggtttcgttcggtaccaacccgggcgattttgtgttcccgcttccggtaagggacccagatcggttgtaaaggcctttgggcttggcgctggggacctaccaagtactttggtggcccgcccactcgccaaagtgggggccaaatcgctcggcgtcttggggacgtatcacctttgcgcggcaccggggtgagaactccaattcccccttaaaaaacgcatccccga

SEQ ID NO: 603622 - DNA, 142 bp, Homo sapiens
aattaacattcgtgccactccatcttcaaaccccctcactttcccatcctactcctgtcatgcatgagtcatgcattctgggggtgagctctgcggtttaggtggcccgctctatcattctcaacccatgaggtgccgtagc

SEQ ID NO: 603623 - DNA, 285 bp, Homo sapiens
  misc_feature (126)..(126): n is a, c, g, or t
atatattaatgttctccgcaggttagtgaaccaaatttccaaataaaagaacttagttgctacccaaacattcgtaactgcagaatcaattctggatttgccaaacgtgttcgacaagataattcnagtgaggagcgggtgcgagaaaacaaaccaacaactggaacataaaagaaacatcgtgtaaaataaatccaagcatgggttagaaaatttggaagaaatatttcaaaaggaaatctaagataaatcacttcaaagccaagcaaaatgaagttgatcatt

SEQ ID NO: 603624 - DNA, 849 bp, Homo sapiens
  misc_feature (33)..(33): n is a, c, g, or t
  misc_feature (69)..(69): n is a, c, g, or t
  misc_feature (80)..(81): n is a, c, g, or t
  misc_feature (87)..(87): n is a, c, g, or t
  misc_feature (170)..(170): n is a, c, g, or t
  misc_feature (175)..(175): n is a, c, g, or t
  misc_feature (184)..(184): n is a, c, g, or t
  misc_feature (193)..(193): n is a, c, g, or t
  misc_feature (204)..(204): n is a, c, g, or t
  misc_feature (211)..(213): n is a, c, g, or t
  misc_feature (218)..(218): n is a, c, g, or t
  misc_feature (220)..(220): n is a, c, g, or t
  misc_feature (225)..(225): n is a, c, g, or t
  misc_feature (276)..(276): n is a, c, g, or t
  misc_feature (307)..(307): n is a, c, g, or t
  misc_feature (310)..(310): n is a, c, g, or t
  misc_feature (313)..(313): n is a, c, g, or t
  misc_feature (316)..(317): n is a, c, g, or t
  misc_feature (323)..(323): n is a, c, g, or t
  misc_feature (333)..(334): n is a, c, g, or t
  misc_feature (380)..(380): n is a, c, g, or t
  misc_feature (397)..(398): n is a, c, g, or t
  misc_feature (424)..(424): n is a, c, g, or t
  misc_feature (469)..(469): n is a, c, g, or t
  misc_feature (488)..(488): n is a, c, g, or t
  misc_feature (505)..(505): n is a, c, g, or t
  misc_feature (573)..(573): n is a, c, g, or t
  misc_feature (765)..(765): n is a, c, g, or t
  misc_feature (783)..(783): n is a, c, g, or t
  misc_feature (785)..(785): n is a, c, g, or t
  misc_feature (821)..(821): n is a, c, g, or t
gataccttctgaaatgtttcaggcttttaaacncttctatttacacttatctgacatggaattaaaacnaaaatggtcanntaccangataatagaaagcaaccagccaacatagctaggtcttctcttaaatttgctgatcaacattagcagtagttaccttaataatnaattnttcattttnaaatccgtngtaactttagncaattcnnnaatangngtgcnctgtgcaatttacacgtttaatatcctgtggatactaaaagcttgtatatngtcaggtttgcacattattactttatcaaanacngtnagnnttcccnaaggggaggnnggggcaacttgagagggtattctggggggtctctggggggttatcnaagctctgcctgctttnngggaggaggttccaatttacgcgagngggcagttaaaatctggttgaatttctcatatctctctgtctgantgacttgtgcacctttgcngccccatagcaatcgcntttgaaattcagtcttgcagatttcattcatttcttcatctggttgaaaacctgccaggatcctctcngcattcctccggtagctgtctgccgcctcggccatgaatcgcgctgttgccaaatggttcagcatgatttcacagctctggtcgtttttttcccacatgtcggttccttcaaaagtcacagcctggcgctccattaacgtcacaagcggcatcagcagtgggactgatacattgtttgggggaacacatgtngactctctgccttcatgnangagtttgctgaagggcttcagctgtttctcataganaatggcagtgtgggtgtactggtgccgc

SEQ ID NO: 603625 - DNA, 398 bp, Homo sapiens
atgcttgctcctgtgaatgtgcttggctctacgattgggcctcctaatactctgaagactaacatccctttgatgctgacctcccagaaggttcttcctcctctgaatgaccatgttcctcaaccaaacttgggtccttgacacaatcctactgacggggactatcctcttgaagaggcccttccggttccacgggcccccttggttcacagaccgagcttttatcatcaacctcattgttatcctaacctgcactgtacccaaagcctgggggataggatcctgcatactggggaagtagcccctccatggaaagctcactttctccagcgaaatggttcacctccattgcctgaaccacctacggtcccacgatcgggtatagacaagggatcctc

SEQ ID NO: 603626 - DNA, 280 bp, Homo sapiens
tattctgttgaaaaccaaccaggaactatttattaaaaaactaaagcaatgtttatccccaagaaggttgaagcaccgctggtgggttctgactattcgattcaggctgaaggcacggcaactcttccagcctcttgcggggaaatgtcctacccaggccacgggcagtgccccagtgcagtctggttcccctaaaagcccccaaacacttgttccccccaagggcttgaccagagcaattctcatcaagcaggcagggcccaccccttgagacacaggg

SEQ ID NO: 603627 - DNA, 159 bp, Homo sapiens
aatgacctacccccggttaagacctggaaaacatcatcgccactgtaacacgaggctgcctgagttctcagagctgcagggctgtttccgggaggagctcatgtactccttcaccagtgtgcagtgtgcaatggcctcacatgagctcctcccgtgaaa

SEQ ID NO: 603628 - DNA, 895 bp, Homo sapiens
agcgggcggctgcaggcgggctcacctccgcggtccgcccgggcgccccgggacccgttagtgaccagactgcgtggtcgaacgggagccctcgaccggcgcgagcttgctcccagaccgtcatgctcgatgactatgacgccagatcagtgccaactggctcactagatgactgggcggaccgggcgggagccggcgcgagagaggcaggcaggacagggagtgcgaggagggagaaggaagggccagagctcgggcggtgacggggggagaccctggttctatgaaagcccggcgttctctggcccggatgcttgagagctctgtcggcccaagcggcacatatttctgttcctgctatgggacctatggtcccaactacaggttttgcgggatgccaatcgggtgtacactacgccctcactggggatgcaatacttgtggcctttctacttctagtgcaagtgtagcaaaatataatatgcttggacacgaggtacttggtacacatatgtaagataagtcatttcaccggactgcgaccgtcagcgaggtacgttagattcctgattgccacgctacctgcattcatcgctctcttgctgcctgtctacaaagctgggactaggtggccacgatggcatctggatttcttggaaccgcatgggagagaacgtgctacataggggtcggaacaatagcatggaagaagggtcgtcagaatcttttagaggaacgccaaaggtggatacgtagcgaaaagtgaagacatcacatgagtaggaatgaaagagaaagagaagaccatgaatgggaaggaaggaagcaggagctgatagccaacattgaggcgtcagggagatcttgcgtgtttaagaagaatttgcgtagaaga

SEQ ID NO: 603629 - DNA, 81 bp, Homo sapiens
gggtggcctcgtggtgctgtcgtgggtgctgtgtcttggcgtgttctcctacgtgaaggtggcagccagctccctgctgca

SEQ ID NO: 603630 - DNA, 1209 bp, Homo sapiens
gtatctgggaactgtgcctttgagtttcctcaggcgtgctggatgtgaaaactgagactcagacaggaaagggaaggccccacatgacaatggtagccctaggccacgcaggctatgtattatgatctatttgtgtttttactagaggtgtgtgatatcccatatgcatgcctaggcatagaccattgcaactccatgtggctcaagcagatctacacctatctctcagcactccgtgatgatacgctgggattcatagatttggagccaccatgcccagctcagagggtttgtatctcctagactgaccctgatcagtctcaagcatgtggtgtgggacgtcctgccacctggggcaagtcacctgaccagatcccagaaggacctcactgagacgactgactcaagatgtctcagtccacactgagctgccatccagggatgccatctgtgggcacagctgtggtgccggtgagagatgctcagaaacatcaagcactatgggagagatctcggtagtgtacagtggatagaggattacggtgcatgaagaaaggatagagtggaggcattgcctggacccccagcctgcaggcgataccaggcagaagagtacacagccacaaggaccggcacagtcccccgacgacacaaacatggagaaacaggacgcccagcgaaacacgaatgacacccacaagcaagcacaactgggcgcatcggatacaaacaagcaacacacaacgaatccgagcgaacggatgacacgggcacccagcacagccaccatgacacacaacataacacacggtgagaacacataacacgcacaactgacaaacaaaacaaaccaaagacaaacagacttgcaaaaaaccggaccaaaacaaaaggcggactagaaaccccaatgaaacgagccacgtaacattaacagagacagccacacacaaaaaacaacggccaaatctacccatagaaactaagaccaacaaccaggggagccaacaaaccaaccaatcatatgacaccagtgtgacgaagcagtgccataaaagacctgagacaagcaatagaaaccgatcgggacccaaaagcaaaccacaaatagaccagaagtgacaacaaaaaaaaaaggaaacaaaagagacaaaacaaaaaagaaaagaaacgagaacatgaagaccaagcaaacaccgcacaaagcaa

SEQ ID NO: 603631 - DNA, 163 bp, Homo sapiens
tggtatctacaggattgcgacgggatcagtcgatctgaagactgagaacggtacactcagaaggcagaggcgcgcaattaccactccgaccggaggtagtgacgaaatacatacaggatctcgaggcctgtatggaatgagtcactttaaatccccgcgtcga

SEQ ID NO: 603632 - DNA, 100 bp, Homo sapiens
tgcacacttttgtgcatcatggatttcctaatatatcatgcgactgaattaaggagaatggcctaagtgacttccctagtttgttctgctttatcattgc

SEQ ID NO: 603633 - DNA, 782 bp, Homo sapiens
  misc_feature (782)..(782): n is a, c, g, or t
tcccaccaggcaacccgatccgtatcctggtcaagccctgatggagcgcatcacgggtgccgtcgcgattcgttgtggcggcaccttcgcgttgggcggcatcaatccatgcagctgtgtgcaacctctgtgtctgagcgaaggcctacaattcaagggttaagtcccggatcgaccgggattgctgcgacgcgcatcctgccgtcgcggcgggaacgtcggcacgatgccaggagcttcatgacagtactgaccgactttcttgccacgcatcaactgctgacgatcctgatcgtcctggcctccggcgccttgctaggccaaatcaagtttggcccgttgagatttggtgccgctggagccctgtttatggggctggtcgtcggggcccttgatcctcgcttcggtcaaaacctggggatgatcaaaggcctaggcgtcgtgctgttctgctacaccgtgggcctggctgctggatcgaccttcttatctgacctcaaacgtcagtggggcctcatgctcgccggtgtcgtcgggttggcagtgatggccgcagctggactcggcctggggcgactcttcggtttaaccccggctcacgttgcgggtctgtacgccggtgtcctcacctcaccagccattgacgccgcatcgatggctacccatggagccgcagatactcttgtggggtatgcgctgtcctatcccgtgggcgtcgtcgtcgggctcattatggtcgcaatcattgctaagagatgctgggccgcccacaaagacaaacn

SEQ ID NO: 603634 - DNA, 1001 bp, Homo sapiens
gatggtaggtaattctctaggatccgacaatgcgtacgttgcgagtcgcccctgagtatcatggccagatgaatactcacgcattgcgcattgaggagtgaccactcggacgcctcgatgctttacgaaaaaaagagtttcttgattaaagtctcttgacactcagatgtgtatgttccttgaacagggcactacggtcatgtgggaggcattccggtgcctcgtctggtatacatgccgtggtcaacaacttgaaagaacgttgcagcaagctgggcacgcacttcatgaaggaaactttgtggggagatgccactgcaggcttatgaaacacatcctaaggccagagatatacctctagttcttgaaccaatcagtagcaatagctttacaagtaaccgttggtgagactggcctacataacgcagtttaaccaaccaggaatcttgttccgtcaacagttgagaccagtggtgttagtgtgccaagattgcttcctttgtgcggcttgatagaggagagcagagcgagcaagagaccgagttccacaaactcctgttgagaacgctcggctggtgaggcctaaaattgtcacccgttcatattaacctgaactatggaaacctgggacagccactatgttaaacgaacgagtcttgtgttggccatatagcgtagactacagagttgtccccggccgttaattttgcgcctttttgcttgcgtgacctgtttcctaggtatagagttatcaaaacttggcctgtgggactttagattaactggcaaagttgcaggattataattttatcatcctgggaagtccatggggaaatcatcaatagacacaagaaggggtaacgggggagacccgtcatagggtgctgaaattcttagaacattctggtggagggtatcccttggcgttcaagacggcatggggcgactttccaagggtcaaaagtttgacccatttggagggagttggtttaaacgagtag

SEQ ID NO: 603635 - DNA, 871 bp, Homo sapiens
cactcattcttcatctatgagaccttctacaagctggtgaagatcttccagcgagcaccccctgtcatggcgtgctcagcctccaacagctcatgaggtggacggcggtgagaacatgacatgggccggggcaagaacgccacgctggggccgggcaacaggagcttggttgggcagtctgggcaggggaagccccgtgcggccatgtgccatagcacggccctgctgctccgccgtggtgctcatggcgcggcaccgttcttcactcgccttcgttcctgcgcaatagttcgaagagatcagccgggttctttcctggccgggactccggcgggtgattggggactttggggtgcccagtcgcgcatcctcactcatggtgcttgtggattacagtattgaatggacacctatacccagtaagctgtagcgttcccagtggattctcgtgtgactgccccagtaaaagaggggctgggtcatcaactcccctgggagagaagagccccttccctgtgtggatgatggttgccagcctgctgcccgcctatccgtggtcttcattgctcatcttcatggagacacagatcaccacgtccgtcatcatctgcaagaaggagcgcatgctggggaagggctccggcttccacctggatctgttgctcatcgtggcctatggtgcggcatctgtgccctctttggcctgcctggttggttggtgccactggtcgtctggtcactcagcgaacgcgctcactgtcatgagcaagggctgtggcactggggacaggccaagatcccgacgtcaaggcaccgggggaacgggctgtggttgcctgttgtggccctcccatacgggatggcgggaccc

SEQ ID NO: 603636 - DNA, 387 bp, Homo sapiens
aatccgcgcagctacctgaagccaacgcggcctgtttaccggcaagtcagagcaaggcgtgagtttctgggctgcgatctatatcccgattgtggtggcgatggctgcccagcaaaacgtgtatggcgcgatcagtggtgggcctatggcgattctggccgggaccctcgccgtgctgctgggctttgccctggtgcccgtgctggtgcgtatcggtcaccgcgagccggttgcggttgctcccactaaagaagcggggtgatcgccatgtacgaatcgatgatgaaagtgatcaccggctacggcttgatcagtggtttcgccgtgatcggcctgaccatgtgggtgtcttattggatctccgataccttcaccaagggccgcctg

SEQ ID NO: 603637 - DNA, 782 bp, Homo sapiens
  misc_feature (16)..(16): n is a, c, g, or t
  misc_feature (34)..(34): n is a, c, g, or t
  misc_feature (49)..(49): n is a, c, g, or t
  misc_feature (51)..(51): n is a, c, g, or t
  misc_feature (60)..(60): n is a, c, g, or t
  misc_feature (79)..(79): n is a, c, g, or t
  misc_feature (95)..(95): n is a, c, g, or t
  misc_feature (106)..(106): n is a, c, g, or t
  misc_feature (118)..(118): n is a, c, g, or t
  misc_feature (124)..(124): n is a, c, g, or t
  misc_feature (130)..(130): n is a, c, g, or t
  misc_feature (154)..(154): n is a, c, g, or t
  misc_feature (156)..(156): n is a, c, g, or t
  misc_feature (166)..(166): n is a, c, g, or t
  misc_feature (169)..(169): n is a, c, g, or t
  misc_feature (185)..(185): n is a, c, g, or t
  misc_feature (188)..(188): n is a, c, g, or t
  misc_feature (191)..(191): n is a, c, g, or t
  misc_feature (194)..(194): n is a, c, g, or t
  misc_feature (202)..(202): n is a, c, g, or t
  misc_feature (204)..(204): n is a, c, g, or t
  misc_feature (207)..(207): n is a, c, g, or t
  misc_feature (217)..(217): n is a, c, g, or t
  misc_feature (221)..(221): n is a, c, g, or t
  misc_feature (227)..(227): n is a, c, g, or t
  misc_feature (229)..(229): n is a, c, g, or t
  misc_feature (235)..(235): n is a, c, g, or t
  misc_feature (247)..(247): n is a, c, g, or t
  misc_feature (255)..(255): n is a, c, g, or t
  misc_feature (263)..(263): n is a, c, g, or t
  misc_feature (267)..(267): n is a, c, g, or t
  misc_feature (276)..(276): n is a, c, g, or t
  misc_feature (280)..(280): n is a, c, g, or t
  misc_feature (291)..(291): n is a, c, g, or t
  misc_feature (306)..(306): n is a, c, g, or t
  misc_feature (310)..(310): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (354)..(354): n is a, c, g, or t
  misc_feature (358)..(358): n is a, c, g, or t
  misc_feature (363)..(363): n is a, c, g, or t
  misc_feature (374)..(374): n is a, c, g, or t
  misc_feature (398)..(398): n is a, c, g, or t
  misc_feature (403)..(404): n is a, c, g, or t
  misc_feature (409)..(409): n is a, c, g, or t
  misc_feature (431)..(431): n is a, c, g, or t
  misc_feature (446)..(446): n is a, c, g, or t
  misc_feature (452)..(452): n is a, c, g, or t
  misc_feature (467)..(468): n is a, c, g, or t
  misc_feature (482)..(483): n is a, c, g, or t
  misc_feature (501)..(501): n is a, c, g, or t
  misc_feature (716)..(716): n is a, c, g, or t
  misc_feature (719)..(719): n is a, c, g, or t
  misc_feature (781)..(781): n is a, c, g, or t
tggagctttgcctctntaggccggcagcgctctnctccatggtcctgtntnttagcgctntttttggagcccgccggtnaggccgggccacgctnagacactttgnttgttgagtttnttactnggcatngcgggttagttttgcagctatgtntnggacccgctnctnatttttttgcagattnttnttnttnagaccgtntnttntggcttgctnggcnttttgntngcgctngttgacgggctnttgcgaanagcccctngctngaccagatntttnacgccgagatntttggcttttttacncctncaggccggctnttnattnttttttttttttttaacgcccttacntttnccctnggctttttttnttttttttggcgaggaaagcagtnttttnnttttntttttattttttattttttttnttttttgggctgttngttttncagtttccgttttcnnttggcgctgacctnntggttggttcaagccgtntgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctnttngtgtgggagagatagtgagggcctgtcaaagaaggcaggtagcagtcagcatgacagctgcna

SEQ ID NO: 603638 - DNA, 359 bp, Homo sapiens
tatatgtgatcaacagtgccggttaaaatgggcatctcgactggggctgcgctctcgatgatcaactgcgcttttttgtcagccatgtggcctcctatttatgcttcaaatcatcagacagaccccccacgcagtggcccgcaccactatatttgatataaatccagattgtcaatttgcctaaagtcttgcgccataaggctttaaccgtactttctcgtcgaaattgactgccatttacgccttttatcccgacagcgcaatcagctattcgtggccagaaggatccttctggacacgctgataagctgtacccgctcagtgtattactgggatattgtcgtccagagagttgggta

SEQ ID NO: 603639 - DNA, 123 bp, Homo sapiens
gcggccgcctactactactactgctcgaattcaagcttctaacgatgtacggggacatgcttgggttttgtctttaaccttgtaacgcttgcaatcccaataaagcattaaaagtcacgaaaa

SEQ ID NO: 603640 - DNA, 137 bp, Homo sapiens
aaaatacaaaaattagtcaggcgtggtggcgcacgtctgtggtcccagctacctgtgtctgtccatacttttgcaggatatatccataggataaatgtcaaacagtggaatcattgtgtcaaagggtagtatacatt

SEQ ID NO: 603641 - DNA, 108 bp, Homo sapiens
ccccactaaatactaccgtatggcccaccataattacccccatactccttacactattcctcatcaccaaatatctcatcaacaaccgactaatcaccacccaacaat

SEQ ID NO: 603642 - DNA, 191 bp, Homo sapiens
tcactttatcttcttctatgatctaaccatattacttcagacctcatacatcgcttacttctttatcacgttccttctccaccataagagtaatgagatatccaataaactgagaatgtatcttcacaatctcctatattcttcgttcctccaagtactcagttaggtcttccgtaatacataaccgtctg

SEQ ID NO: 603643 - DNA, 370 bp, Homo sapiens
  misc_feature (79)..(80): n is a, c, g, or t
  misc_feature (284)..(284): n is a, c, g, or t
  misc_feature (324)..(324): n is a, c, g, or t
  misc_feature (355)..(355): n is a, c, g, or t
atttttattttttgagatggcgtttcaccctgtcacccaggctggagtgcagtcgcacaatcctggctcactgcacctnncgcctcccgggttgacgccattctcctggctccgcctcctgagtagctgggactacaggcccgtgcctctgcgcccagctaattttttgtattttttagtagagacggggtttcaccgtgttagccaggatggtttcgatctcctgacctcgtgatctgccctcctcggcctccctaagtgctgggattacaggcatgagctgncgcactctgcccaggttcttatttttaatagaaaagagancagggaaggaacacaggtcagtgtgaggaanggggtcatggtagac

SEQ ID NO: 603644 - DNA, 332 bp, Homo sapiens
ggatccccaagcagttatacagactcaaactgcctagggtggggaggtgggggtcctgcctctgccattgccagacccaccacctatctgggccttagtttagacatccgtaaaatgcagacagtagtttctatctcagagggtagtgatttaatgagcaagtgcatggtgaattgcttagcaaaatgtctggctcgtgctgagcagtttttggtcaaagtctgtatattgggctacgtacagatgatgttctagatattttatgatttaaccattaagaactaatttggcatatttgagcaaaagaaaagtgagtctgtattaactgcttg

SEQ ID NO: 603645 - DNA, 104 bp, Homo sapiens
tgatgcgaggcgactctaagatcccttcacaactgtacaagaagcacgtatctttaaatgtgtgtcttcacagtattaagtatagctattatatatggacctga

SEQ ID NO: 603646 - DNA, 133 bp, Homo sapiens
tatggtgtcatccccatctgtgaacatctgtggtcaccaggtgcttctgagcaatgtgaactcaggggccaggaaagcgaggccttgccctccgggagtccctttcccaaaggggcattactgggagatattt

SEQ ID NO: 603647 - DNA, 303 bp, Homo sapiens
ccggagtatttgggaccgggagacacagaagtacaagcgccaggcacaggctgaccgagtgaacctgcgggaaactgcgcggctactacaaccagagcgaggacgggtcttacaccttccagaggatgttttggcttcgaccttgggcccgacgggcgcctcctccgcgggaataccaggttcgcctacgacggcaaggatacatcgccttaacgacgatctgcgttctggaccgcgcgaaacgcgctcagatcaccagcgaagtggaggcgccctgagcgacagcgagagctactgaggcac

SEQ ID NO: 603648 - DNA, 267 bp, Homo sapiens
ttttttttaacccccccattccccggggggccccccccccctttttttttccccctttaaaaccccggggggcgttcccccccccggctttttttttgggggggggggggggttccttttttccccggggaccccctttgccccttgggccttttttggggccccttttaaccagttttttccaaaaaaccggggggggccggggcgggtttttccgggttttttttcccccccgggccccccccgggggcccccccgggggcccga

SEQ ID NO: 603649 - DNA, 1540 bp, Homo sapiens
  misc_feature (1092)..(1092): n is a, c, g, or t
tggaaaaagtctggggggccagggggtgggttgtgaaaccagtcttggggggggttcgaattcctttcctttttgtgggtcatagaatttaagtggtatatagcgggtttcttcgaagtggtggtggataggggtgggggcgcactccaatattagctcacctccgagggttaagtgggagggtttcttcatacatattaataggagacatattctcggcttctcgagaagcgcgagaagggtgttctttaaaaattctaatagaaaacactttatttaatatatttacgtggcgtggtgataagagagaaaatgagaatggagggccatacagagatgagaatagagagaaggtggtgtcacagtgtgtggggtgtgtgatgcgccacctcgcgagggggataagctcccgagagggataaaccgggtgcggggggggccattactcccgggagaaatagtgcggccccgagaagacaagcgcgtgtgctggctgggcgacaagaaaacaggtgtaagaatattacaacccgcgcgagactgggatatactatgcgcatagcagggggaaaagagggggggcatacgagggggggctccaagcgccaaggggggtcccaaaggggtgggttaaacgctcggcggagaaaaatcgacggggcggagaaccaaaatccccgagggcagcaattatacagaaaaacgccctctctcccaaatacgaggagaggtggggagccacaatattgaaaccaacgggcttcgcccctaaaattgcgggaacagaggcgggaccaacatcaaagaggggggcacccaggtgcgggggcgcctaaaaaccacaagcggtgtaaggatacagccggcgtgggtcaccgaggaggtcgaagaaacaagcggcaagaggtccccaaaagcggtcggcacgtggaaaggtaataggcgcgcgaaaatttttaaccaacaattgggggcacccaaggacgacagaggcggcccacacccaccataaacggggggggtgcaaaaacccagggcgcaacacagcgatcaagtctgaacagtctactccaagaagggggggccatccgnaagaaaagccgccaccgcgtgggtcgaggccgacgagaaactaccacgtcgttcaggccactcagatgtgtggggcgactactcccccggcggtatgacaaaaggacgaggtagtgaggcagcagaaagaacggcaactgcaccggcggcagtcaagccaacattaccagcgacagcagaaaagagcaacacacacaatagcagagtatctcacgcgaacaggaggacgaccaccactatcaaatgatagcacgcgggcagctgatgaccgccgggaagaaaaaaacacggagagcgaggtagccacaacttgagacgcaaactgtgtggcgcccccacacacgtgggtgcccccatcacagcgagcgcgagggatgaaccagaccggagcagcaacccacgacagggcgcttcgcccgtgtggtgatacaacccacacgccggcggc

SEQ ID NO: 603650 - DNA, 260 bp, Homo sapiens
acgagccaccatgcatggttaattttagagccactgtgcctggccaaggttttgaatatactaaaaaccactgtacattttaaaagggtgaattttattatatgtgaattatatatcaataaaaagcatgaatttttttttttttttttttttttttgagatggagagaatatccaagaacgatggtacaattaaatcatctaacacatgtgtcattagaatcccagaaagagaaaatggggcagaagaaatatttgaag

SEQ ID NO: 603651 - DNA, 375 bp, Homo sapiens
accatgaatttgtacactgtgccccagagattgaaaagttatttcagtctgttgcacagtgctgcatgggacagaagcaggctcagcaagtgatggaggggaccggtgccagttagatgaactgtgtatatcccttgcagatgcatcagccttggtccgctgaaccaagttcataaactgaagattcctcctgactttcctagccctttggttctcaggggtctgccccaccaactgctggggttgatctcctgtctatgtgggcaagttccaaagtttaaatgcattttttttttgactcttggccaaaatttagaagatgctgtgaatatcattttgaacttgtgtaaatatatgaaagagaaaaaaaaaaaa

SEQ ID NO: 603652 - DNA, 166 bp, Homo sapiens
tgtggcgctctgacggtcccctgtgaggttgtggcggttgggacggctgtggagacgacacgtgacgcacggtgctcttgaaccctgtgctcattatgcaattttatccgtaatttgcacttagagtttttacgccacctcttttgttgtccctgccacaactcta

SEQ ID NO: 603653 - DNA, 726 bp, Homo sapiens
gccgagcgggtgccgggtgccgggcgcatggccatcaccgcgcggcgcgcagggacaccgtgcgtaccggcctgctggcgcccggcaccggtgagtccccggccgagcccaggagcgcctctgacccgctgcgccgcgcggcctgccgccccgccccgccccagctggatcttgcgctccgacgtggccgctcgggggcggaccgcggaacccgaggccatgtcccatgaacagagttactggtgtcctggggacgacgtagtcctcacaacaagagaacgtggatatcccggggggggccaccaagaacacagatgcacgcctctaatcgtaacgacatcaccataaacataggggcaggcgataacacgagaagggaccacggaataagcaaggagagacaaagaaaaagagcaaacagagcaaaacagaaagcagaagacttgacgcccagcgcgacactgcgcggggcgcaagcgtgggaacagatgaacccaccaatggcgaatacccatgagagccagtgcggagactcgagcagaacggaagagagacagaagacccagatacaggtcgatggaagcggctgtgaaagaagacgcacaacaaagcgacaccgcgcggagcccaggatggagcaaagaacgcaccgtcggactgacactcctaagatcacgcggatccgagtcgcttgctgcccgcgcgacgctgccccctcatacgccc

SEQ ID NO: 603654 - DNA, 295 bp, Homo sapiens
tggtcctgggcaatggagtgatatctgctattttgaacacctgatggacatgtgaagaaccgagctaagtggggccttcttaagaatatccagtttgccctcctgaagcacttctgagctccggcagttctggaaacaacctcagactcatcacaaagtagacatatacacacacatatatgtatgtatatttttctcaccatattcttcaaggaggttgttgacaaatgttgccatgacctcgcagttttccaacaggaatcttgtaatagctattataaggaaatacctgaat

SEQ ID NO: 603655 - DNA, 193 bp, Homo sapiens
ttactggtttgcagcggtactggtttgcgttacatggtttgcagcgagggaatgctggaacattgtaatgggtttggagacatgtcatataagttatgctaaggtgagtggtaagaagttttatcatagcgaagtgtatacacttggtcgtagcggaatcgggggtatgctgttcgaattcataataacaggt

SEQ ID NO: 603656 - DNA, 1132 bp, Homo sapiens
  misc_feature (7)..(7): n is a, c, g, or t
  misc_feature (17)..(17): n is a, c, g, or t
  misc_feature (19)..(20): n is a, c, g, or t
  misc_feature (27)..(27): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (94)..(94): n is a, c, g, or t
  misc_feature (111)..(111): n is a, c, g, or t
  misc_feature (136)..(136): n is a, c, g, or t
  misc_feature (206)..(206): n is a, c, g, or t
  misc_feature (234)..(234): n is a, c, g, or t
  misc_feature (240)..(240): n is a, c, g, or t
  misc_feature (316)..(316): n is a, c, g, or t
  misc_feature (318)..(318): n is a, c, g, or t
  misc_feature (351)..(351): n is a, c, g, or t
  misc_feature (367)..(367): n is a, c, g, or t
  misc_feature (377)..(377): n is a, c, g, or t
  misc_feature (382)..(382): n is a, c, g, or t
  misc_feature (426)..(426): n is a, c, g, or t
cagtggnagtcgtctananncgcgtantaactctcttcacttcgtacgatgtacntntntgatgattgtcatccacgataagacctcgtgcgtngccgtccgtagtcgctntcgacacagacgacacgtattattngtatgtcgacgtagctctagccgacgacacagtcgcatgaacgacacgacgtcgacgatgccgatgaggntgcgtggtcggtgtgcattcgacgacanctaaancacgagaatgtgacgcgcacgacgacgacgagaacacatcgacatgatctcgtgccgtgtacggtaagcatacgtnancgctgagacgtcacgacgtggtcgcgacgacgncatatcatcactaganatgacgattncgcgncacgatacgcgacattagcacgacacgacgagtcacgacatcgncgcgggacgtgttgtgtgtcgacgcgacatgacactgcctactctagacacatacgagagagagacgtgcgttcactagcgtgacctacagactgagagatgcgcgggcgcgtgtggtagatagctgacagagacactatactttctgaacaactccaacggagagggggcgcgtgcgtgacactattacttattgtcatacatactagaaagaggcagggactgcgcgccacgcttatacacgtatcgtgtgctaacacgggaggctggtgcagaaacagcggcgagaataaattcttgtcatacacaccagagggggtcaaacacacttgactttctgaagaaaacgactgattgtctccccgcgatcggtgcacagggtcaatttgaggaggcagtctcctccgggggcgagtacgctacggcgggataacatacattttattccacaaccaaagacgagaagatgtcggtgcgcccccccctcctggcgggagagagagaacacaaacgtgtttctccaacacactcgcgcgcgcggaggcgatatcgcgctcatagttagggactacgtcagacgaacaccgacgaggtgccctcatgtgtggggatgaataagagagagagactctactcgcggtgctactgtgggagagacgaagaaacgtgcgcttcttcgtgcatacgctacgaggaggcggggccg

SEQ ID NO: 603657 - DNA, 675 bp, Homo sapiens
  misc_feature (629)..(629): n is a, c, g, or t
gagccggtccaggcctctggcgaacatggcgcttgtcccctggcaggtgctgcggatggcaatccttgctgtcttacttgctctatcctgtgtaattacaaggccatcgaaatgccctcacagcagacctacggagggagctggaaattcctgactgtgcattgatctggttatccaggctgtcttttttggcatctgtgtgctggactgagtctttccagtgcttctgacgtcgaggaagtgggaaccaggagcaggagaggcaggtcaagaagctcatcgtctctccgggactggatgtaagctgtgttggtctttcctgtgggggttacgttgtgagcagtgttgctggatcatttatgcgctagtgagcagatgagatgatataggccgaggctggtggataattttatcccagggtggctgaatcacggaatgcacacgacggttcgtgccctgttatagtaaatcgagatgaggacatcggaccagcagtatcccagcaggagcagggacattaccgccatggtgtaccttctctgttgggtagtatacttatggggtgtgctggggtgcatccgtgtaaatgggctgtgggggtgtacccttttcctgggagcacatttggnccaggagtccggaatcagtcttctttgggtgtacaacatcttaatg

SEQ ID NO: 603658 - DNA, 95 bp, Homo sapiens
ccagctttggattatcccgcatgcaagattccggtgatcacataatcctcttcttcatcctcatatgaaatgaagagagagagcttcctcattca

SEQ ID NO: 603659 - DNA, 473 bp, Homo sapiens
agtcagttattctgaataattttatttttgggagacagagtcttgttctattacccaggctgatgtgtagtggcacactcttggctcactgcaacctttgcctcctgggttcaagtgattctcctgcctcggcctcccgagcagctggaaccacagttgcttaccaccacaactggccacttttggtactttaagtagagactgggtctcaccatgttggccaggctggtcttgaactcctgacctcaggcgatctgcccgcctcgccctcccaaattactgggattgcaggcatgagctaccgtacctggccaacaatcccaactcttaaaacgcacacacaaggaaattcgtgttataacactgtatagaacatatagggcacttatcgtattcatggcaaaataagtgttggcaccataatcttttatattacctttcttatggatgccatggggcccggggggggaaat

SEQ ID NO: 603660 - DNA, 201 bp, Homo sapiens
  misc_feature (36)..(36): n is a, c, g, or t
  misc_feature (130)..(130): n is a, c, g, or t
  misc_feature (159)..(159): n is a, c, g, or t
  misc_feature (191)..(191): n is a, c, g, or t
cttggatcaagcttagcacgtcaaggccatgtttgntaccccatggtcaatgacgtggactcctctcacctccagcttctcagtttctgcctgggcaatggctaagggccaggggtgagggtgggtggtngaggtgggtgagagctttctggagatggngcagggcaggcccaatccccagctgggttctnggtcatttgt

SEQ ID NO: 603661 - DNA, 145 bp, Homo sapiens
tacgggctttaaatccgcttccgtctcaggtcgcgctgcgaatggaccgcagccatgtctgcgcatctgcaattggatagtcgtgcggaactgctccagttccctgatcatgatgaataagcatacctacagcacatgagcccaa

SEQ ID NO: 603662 - DNA, 239 bp, Homo sapiens
ccgtgagtaatcttggcgatgagtaatctggggcagacaggagatgctgagcccaggagtttgagacctgtcttggcaacgatgataagaccgtttctatacaaaaataaaactaaaaaataaaattagctgggcgtggtgacgtgtgcatgtggtcccagttgctcgggaggctgaggttggaggatttctggagcccaggagtttgaggtggtagtaagctaagatatggccactgt

SEQ ID NO: 603663 - DNA, 849 bp, Homo sapiens
ttgatctcagagttcaaggaaccagttcttcccaacaataaatacatctacttttgataaaaatctatcccactggactcttcacaccagagcttgatcgtctcagactggggatatgtttctgtaagcagtcctgagggcaattttacacatatccacagttccacagaattagaagatctcttttggtgggcagctggaacaggcttcacaccatatggttaaaatactgaattatgcttgtgactgatatacccagtctcaggaaagtgaagcctgatgttcttcaataaaacagaagatgatataattggagaagccacttggagaaattagcatttacagataaaagactggcatgtgacattgtctctcagcacctatttctgaatggaatggcaaacagggacaatatttcaccagctcttctttctgaattttcgaccacagaaattggacaaatccaaagttctcgtcgtgcattgtggaccagtgccattacagaaccaggagtaggttgctgcttgatctcaacttttgccaaaaagtgagatccatagttttacagccatactgaccgcgctggtcatgtcctttattcaactagttaatctaacttgtgactgcttagggtttaagaagaactttttgtacctaacaaaggttacctaaattcagccttagtcctaaatgccttcactgtcctcagtacaggaactctggcttctttgacacactttttccactgctttgacctgacagtatctgcacacatcttcggtcttgcgtgacaacaatcgtcggcccaatattcggttcacaagcctgttgcaagtacacagactcccg

SEQ ID NO: 603664 - DNA, 285 bp, Homo sapiens
tatgttgtggtcgtcctgcaggatccccggactagcacgcgctacaatcacgatttatactttgccactcctttcagtgaagcctgggctcgtgcttactggagttgcctcagcgcatggataacccataatgttccttcaattctttgcctttagagttggaactaaaacgcgatcggatggtacattgatcattaaagtgttggccttaaaaccctagagtacctgatggaggatacttcatcatcgtctgatgtgtctttgctaaatccagatcctctctgt

SEQ ID NO: 603665 - DNA, 284 bp, Homo sapiens
atggtagacctgcaggaaatccatccaagtctggaatgacgtaataccattccacaggtatagccagtggataggatgatagaatcaagaatcaaaaaatgccgcttataaccagctcagaagcaggtgagcactaagaacaactcagccttcatggagaagtggctgtttccaggtctgaagcaaagaatgacatgatgtacccaaaaccctctgtcttgctggaaagggagggctggaactcacaggtggggagggtcttaagtaatcaccaaagctctgtg

SEQ ID NO: 603666 - DNA, 1740 bp, Homo sapiens
  misc_feature (63)..(63): n is a, c, g, or t
  misc_feature (472)..(472): n is a, c, g, or t
  misc_feature (675)..(675): n is a, c, g, or t
  misc_feature (1218)..(1218): n is a, c, g, or t
tcgtcccccacaggccaggagagtgacggacagagggcgagaggaggggaggcggcgagccanaaaggtgcgagatgagtgattgctgtctggctgatgtagtagtctggttgttgagttatcatctgctgtttgttcgtagtttacgcctgctggtgatcgctgtagtcactcgtcgtgtgtgttgcttttcaccccggagctggttgtgtgtcgtacgatcagtatgctttcttccctgcaagctaccttctgtttacacgagggggcccccctgctcccggttgaataacgtgttgccccccaacaagggctgtgtagggagacgcaacagacagccggtgggtgttgctccccccatataggatgggcgcccttgttcccaccccccctgagagggtgcgcacaccaaaaagaggccgcctcttcgaaggagcacctctcccgcgggctgcccccgccacagactgtncgccgccaccagtgtttgagaactcgctcgccctcccgggtgcttcttgggcggagacaccgccccccccccgcgggggaaggtgtggagcacacccgcccgctgtcgtcgcttccccaaagcgtgccccgctacaacaggcgatgccccaagagaaggttggtgggggtctgtcccacaagaggccaccaaccgaagtgggncctcctgaaaggggagggggtggaccccccccaccacgatgtttttgcccgtgcgttgggggacccccgtcagggcccctcctttttttttgaggtctggaagtgcaggccccgacagattgtggttgagagagcgtctttttatggttccccccccccgggaccacattttagggcccacgagtcttcctgtttagtgttggaggcgccccctccacacggcaaagacacgcgggtttggttttggcgctgggtgctcccctcggggccctttctggggagaaggacacatttgggggggaaatttttttgggagattatcttctggtgggtgaaaaagtgggcccccaccagagttagagagagttgtcttctgagagtgcgctttgtgcgcttgtcctttgtcgtggtggcagagacacgactttctagaagccctgcggcacattgtcccccctcttgagggcccaccttgcgagttgtggagttttatagagagagaggtctcccccccacaaaggagaaccaccaccctcggttttntggagacccccactcgagaggccactttattgagaactgccacatgtgtgtcacatttccggaggagcccccctcatgctgcacacacatatatgagcttatatgtgtagagaatgttaatacaagctataatgtgtacatgggaaaaattcacttgttctctcacaattgcacattagcccaccactctttgaggtaattcacatgtggctcgggctaagagtttctgtgaattatgcaccacacaagatatatggagaccactttgccactcacgccaccacgagaagtttctgcttggacacgcacctgcacttatgaataattttcactactgcttttcctcacaattaaatttttgttgttaacatgttgaatgtcttcacattggaatgggtcataaatgttccactgaaacctttcacagtaacaccattgtatgttctttgtatcccttacccccaatatctcgctctggtcattttttttgcagcttcctataaaggttgtcttcctcatcca

SEQ ID NO: 603667 - DNA, 1065 bp, Homo sapiens
  misc_feature (785)..(785): n is a, c, g, or t
  misc_feature (1065)..(1065): n is a, c, g, or t
ggaaaaattcgggctaggtcgaaggctgggtgttgacctgtcgtgactctgacggtttctgagcgttggtctttggtcaccgcgctacccccttttgctcttggttctgccatgccgatctaccaggtaagagccctatcacgggggcggcgcgcctctccgtgtgtatgcttcccaccctgcatgtacccggctccccaacgtgcacgcgcaggaactacgcgcccagacgccgggcgctggcctactgtgcaggaatgagtctaatcctgtctctgcaatgactcgttgaggtcccgcgcaactatggagtatttctaacaagcgtctgtatgacgttgaatagctgcagttgatggcctctctcaatggatgattcgagtaatcgaccctaggagtgcacgcaccttgggtactggttaaaccgaaccaataaagttccagagcgcgaatgtaaggccacacggaacttatagaccgaccaaactggcacatgggaacttgcagattccaagtgcattgagtgaaaggtgaattatcggggcgtcgggctcgtagaacgacaatcgatgtagtctaccgacaaaccccggcacttaccctcatcccgctcatccctgtcttatgcatgcaccaacgacatgctcctgtggaggcagcttcaagggtaccttgtccacgggtgcatcacagcaaatcctcggatcaagagcgtagccttgaaaaaccttctacaagttgcgtttaggggaggaaaccaggaattaaagaaaaacaaggccccntgaccaacgaatctgatacagtcgtgggggaattcagccttgaatgtttctgggaaacgaattggtggccataataaacgccagattggaaaccgttctggctatcccagcaacaatgtaggccccactatcgcatacgcgacaggggacgaattgggaccggtccgagggacccctggttggcgccaaaacatattagggggcaacatgacccctttttcatcataaggggcgtgaataatgccaacacagtcaacagagagaggagaaacaccccttn

SEQ ID NO: 603668 - DNA, 428 bp, Homo sapiens
  misc_feature (31)..(31): n is a, c, g, or t
  misc_feature (85)..(85): n is a, c, g, or t
  misc_feature (87)..(89): n is a, c, g, or t
  misc_feature (151)..(151): n is a, c, g, or t
  misc_feature (165)..(165): n is a, c, g, or t
  misc_feature (172)..(172): n is a, c, g, or t
  misc_feature (189)..(189): n is a, c, g, or t
  misc_feature (213)..(214): n is a, c, g, or t
  misc_feature (232)..(232): n is a, c, g, or t
  misc_feature (250)..(250): n is a, c, g, or t
  misc_feature (253)..(253): n is a, c, g, or t
  misc_feature (260)..(260): n is a, c, g, or t
  misc_feature (284)..(284): n is a, c, g, or t
  misc_feature (289)..(289): n is a, c, g, or t
  misc_feature (320)..(320): n is a, c, g, or t
  misc_feature (328)..(328): n is a, c, g, or t
  misc_feature (347)..(347): n is a, c, g, or t
  misc_feature (364)..(365): n is a, c, g, or t
  misc_feature (367)..(367): n is a, c, g, or t
  misc_feature (412)..(412): n is a, c, g, or t
tgcaatgcatcacctgacacacaaggcaganagcatcaagctctctgtttatcccaattcaatgacaaccagaacttattttttntnnnatggggtctcgttctgtcgcccaggctggtgtgcagtggggcattcatggctcatcgcagcntccaactctcagtntcaagcnaccctcctacgtaagtntcctgagtagctggaactacaggnntgctccaccacacttggntcatttttaaaaaatttnttnttgaganaggttcttgctacattgcccaggnttgantgccgtggtgcattcacagctcaccgcaggntcaaactnttggtctcaagcgatcctnctgcctcagctttctgnntngttgggactacaggcatacaccaccatgtctggttcatttcttanactttttgtagagaag

SEQ ID NO: 603669 - DNA, 312 bp, Homo sapiens
tctaaggatctcttagtgtcactgtcattcataatgtataatgtacgtcaagtattatgtctataatggagtgtagcagcatgaagatgaacaacatgtggtacttccctaaaggcatcacacagaattacatgtaataaagggggcgtagagagagattccttatggtgtggggagtagaaaggctcatcatggaagtgacattttgagcttactcttaaggaattaatgttttgtgaaacagagacaaagggggcattttagataggcaaggaagctcaaaggcatgtgcttggagcatagtacttgggt

SEQ ID NO: 603670 - DNA, 179 bp, Homo sapiens
aatgtgaatgagatctgatttacgcttttgatatttagccttttacatcctcatgatcatttcttagatagtgcattggagatattttttcctgatgaattatatagtttatcatctgcctccagagtttataaaaaggttctgatagcaagaaacagttgttgcaaccaaaaacaacc

SEQ ID NO: 603671 - DNA, 292 bp, Homo sapiens
cggacctaatataagtattatagtagagttgaggtaatcaccatgtaaggtacaggctggtctacaaacccctgacctcaagtgatccaccccgcccccccttcggcctacccaaagcactgggattacagggatgagccacctcgctgggaccagaccttactttactatgacttggacacaagtctgtcctgctacagagctgctgaaagtggctctcctgttgtatgggcttgggtgtggtagtggtggccctataccctgtcccagctgccttcttcctgggcactga

SEQ ID NO: 603672 - DNA, 434 bp, Homo sapiens
taacggacagcaatagatacagaaaagcggtcctgcagagaacatagtgaatatcagcaaaagcacagcaacgcagagaaggaaatagccttcacttttctttaatctcagtgctcaggcctctttccactttttacctgaagcagatccatctatgacccctgcagccgatgctccagatctgcagatgagctctctcagggactgggtctgctgcaccatctccagtttcagagttcgtaaggcttttcagaatgtcttcctcctccttctccaggttttgcagctcattgctctcctcccagtccaggatgtctctcagttgctcaaaatctgacaagacgttggtatagtcatacagtatttgagtcttccaggaagctttctcttctctgatgtcagcttccaactcttcagcttcctgctgcttctgc

SEQ ID NO: 603673 - DNA, 606 bp, Homo sapiens
aaatgaatgggactcggtcttaattagtattgtcaccaacttcgttgagcgcgagagcaattatggtagtttaggtattgagctaggtacagttctactgatgtgagaacaggctgtagcaagctaggacacagctttaagctggactgccatgatgggtgtattcctcgttgttgaggtgcccgcatacactattttgataaactgtaatgccaccatcttgtactagagtcggctgatccgtattgtagataaactgtcgagggttaggacatgggtctgtactgcatcattatactgtgcctttccgttatgcttcaagagaatttaccatctaatggacagagaacatttgcaagtatggcgtccagtgacctaagcttcctttccacgatacatcgtacgtccatctgaacgtttgaatgcagaatcttgaaagtgcaatgcccagatactaaggtcaagaaagaacttaatgggaattaatctccacgccattagctttaccctgacatcaggatgtgccaaatccaatggactcttgtctattcttacgtgacttctgctggaaaatgcgaatgttgaccatcctgccacttggactct

SEQ ID NO: 603674 - DNA, 1163 bp, Homo sapiens
  misc_feature (188)..(188): n is a, c, g, or t
tccccaaaaccccgggggttttttgggggggggggggaaaaaaaacttctggggggggggggtggcgcccacaacacatgtgcgggagcacgagagacatgtctctgtgggaccaaatccgccctcaggtgccctcgtgggagaagagtgtggagccacacacagagtgagcagccctccgccatgtntgtgtgtcccccgagagagactgttgtaacgaggcggaagggcgtcccagagagcaccgtggggggttttacccccattgtttctctcgcgcggccctcgcggaggagtgtgtccccagcgcccctcggtttcacggggggtccgtggggcgcggcatacttgtgggggagagggggggggggccccccaaagcgcgttttctctgcgggatcccccggtgtgtgataaccccttctcgccacagagagtttcttttgccagaggaatatatattcaagaagacgcggtgtgtaaaaacaccccgctaatgctcccgatgtatgcgcgcccagctcctcccactgagcacatatgcgccccatactatgtgtggacaacacaggagcgaggtgttgtttcgccccacgccactctttttgtgagaaggccgcctctgcgaggagagcaacccccctctccgggggagagaaatctgtgggtgggttctctctgcggcgcgggagcaccccgcggacatactcttttttgtcccacccagtgtgtgttctccgcgcgcaccccgcgcccccgtgtgtgctcccccccacgctctgtgtgtcgagatgcttcgaggctgaagaccactgtccaccctctcttttatgtcttgcaggagacgtttgttgttgctgcgagacccctctgttttgagtgcgctccccccgaggaaaattcttttgttggcgccctctgcgtggtgcatccgctggggtcccccctcgtgtgtgggttgtcccgtcactcctccgcgacacgccgcttcgttgatcatcctcctctctcctcgggagggtatcgcgaggctcctttgctgctgaggcaccacatgcttctctggtgggtggtaatacgttgcgccccccccgcgccgggtagacatctcgctccccttttctgtgtggacaccgtcgcgggctcattatgttacccccccg

SEQ ID NO: 603675 - DNA, 181 bp, Homo sapiens
cctatctaatagcatcctctatcaacaatatactaccccggacaatagaaccataaccaatactaccaatcaatagtcgctcattactaatcatagtggctatcgcaataaaactaggaatagccccctttcacttctgagtcccagaggttacccaaggccacccctctgacatccggcc

SEQ ID NO: 603676 - DNA, 261 bp, Homo sapiens
cacaggtataactagccgtcgtctttcactgcccatccagctataccggggcaccctttctcatagtcgaccatggaataacatccacatgactatcctggctagccaattcaaactaggaacgcactctactaatcgcataataatcctcactcaagcgacctccatacttctagtcccactaatagctctcagatgacttctaacaaaccacgataacctcgcctattctacaccaaccccgccgttcagccgcatcag

SEQ ID NO: 603677 - DNA, 198 bp, Homo sapiens
aatatcgtcgtcctctactccccttacattaccaataaaaagtttaaaataaagtgtcagattgatttttacaagaacagcatacatatatcaaaaacctctctctttttttttttttttttttttatattttttttttttttttttttttttttttttttttattttttttttttttctttaaaaaaaaaattttaa

SEQ ID NO: 603678 - DNA, 113 bp, Homo sapiens
ccggctacggtgtggccgacctgatggcgcactggaacttcgccccgggcgccaccttcaacgtcggcgtgttcaacctgggcgacaagcgctacatcgattggtccaacgtc

SEQ ID NO: 603679 - DNA, 1107 bp, Homo sapiens
ggagacttagtctcactgcaacctccgcctctcaggttcaagagaatctcttgaacctgagaggcggaggttgcagtgagccaagatcacgccattgcactccagcctgggggacaagagtgagacttagtctcaaaaaaaaaaaaaaggaaaaaaaaccgggatttattcatatcccattcttggtttacaccggatgtccctgattatcagcctggtagctaatggggactggggatttctgggtctaaggtggggcctcccgggggatgggggtgggtacactggagcttctggagcctcattggtagagtagaaagggtactgggggccgtgtgttggtaagcctggttgaaatggctctgggtattcagtatggccttaataaacttcacccacaactggcaaaaaaaaaaaaaaaaaaaaagaagaaaaccaacaaagagcgggggggggcgacgacgagaagaattcaccccgcgagggggggcccagacgtttacgcgagatgaccgcgcgagtgtggtgtgggcaacgaaggcggccccctgagagacgacgcgtaaataaaagacaagacacacgggcccaggtattaacaacagcattcggatggcggaaaaaacagtgtcgtcgtggaaatcatctgggggagaggaaccgcaaacgtgtggggggagcacattgtgtggcacaaaccaaccgacagacaatgaaagccccagaggggaaaaacatcaacgtggagggctatggcggggtcaccaccagaaggaaataggccagcgcgatcgaaaattagcggcccaggcttagcatggcacacaattctaccgacggctgtagtaaaagcgccaaagagaacaacgccacagcacagacaacagaaccgaaaggcagactgcacgatgatcacaacaagcaaaccaagaagacaccaaacgaacaacagacacaccatcatgaacaaaacccagcaaagacaacaacaccacacacatcacgaaagcacacagaacaaccagaacagcgcaaaacaagcaagaacgcgcccaacatgacacaaccgcaacaaaaacaatactgacgccaaaagaacaaccaaga

SEQ ID NO: 603680 - DNA, 871 bp, Homo sapiens
taaaaaaagtaacccttttttccttgttggtttgggacaaaaaaaaggggaagggggggggctttggggggattagccaaaaaaaccaatccccttttcccgcggcgcggtacctccccctccgaactctcgccggggctacaaaccttaaggcgggggccgtggaagaacaaccagcagaggaaaccagccgggtgggggcagccagccacaagggcggtggcagaaccgcacacaaaggggacagagaagtgggaactcagccacagaagagaggggcctggaaccttttaacagacccaaggtgggacagggggtgtataacctgcgcgatactcacagagagaaaaccaaggggcacagagagactccccgtgtagtggagcccccgggtagagaatgcagacaaacagaaaggggtgggagtaccctgagtgtgcgacaacaagaggtgtgggggtggtcagcgcccaaatcttgtggcgcgacaacccaaagacacatcgggtgggcacacaaccttgttggtgggagaaacccccactaacccagaggaaaaggcagaaaaaattggcacgggaaggaccacccctcggggggagataaatcaaagggccacctacacgaggtgattgtgtctacaaattagctgcgagacaccatgtgttggtcaaaaacacacgcgtgtgctgtgtatagtagaacacaagcccccaaaggggataaaaaggggggcaaacaagtttgaagagaccagtgttcacacaaacgcggaggcttctcaggggcccccacatgtggtccaccaggaggtgaacaacagggcactaaaccacagaataacaggggcccgtaaaatcagggggaaacc

SEQ ID NO: 603681 - DNA, 1121 bp, Homo sapiens
ctggccagcgctccgaaaccttgtcctcgctgcgcgccggcccctcggagcccacagcccgggaaggaggccgccgcgggccgtggcttgcccgctctgccaagcggacccagcaacccggaaaggcggcggcgggcggagcctggagccggatcctgctcagaccgggcccctggccggccagagcctgctgggctatgtcgagagtgctgcggacaggggcctggactgatggcgtgagggagagccacgtacgactcgtggcacttgagtctcttgcgctctctgcggctcccgtacccgagtccacctctggctccaagcctccgggtccctcgtgacggctagcccccagccctgacacccatcctccgggacccgtcaaggaaccacaggagaagtgaagacgcggatgggtgagcgggctgagttccacctatggctcctcctcgctcacctacagccctgtccttgcttgggtgggcccccgtagtgctgagtgaccctggactccaacagccgtgccaattccacccgacgtgggggcgcttgagcccttcagcgagctggaagcacgtcacttacatctcctgaggacggaggacacgctggtccaccttggcagtgaatccatgaggccccagcggtgctgcatctgttgccctggctttgcatgtcccaggagggtcctggagcgtttcacacataaacatttacacagatcagcactccaatcttggctgtaccatctggaccaaaccgggggcagcacagttcggcgcaactgggtgcatgacagggtggggcccaggccaagggcaactaccatggaaccggtcaaatgggtgaccacgaagcgcgccgttcaagttgtttgggctcctgtgtcaagtgggacccaagcccagccttgttgcactttggtggcccccggctggcacgctgcattggaacatgggcggtcgccataaatgccacagtgctagtacgtaacgactcgacaagctgtctcagctgtggaaccataccagtattggtccaaatcgtgggcaacgggttctaggggatgttactcaccacgtttggcaaacccctttaagcgcaaggaagcaatggcgtct

SEQ ID NO: 603682 - DNA, 1099 bp, Homo sapiens
tacaaattcactgggtttaatggaataattggcgaaaatctcaagtgaaattcttgggcgagggtaaaagaggccccaatttaagccattgtgataaatatatagcccaattaagcagtgtttcacagaacagggccgtgggcgtgacaagccaccgtagagttatccccaatcaccagcggaaataccaacagaacaccacataaagaccagagagaaaaccaaccataaagcgggcccagagcaacccccaaataagcgggcgggacaaaatcaaggcacaggtgggcaaccacaggaacaacagcgcgctccgagggagaaactcaacaatagaggcacaaatacataacgccgcggtacacttacgttcacagtgggtgagcaaaataataatccctccacaagagcacaacaccactcacacacacacaaaccaaccacctcccacttgcgagaagcgcggggaacaatagagccgcggttccaacaaaaagcgggcaccccctatacgaacagcgggcgcccaaaaaacatacaacacgagaagaaaaagcgcgcaaaactaatatcgcacaaatctaagtctccaccgggcaaacttgcgacacaaagacaaacacaaacaccaagcacacccaagaaccgcacaagagacaacaaagacagaccgaacacacacgcgacccaagaaacaccacacacaagacacaggacagcagagaaacagcacaaaaaaaaaaatagcaaaacacaaagagtgggaacgaagaagaaagagaagccaacccaccgccacacgaaacgtacccatcacgccggcgcccaaaagaagaccaagcgaaacaaaaaactacaaaccacacacgaaccagcgacgtagacacgacaatgaggacaccaagaaacccacagcggagagaagacgccagcgggagggaggcggggcacggcgcgcacagagggcagactgccagcgggcagtggctgatgagggggcggaaggtgtcggggggtaccgcaagcgggggagccgcggcggcggggggcgggcaggaagcgaggtgcggagagggcgaggggagtacgggagaggggc

SEQ ID NO: 603683 - DNA, 324 bp, Homo sapiens
  misc_feature (72)..(72): n is a, c, g, or t
  misc_feature (84)..(85): n is a, c, g, or t
  misc_feature (132)..(132): n is a, c, g, or t
  misc_feature (138)..(138): n is a, c, g, or t
  misc_feature (143)..(143): n is a, c, g, or t
  misc_feature (179)..(179): n is a, c, g, or t
  misc_feature (210)..(210): n is a, c, g, or t
  misc_feature (255)..(255): n is a, c, g, or t
  misc_feature (288)..(288): n is a, c, g, or t
gtccccggaaattcggccattatggccgggattcaggaaaaatttaggaagggattgctccatggggataangttcctttcttnngcaaaattagggaaaggaggggtagttttccagaggatgctaagggnttaganggccntatcgaagtccccaaaggcttaagggaccacagttntttggtttttgggaaaactgaggcatccgangtaaagccatgctaagggggttttaaaattccacataaaaggtancactggttcctggttaatccagggaccctaatngaaatttaaaattaaggctcctgaattaatggccgc

SEQ ID NO: 603684 - DNA, 104 bp, Homo sapiens
tcaagcttctaacgatgtacggggacatgatcttgccactgcactctagcttggtggacagagcaagaccttgaaaaaacaaaaaaaagggaaagagaggaaaa

SEQ ID NO: 603685 - DNA, 292 bp, Homo sapiens
tacacctgaggggaaatctatcccggcaagcacagagtatatatatacggcaacaatacatacatctgagttacacttgtacaaataactgtaataacccgtatgtgtttcatttaaacagcatcaggtttaggacatatgatttctttctaacaatcagtttaattgcaactgcacatctgtgggtagagcattcagtgacagagaaacctaggtatctatgccagagaaatgtgacattatgtattaagctttctctctgagaggaggacaagagaggtatagtctttgg

SEQ ID NO: 603686 - DNA, 1052 bp, Homo sapiens
gggcaacccagctccggtgtccattccatgctgtggaggctcatgttgtttcgctctttctactgcttacatcttcgggtccacactgctttatatgagctgtaacactcaccctgaaggtttgcaacttgactcctgaagccagcaagaccacgagccccagggaggaacgaacaactccagacgcgctgccttaagagctgtcaacatcaccgagaaaggtctgcagcttcactcctgcagcccagcgcaggccacgaacccaccagcacaggacagcacacactctggaacacatccgaacatcagcaaggaacaaactccaagacgtgccaccttcacgagctgtatcaacactcacaccgcgaggggtccgcggacttcaatttttgaagtccagtgagaccaagaaaccaaccaattcggggccacaaataccacctctttcatgccaggagaagcctccttaaaaacatacggtgcattcacccagcagcacattgggtcaacaatctccttgcaacagttgagccagggcgcagctgtaggaagatttcctcctatcctcgcaacatgcacatcttctgatatcagcaggtggttaccgggccacgcaaggacaaccagaaggagaaaccaagaacaacatcacggcactacaattccatcaccgacctcaacaacaagcactggtatccatacagttatgaccggcactcaggcggcctcagacgggagaaacgggatgccgagacaaggacgcccttgtgccccctccccctgggcacagcgcccctccacgctgacaccgtggccacacaaaggcacaccaaacatggaaaacgaccggtgccaactcacgaggagtgccaggacacacgaggctcgaacggcaccggggaacggcaagctcccaaccgacaggaccaaagagaaaaacacgtcgaggcgagaccagccgcacggagaaaccacgtgaaggagcgaacacgcgggcaccccatactgcggcgccgccggggcagcacaacagaacagtcgttacagccgag

SEQ ID NO: 603687 - DNA, 297 bp, Homo sapiens
  misc_feature (45)..(45): n is a, c, g, or t
  misc_feature (57)..(58): n is a, c, g, or t
  misc_feature (105)..(105): n is a, c, g, or t
  misc_feature (111)..(111): n is a, c, g, or t
  misc_feature (116)..(116): n is a, c, g, or t
  misc_feature (152)..(152): n is a, c, g, or t
  misc_feature (183)..(183): n is a, c, g, or t
  misc_feature (228)..(228): n is a, c, g, or t
  misc_feature (261)..(261): n is a, c, g, or t
gtccccggaaattcggccattatggccgggctccatggggataangttcctttcttnngcaaaattagggaaaggaggggtagttttccagaggatgctaagggnttaganggccntatcgaagtccccaaaggcttaagggaccacagttntttggtttttgggaaaactgaggcatccgangtaaagccatgctaagggggttttaaaattccacataaaaggtancactggttcctggttaatccagggaccctaatngaaatttaaaattaaggctcctgaattaatggccgc

SEQ ID NO: 603688 - DNA, 1099 bp, Homo sapiens
  misc_feature (78)..(78): n is a, c, g, or t
  misc_feature (80)..(80): n is a, c, g, or t
  misc_feature (898)..(899): n is a, c, g, or t
  misc_feature (902)..(902): n is a, c, g, or t
  misc_feature (905)..(905): n is a, c, g, or t
  misc_feature (908)..(908): n is a, c, g, or t
  misc_feature (912)..(912): n is a, c, g, or t
  misc_feature (954)..(954): n is a, c, g, or t
gggcgcgcggcggcggagggcgtgcgaggctgttgtgctcccggctctcgtgtttcccctcctgagcgggtggaggangnccaagcggtgctgggcgcgctcccccttcctttccctccggcgtcctctcccggccctctcgcgctgctctgtctctccgacgcaagattgtcccggcccggctttggagaccgagagtctcacgtgtcagcccaggctgcaagctgcagctggtgccgatcaacgcgtcacgtgcaaccatcgtgtctcccgagattcaacgcaattctccaacctcagccatccacaaggtagtctggaattacacgatcatggcatcgtggacatgccagaatacattgcagtctcgagctacgacatagaatgcccaaaacagcaagcttggacaagcagccagaggacacatggtacatgagccaaatagcgcgtagctgtctaatacgtctgcctgtacgttatataccctgcgaacatggtctggtatggacactagaatgcgcgagacctcataagatgctttcagaggcagcaacttatgagatgacaacgcatcgcgtaaggactccgacgttccgtaccatgaacttagctgattggttcacgtgcataagggttagtttgacagtgtcgaatgtgcatgacacacttgtgacctctgtcatactgtgcttcagacgcttacggtaagcatactcctgcagctgcgttcttctaacgaaagctgttagatcagcggtacaataacgggcgctacagaaagcgacgtcacttgaatagtgctgtgtcccctcttgggcttcatgcaaagacaattctgtgtaaatgtacagatgactctgatttggacatatgcacatcagtccatccttgttataannaanttntanaatngaattatattgatgtcacattgtgtaaataactcattaatancatcgaacttcgacttacgaccatcaccggacacaacaaaacaggggggccagccagccaaagacacaccacgagaccaccgcggaacgcacacgcccaacggccaccagcacgcggacggcagcacacgcacacaccaaaacgc

SEQ ID NO: 603689 - DNA, 883 bp, Homo sapiens
  misc_feature (78)..(78): n is a, c, g, or t
  misc_feature (80)..(80): n is a, c, g, or t
  misc_feature (682)..(683): n is a, c, g, or t
  misc_feature (686)..(686): n is a, c, g, or t
  misc_feature (689)..(689): n is a, c, g, or t
  misc_feature (692)..(692): n is a, c, g, or t
  misc_feature (696)..(696): n is a, c, g, or t
  misc_feature (738)..(738): n is a, c, g, or t
gggcgcgcggcggcggagggcgtgcgaggctgttgtgctcccggctctcgtgtttcccctcctgagcgggtggaggangnccaagcggtgctgggcgcgctcccccttcctttccctccggcgtcctctcccggccctctcgcgcatgcacagtgtcgtcgtcctgagcgaccacagcacttgtaccctggcccctggcatcatgtgctccgtgtgaccagccagaacaattccagtctccagccagaacaaatgcccacaaaagccacagctggcacagaaagcaagacaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtctacaggtgaattcatgacacctttgactcttctactgtctcagaccttaggtaacatacctgcagctgcttttctaacaaactgttgatcagcaacaataaaggggctacagaaacactcatttctatgctgtccctcttgggcttcatgcaaagacaattctgtgtaaatgtacagatgactctgatttggacatatgcacatcagtccatccttgttataannaanttntanaatngaattatattgatgtcacattgtgtaaataactcattaatancatcgaacttcgacttacgaccatcaccggacacaacaaaacaggggggccagccagccaaagacacaccacgagaccaccgcggaacgcacacgcccaacggccaccagcacgcggacggcagcacacgcacacaccaaaacgc

SEQ ID NO: 603690 - DNA, 142 bp, Homo sapiens
ctagaggatcacgagaggtgcgacactgggaaggtgaggaatgtcgcgttggtcaggtggaggagggaggcgcacgccaccgggctgggcaggtgcacgctagtgcccaggcctgggcccgtgagagcaggaacgattgcgg

SEQ ID NO: 603691 - DNA, 247 bp, Homo sapiens
cggcctgatgtagtctgtgggatccctgaactctcagacctggagaacctcaagtatgtatacgatgccctggaggcctcaggatacagcggccaatgccactacctacttcactaggttgattgagtccagcctgggcagtgtagcacaaagctcaattaattcatccataatctggctcagatgaagttcacgggctcaaatgcccggctgcccctctccttagcctcccgagcacacgcaactg

SEQ ID NO: 603692 - DNA, 411 bp, Homo sapiens
  misc_feature (131)..(131): n is a, c, g, or t
  misc_feature (142)..(142): n is a, c, g, or t
  misc_feature (178)..(178): n is a, c, g, or t
  misc_feature (203)..(203): n is a, c, g, or t
  misc_feature (207)..(207): n is a, c, g, or t
  misc_feature (216)..(216): n is a, c, g, or t
  misc_feature (231)..(231): n is a, c, g, or t
  misc_feature (235)..(235): n is a, c, g, or t
  misc_feature (289)..(289): n is a, c, g, or t
  misc_feature (344)..(344): n is a, c, g, or t
  misc_feature (404)..(404): n is a, c, g, or t
tccaagccttgtggtggaatatggagaggaaagaggccatttagagagattggcgctgggggtggagctctccagagctgagccctttgttcctctcaggccctctgagcagccttgacggggatattacnatattaggctnggtgcagtggctcatgcctgtgatcccagcactttnggaggccaagggtgtatcacttgangccnggagttcgngagcagcctgggcancatngcgtctgtctctacaaaaaaatcttaattacccaggtgttggcgctctcctgtngtcccagctactcaggaggctgaggcaggaggatcacttgagtccctgaggtcangggtacagtcagcagtgatcttgccactgcactccagcccgggtgacagagtgagatccngtataaa

SEQ ID NO: 603693 - DNA, 343 bp, Homo sapiens
  misc_feature (227)..(227): n is a, c, g, or t
acacgcactctgtggatacatgtgagggctagaacactgatgtgtaggcactattatgtatatgttatgaacacaggatgtagccaaactaatgcagttgtgctcagatgtcttcctatcagaacagagtcacatcagaatttgaatgcttaagtgtgacagcttattcagatatagaaaaacttttggtatgggccaaagaaaacatatccttaaggggatatggnccctaggtcctcatattccttttctgtctgagcagttaaaaaaagcattaagtgaattccacaaattctttggtatacctagagataaacagattatcatgttaactgtatgatga

SEQ ID NO: 603694 - DNA, 117 bp, Homo sapiens
tctttacgctgcgatggcgctaatcggcgcccttttcttttcatagaacaggtagaagtcagcgatcaaccggcggaaatcgtcggtgtagctgccgtcggcctgcttgatcgccag

SEQ ID NO: 603695 - DNA, 707 bp, Homo sapiens
gtgatgctgggaaatgacacatgtgagatgtctaacagccttgggctgagagaggaaacgtgcgcctcagtgtgatccccactccaatgctgcgacatccctcgtcagtattgacatgccccagtgcgttatgacggagtgactggatgggcgcacgtgtgtggtgtcagtgagtctagtaggccgtggtttgcatgtgtaggtgggctagcagtcatctcgtagtgggtgggcactcatattaccacagaaaggcggaggaatgaagaatggcccgtttgtgcacaagcatcgatgattgaagaccaagattgcacatcgcagaatataccttagtctatttggtcatcttccagggaacgttgcgctgacagggcaaggagggaggtagcgttagtctctcagaaatgttggagaagccaccgactcgagaattgtcatcagtcttcagggtgctggagatgatgtcattaccacaaacattggcagctcgtggggaccatgctcatatccgactaagtagctagtgcggctgcggtggaaggcttgacacagatcggttcctttctaggccggtcaggggggtccaacggggcccctagtgtgatctcgaacgggaaaagtgtgtaatgggcctcatgatccgttgttgaaacaatatcataccaggttagtgggtccgtgacccaggaactggttttagggga

SEQ ID NO: 603696 - DNA, 250 bp, Homo sapiens
aggggggggaaacccacttgaacccaggaggcagaggttgcagggagccaaaatcacgacagagcaagactgccctcaagcctgggagacagagcaaaactttatttaaaacaacaacaacagcaccatcaacaaaaacccccacagaattgaacaacacaaatgggggcccctaaggaaaactatggactttggttaataaaaatttatcaatatggattcatcattaataacaaatacagcacactga

SEQ ID NO: 603697 - DNA, 138 bp, Homo sapiens
cccctggatgccccgagctgctctctacagacattgaagaaaatattaaaatctttgataaaaggagaagttgaatttatcaggtgtgcctgtcccagtagttttgcagacttgtgattcctgtccaacatttgttca

SEQ ID NO: 603698 - DNA, 122 bp, Homo sapiens
  misc_feature (112)..(112): n is a, c, g, or t
tgatctagaggatccttaaaaatagcgagggttcgggtcgatgacggatgttacaccaactctcccgggcgactcgtgctctggtccacagggcccgcagttgtcgaccagncaatccttgg

SEQ ID NO: 603699 - DNA, 107 bp, Homo sapiens
acggccgtgtattactgtgcgagagtagtcggattacgatattttgactggtctataggaggtgcttttgatatctggggccaagggacaatggtcaccgtctcttc

SEQ ID NO: 603700 - DNA, 691 bp, Homo sapiens
  misc_feature (21)..(21): n is a, c, g, or t
  misc_feature (164)..(164): n is a, c, g, or t
  misc_feature (278)..(278): n is a, c, g, or t
  misc_feature (296)..(296): n is a, c, g, or t
  misc_feature (319)..(319): n is a, c, g, or t
  misc_feature (327)..(327): n is a, c, g, or t
  misc_feature (335)..(335): n is a, c, g, or t
  misc_feature (351)..(351): n is a, c, g, or t
  misc_feature (354)..(355): n is a, c, g, or t
  misc_feature (357)..(357): n is a, c, g, or t
  misc_feature (361)..(361): n is a, c, g, or t
  misc_feature (367)..(368): n is a, c, g, or t
  misc_feature (391)..(391): n is a, c, g, or t
  misc_feature (428)..(428): n is a, c, g, or t
  misc_feature (453)..(453): n is a, c, g, or t
  misc_feature (495)..(495): n is a, c, g, or t
  misc_feature (512)..(512): n is a, c, g, or t
  misc_feature (523)..(523): n is a, c, g, or t
  misc_feature (592)..(592): n is a, c, g, or t
  misc_feature (691)..(691): n is a, c, g, or t
atcaggacatcaacagtagcncaccatggtctagctctatactgaaagccatctagattctagcgcagctttgattctacacatgcacacaatatgctctctagcacaacaaatgaggttatttgcagctcgtcctcgtcagctacctcctggcgaaaggactntgcatctccctgacgttgaaatccttgtaaaactgtcacatttaatagtcggaacatgtcaagcccctcgcacaccagcagtggctctttccgagaataaggaaacaaagagcngcacccctgaacttgtanagacgcacataaaacgctgtgcngtcagccnagagttcncttactgatgtagtanganncnagtnggggannttcataagctacttaggatttcnagtgacatattttctattctcgcgtcatttcctgcgnagtttcttggagtttcacacacccnggcttcctggctacagacatctgagttcacaaagcatatttnacctttaacataatganaatgatgtatntggcatgaagagtttactcaattaagtcaagagttttaaagtcttctctgatcagaatttgctatctgntcagagcaggccacccaatcacagcaggtgcttggaggggagtggaatctcagtagagttgatgactcaccaagtgtaaatgggaaaaagcaacacagn

SEQ ID NO: 603701 - DNA, 350 bp, Homo sapiens
ttggggctcgattcacggtcggggcttctttctcccaaccagacagtctcctcctcagcggtggtgcctgtaaaggaggtgtgaattctgggggttctgcagcttagtcagccggtggtgtcgggagttcttccggtgggccagccagtgaggcctggggtcttgcaactcaaccagacggtgggcaccaacattcggcctgtgaatcagccagtgagaccgggtgcttcgcagaacaccaccttcctgacatcaggctctattctcagacagttcatccctacagggaaccaagtgactgggattccaacctacaggcgggcccccgtgtctgtcactctgccggttcc

SEQ ID NO: 603702 - DNA, 172 bp, Homo sapiens
agtcaaaggcaggagaaggataaagagacatctgcattttttcttctgtcatggggcagatagtaaatattttcagttttgtggcccacatagtctctgtcacatttacttgattcttcagttgtggcatttgcagcagctatggacaatacttaacttagtaggggtgcct

SEQ ID NO: 603703 - DNA, 622 bp, Homo sapiens
aacattgaaggattctctgtgttggctgtaacttttgcgcccctcttcctacctaaagatactctttctatcccactaatattttttgtgaatatagatatccattgtaatctgaagtatcaaaaattacctagaaaaaagctttgaggaactcagactctctctctcacacacacacagacaaaacaaaaggtgatagatgataggtgatctccgtccaaaggatctacaaacccatcaagcagataaatacttcaagagttaaaaaaaattactaaatggaaaagtcagctctcaaagggacagttccccgagcccaacccctttctagcttcacatccttccaggaagatttcatgggtggtttagctctagagatgcacggagaagcttctggagttgaagagaagtggttgtgcccctgagtaaattacaattccaggtgcctacatagtgttaaaaaaaaaaaaatctgaaaagagcttgcctggaccaaatttgaagccattcagagctgaattctaacctatgaccttgatcaaattacctcttttagccttagttttctcactgcaaaatgggacaaatgataccggctgtaataaactatgcaagaatgttc

SEQ ID NO: 603704 - DNA, 269 bp, Homo sapiens
gtgctgcgtcgctctagaggctcccggtgctacgcttggtgtcttgcacataggcacactcggtaacctggaccaggctggtggtgacttatcaccaattttccctggcaagggtaggtttaaatacctggccatccgggagagaaggaaccaggctcagaaaagggaagtcactggccagggtcatgtagctgataagtgcgggaatcaggatttccactcaggcctgcctaccgggggggctgacacccttcccagttggctcggag

SEQ ID NO: 603705 - DNA, 135 bp, Homo sapiens
gagaaaaatagaccaacctattccgagcagaattccgggtcttgctgggtgccaaccccagcctaagcggaatgagcagaggatcgagctcttccagatccttcggccagatgagcacatttgcaaactagcgct

SEQ ID NO: 603706 - DNA, 387 bp, Homo sapiens
tgaacctctgggcaggccgatgtaatcaacataaatataatgactcagggatagcttggagaattaccccttgtccaaagatcattctgggcccgaaattgtgtgctgtgctacttgctctgcagtgtaacctagcataaggaatatagattccttgggggtctaaagggtaaagtgtattcattttctccactaactgacccaatgtgagcactgcttccctgtgggccgaaggacagattgctagaaagggacagcattagaggtgcagagcatcatggtgcagctcacagcagtagctccaccacactctgcagcagagctaatggagggatgatggccggcgagatgcaaaagccggggttggaatcttacagggactccaca

SEQ ID NO: 603707 - DNA, 333 bp, Homo sapiens
ttttttgagatagggtctcgctctgtctcccaggctggagtgccgtggtgcaatcatggctcactgcagcctggatctcttgagctcaagtgatcctcccacctcagcctcccaagtagctgggactacaggtgtgtgtgtccacggctaactaatgtttttaaaatttttttgcagagacaggatctcactgtgttgtccaggctggtctcgaactcctgggctaagtgatcctctggccttggcttttcaaagtgctgggattacaggtgtgagcactgcacctggcccccttcctcccctcatccctaagctttgtacctctccagggac

SEQ ID NO: 603708 - DNA, 404 bp, Homo sapiens
  misc_feature (95)..(95): n is a, c, g, or t
  misc_feature (231)..(231): n is a, c, g, or t
  misc_feature (301)..(302): n is a, c, g, or t
  misc_feature (364)..(364): n is a, c, g, or t
  misc_feature (396)..(396): n is a, c, g, or t
tggatctatataggatgtgagcaggacttgacctatgtcttcttatgtctgcgcatgtaacactgtatctgtaagtgtgtaggttcatgtagttnggttcatatgtatgtatgtatgtaagtgcctatgtaaatggcgaacgcatttcgcctagacctgtattcctttttttttttcgagaagaaagactttaagaaggtttgagtaaaaataaacttaggcgagcgcggnggtgccctgaatccagactttggaggcaggcggcggacacaggcaggagacaagactctggtaacatggnnaacccgcttcttcaacttaccggcgtggtggaggccctgagcccagtctcgggaggtaggangagaatggcgtgcctgggaggcggagcttgangagctgag

SEQ ID NO: 603709 - DNA, 144 bp, Homo sapiens
ggaatcggcttcggtcgtgggacctgccctcagtgaggagacagggcagtgcctttcaagtgcatgcagctcactgatttcatcctcagtttccgctcggtgcccaccacaagtatgtccgacaagcctggcagaaggcagact

SEQ ID NO: 603710 - DNA, 1116 bp, Homo sapiens
  misc_feature (870)..(870): n is a, c, g, or t
acacgatcatgcgcaccgctgttactgttgtgtttgtgctcccgttgtggccctccacaggccctgtgtgtggccccctttgttgtgcaccggcaggggccgcgggggtcgtgtgtgaccccggtctagttgtgtccgcccccgctatgtgggttgtggggccgacaattccactgttgatttgggacaatattgggcccataaccatcctcgtggccgaggcgaaagtttccctaagctcgaggtgcccccctgcggataagatgtcctctgtgggggggtacaaacgaggtgtggatccatgcttgctataaatttcttatgcagcagctgaggttagcacacgaaagggtttttagagacctacccacacaaatccccctgtggtttcaatgggggtgggacactccccgtttgacccgcacgaaacacacgcgaggtcgcagaaatttctaacgccccgctagggcccgcggctcgaggaaacttccggcttcagcccattgtgtttcaaccccccaagggcttctctgggggaggtacatctctacttgcgcaacggacaaaaccgcgccaaagcgtcgtgtggcccgctggtggcgtcttccaagcccacactggcgcggcccaccaaagcacacaggtggagcaactgggagagaaataattccccaccccctgggagttgacagcaacatttctattctccgatttgcgtatgcgaccatccgagggagaccacgaggtggtccttgttgtgaggagagcctctatcttcatcgcggagatctcgccacagagttttgcctcgcctgagatgccacgtgtgagaagtcatggaagacggagatgcatgatcacgagaacganaatgtgttcaaactgaacgaggagaatggagaaagtacgcgcatgccctgaaggctggaactccacgagtctgcacaccgcccggccacgctgggaattctgagctgcaacgctggctttttagtgaattcttgcgttttgttacacaaattggaagcccgggacacgatcatagatttttgattttatgtaaaattttgcctaaaacattaaaccaagtcacttttcctgacaaaaaaaaacaaa

SEQ ID NO: 603711 - DNA, 142 bp, Homo sapiens
caactgtatgtgtagacggacttgaatgcccttttgaaattctcgactttctttgaactgtggtgatatcataagagaggaagagtgtgactctattcttatatgtatcagtgactatgccattacatgaacacaaggcact

SEQ ID NO: 603712 - DNA, 424 bp, Homo sapiens
  misc_feature (246)..(246): n is a, c, g, or t
  misc_feature (388)..(388): n is a, c, g, or t
  misc_feature (402)..(402): n is a, c, g, or t
gtaactgcctctaccagcaggtgatgagcactaatccccagagaagagctgccggccagggtgtgctgtgctgctgcgaaggagagaattgaggttgctgggacctggctggggagcaggaggggatgaggaaggaaagcaggagaagccagaaaggagggttcacaggagccagagctgaggcgggaggagtcgggtgctctgcccgagagctgtgtgtacgtccattttcaggttcttccaggnactcagtgacacctgggtttgtccagttccaaagcggaaagttcagattcaggggctgctaccctagcaaactgttttccccagcaggggaatgctcctggctccgcaacgttcagttgtactgagggcagaattgtggtancctggcgctcttcnccagctgaggaccatcgttgga

SEQ ID NO: 603713 - DNA, 217 bp, Homo sapiens
aaactaataggctggggtttttgttttgttttggggttttgttttgtttggttttcccttttagttactgaacccttccaaggttttgtaaagagatccctttttttgtcccaaaaatagccaaaagaatgctgtcaatattgggggcctgtaatgtgaatttatgttggggaaaacaattttttgttcccctttttaaaaccttagggtcctttta

SEQ ID NO: 603714 - DNA, 413 bp, Homo sapiens
ccttaagatactatacaattggaagtctctgtacgagctaagactcttgccgtaataagccatcattgcaatgtgcaagacagctgcttgccggccgcctcgaacattggcccacagcccaatgtatccatccaatacccgtgttccagagtcttaagcttgtgcctaaggtaatcccaaccttccttatgagcatttagaacattggtaagatatttcccccagtagcgctttttctggattagctacggtgtcattctaatgttctgtcaagttcttaaaatcttcacttggttgcaaccatagttcacttccctgttccatttatttaattccaaaggtgagagtggagtgaaagtcttccatatctataccttgtgcacagtgaatgggaactgtttggtttagggatc

SEQ ID NO: 603715 - DNA, 975 bp, Homo sapiens
  misc_feature (276)..(276): n is a, c, g, or t
  misc_feature (406)..(406): n is a, c, g, or t
ccacgcgtccgctccacacactttcctcttttcccgagtatggtgcgttggggtgtggaagtaccaagtaagctacaagcctcctagttctggatgagttgggaagggcatcatgacctcttgtgcctctcctgtgattctcaatgctacccgccatacagcactggtgttggtcgccagctcgccttcacctcgcttccaagacgtcccaatgatctaagtgctcaaggttctgcgacggacactgatcacacattccctcatggttactcgatngcttagctagcgattgtgatggagcagcggcattgttggcctaaccaaaggccgtcgttccctaatcgcgccgtgtgggacgcaagtgccttcgtagtatttagttgtatctgcgatgttcgttctgacngtgttcccacctagcgatggcgctatgtagcttgccgcaccatcctgccttcacctcgaaaacccatgcacgacctcccattcgtgccatcgattgccagatgactaccttagtgcgtgcgatgcgctacacggagtagatggacactggggacctgtgctgttgcgactcgctgcgatagcgatggcgcgcggcgattgtgatcaaaggcgttgtacaacaatccaagattatcaaaggtccctatggaacggatggctcctgatactggtctctcagaggtgaccttgacacagcagttgcatccagaacttcccagccccgatgataaccaaatgaagctaaccgcgtgagaccccttgcccgatttagcataactaaggcgcctcagagcccaaggcgagcccacgcttttgaggcttgagcctaacaaggaaccaagtgtgattcaacacttggcgattttcacgtccacaggaagctccgagagcacggttttgaggaaccaggtcccccttggagcaggtccagaacgggcgcctcatgttgcggttagctggagtacttcc

SEQ ID NO: 603716 - DNA, 935 bp, Homo sapiens
acgcgctgctttcaatgccctttcttgttctaccttcatcggtcgatctaaaagtgctgaaaccatgtgaataaaatacaggtggacacctgcgcaattgtgtgtgcccaccgtgcccctgaagcatggccatgcagctgtgcatggctgacagcgccaaccaacctgacattaactgaaatcgcgcagcatgcactcctggtcatgggaggcaagaacattacctgacgtcaattgagaggcaatgaagagaatggagctacaattaatgagagcagaccagaaacctcaactaaactggagatggaaacagcaaattgaaccagagagacacaaacagaagaaaagacaagagaccaccacaaaaaccaacaagaagcagaagaaaacagacaagagagacacaacaacacaaaagaagagatagcaagaaaacacaataaacaagacaacaagacagacaaacaaagacaaataagcgaaaacacacagagaaaaaagcaagagacaggagactttggacatacacagtagaatagaaaagagaaccagagcaaaaacatgaggacacacaagaggggaagaagccaattgcaacaacgaaaattgaggaccaacgaatcaaagagaaatacaggacaagagccccacgcaccaccaaatcaaaaaggacagcacctagtaagaagagacaagacagcacaggacaacccaggagaaaaggagcgaacaacagcaccccaacagaaggacacaagggcaagagacagctaccaagacaccgaaaaaccagtcagaggcactgcgcaacacacagcatcagtacaaaccgaagagcaccgcaagcacaaacgccaaggcccaggacgcccacagggtagacaacagaccagagggcgcaaccaacaacccgagccagccccacggacacagat

SEQ ID NO: 603717 - DNA, 103 bp, Homo sapiens
tcctgagctagtattgtgcctattgccatactagtctttgccgcctgcgaacagtggtgggcctagccctactagtctcaatctccaacacatattgcctagt

SEQ ID NO: 603718 - DNA, 357 bp, Homo sapiens
  misc_feature (153)..(154): n is a, c, g, or t
catgttcagtaggttgtctaaaaaataaaaatgcatttaaactccttttaagaatgccctttagttaatgcatatttaaactaaaattgatcctggaggttccggagaagctagagcctgattgtaggctactacttcatcaattaacttccnnacatggagactactttctgggactggaatataaaaaagaatccaaggttctgattttgagttgccataaaaggaaaggccctggttataacagtgcccaccttttaaatgtggaacctttacccttttctccccttccacggaaagtagttaactgggaaaagatttcccaaaggataaaaaaaggctccttccagtgaaaaa

SEQ ID NO: 603719 - DNA, 152 bp, Homo sapiens
  misc_feature (146)..(146): n is a, c, g, or t
acacgttatagaccaggatgaggaaggagaaggattacagccacagcagttacacccatggaccacaaagttgctgaagcagctgaggaaggcagagaaggcgagagggagttccggaagaagttcaaggtgaggcctctgagctnaagcag

SEQ ID NO: 603720 - DNA, 282 bp, Homo sapiens
aaaaagagcccctccaatgtggaacctcctacacagccccccttttgggtccctggatatgagcccccagcaggacccccactttagggggaagtttccctcccatccctcagatccccacattgttcctccctgtaggaaaaaagtcagccctgcccctggagcttttccaaaatggccctggactccccgttatttttaggaaccaggagctgaaatggctccggcttaacaacccagtatggccaaagtggaaaggttttttgtcctttgcagtcccca

SEQ ID NO: 603721 - DNA, 1010 bp, Homo sapiens
caaagagcaagtagcaggcccagtgtctttcctgctgatgttttcctgggatggtcccccatcacaacctactccctgggtgctctcaggtggattcgtggagaggcggcgcccagtgtgggccttcgtggaggaggtgccctgtggtccgcctgcccacgcgcctggttcctccctgaagattgtggctctgtgcgccgggcgcgctcaccagtgattgttgggcggcagcgcagtgtgccgtgtgtggcacgtgtgcctgtggcaggtgagcctgtggctgcgtgctgccgggaacaccgttgctggggccgtgctggtggctagagtaggtggctgctgtctgtgcgtgcgcactgcttcgactgtctacggggaccccatagtcagttgggcggccttcctaggcacgccgttcctgagcggcgcggaggggcacgctggagcgctgtggcgcgcatctacaagcgacccgttctacaatctctacacgctcgacttacgacttggcgctgctggagctggcggggcggtgcgtggcagtcgcctggtgcgtcccatctgcctgccctgagcccgtgtccgcgtacccccggtactggcacgcgctgcgtcatcaccggctggggctcggtgcgcgaagggaggctccagtggcgccgggagctgctgaatgcggccgtgcgcctcctaagtgaacgaaaccgtgccggcgcttctacccagtgcgagatcagcagccgaatgctgtgttgccggcttcccgcaggttggcgtgtacatgtgctcggtgttacgcttggggaccctgtgtcttgcggtgagccctctggacggatgagtgcaaaggggggtccataacgtgggctatgctttggccggccccacatcccaagagtataaacccgggtgcaactgtgacaagctgcataggaccagacatccagaagtaacacaagaaatggcaggcgagaatctacataagcacacgacagagaacacaaaccacc

SEQ ID NO: 603722 - DNA, 265 bp, Homo sapiens
ggtaagagtagcaaatgagacagggaacggtcgtgagtctgtcgagggctattgtatacagtagtaaagaatcatggcttgcttacttttacttgaaaccaagtctcactctgtcaccaggctgaagggcagtggcatgatctcagctcactgtaacctctgcctctcaggtcaagcaattctcctacctcagcctcctgagtagctgggcatataggcacacaccaccatgcccagctaattttatttttttatttatttaatt

SEQ ID NO: 603723 - DNA, 545 bp, Homo sapiens
ctgaaaggagaaggagcaggagagttgtgtgaatgagcataagtgatttcctcgggagatgccagatagagagcaatatgctcacgaaggtcgctcctcccatggctgattgccatgtgagtgatatggagcagcgcatcggatcccaagctgaaaatccctgggctgaactcgcccatccctgagagctgttcctttgggtaccatgctggtgggtggggcacatctccagtggatgagactgggaaaccgctctatggggacgtgttgggaaccaatgctgctgagtttcagaccaagactgaggaagaagagatggatcggagcccttggggggaactggtgtcatctgatgaagaatcctcaggagaagaggaagaggaggagggtgatgaagacaaaccagatgagagagggtttattagccctggagagaggggtcttatcactcctggaggcttttcatcagtgcctgctggaatggagacccctgaactcattgagctgaggaagaagaagattgaggaggcgatggacggaagtga

SEQ ID NO: 603724 - DNA, 149 bp, Homo sapiens
agccatagaggatataagcatgggcacagactatatgactaagacaccagaagcaatttgcaatcgaagagccaaacagtagacaaagtgggttctatattaggataaaggagcttactgctgaggcaaagagaacctgatcatactag

SEQ ID NO: 603725 - DNA, 153 bp, Homo sapiens
  misc_feature (83)..(83): n is a, c, g, or t
atctagaggatcctgctggaacgagacgacttgggcacagctggctggtgttagaatgatataatattacccctggacaaaanctactgggtggttattctgtaaatccagacattgtgtgagaaagcactgtaaaactttttgtactgttag

SEQ ID NO: 603726 - DNA, 433 bp, Homo sapiens
tacagcactgtgttggcgtacatgcctttgcggatgaccacgtcacactttatgatggagatgaaggtagggctttggatgccacaggactccttgcccacaatggatggctcgaacagtgcctcaaggcagcccaaccgctcattgtcaacggtgatgacctggccgtcaggcaactcgctgctcttctacagggaggagctggaatcagccggggccatctcttgctctaagtccaaatcgacgtatgacagcttctccttaatgtcacgcacgatttcccgctcggacgttgaggtgaaatgctcattgctctcatcataagacttcccgcatgtatacactctggtccctgcccgccaggttccaacgcatgatctcatggagcagggcatacccctcgttgatgggcccagtgtgggtgaccccttta

SEQ ID NO: 603727 - DNA, 558 bp, Homo sapiens
tctagaggatcccggactggagatgtctgagtgagactgagtagttctaatgcccgccaacacaatatccattctgcaaaccatggatcgaggagtaattttgactttgagcttttttggaaggaatatattgtgtaaagctgtagtcactatagatagtgattcctctgatggatctgggcaaagtcagttgaaaaccttctggaaaggattcaccattctagatgccattaagaacatttatgatttgtgggaggaggaggtcaagatatcaacatgaacaggaatttggaagatgttaattccaaccttcatgagtggctgagtggtttgaaacttccagtagattaaataactgcagatgtggtggaaatagcaaggcgaacgagaagtggagccttaagatgtgactgaattgctacagtgtcatgataaaactttaataaatgaggagttgcttcttatgggtgaataaagaaagtggtttcttgaaatgaagtctactgctgatgaaaatgctgtgaacctcattgagatgactacaaaggattcggaata

SEQ ID NO: 603728 - DNA, 194 bp, Homo sapiens
cctgaagagagctgatgatcagctcattagccacatcacaggtgccaattctctaaagggtagactctgtgcagttttgaagcctggaagacaatacctaccgacatgttaaagacacagatggagtatttctgctatgatgaagattaaatagaagaatgacagatggcaggataacatgtgatgttctgact

SEQ ID NO: 603729 - DNA, 119 bp, Homo sapiens
aagatcccgcatttctctgcgcttcacttgggtcacggctactcctgtcttctgctttgttgtgtgcctctagctgagttgagcctaaaaataagcacaaaccacaaaaaacaaaaaaa

SEQ ID NO: 603730 - DNA, 333 bp, Homo sapiens
ccaagagcttgaaagctttcaggatttcttcttatagtatctttctcagacattttctagggtcatcacagttaaaaagtcaacaaagttcattatttcctgtccctatacctatatcaatttcacttcatcatttacttaaattatcttctttctatgggttcaacagcccagaggccctacatttgccaccattcagttactttcaacatactcatggtagccagttaccatcacgcatacgaaaacgatcacacagcttacccggaatctacctgctttatagaactatcagatacagctccagagcttaagggctccatatacttttat

SEQ ID NO: 603731 - DNA, 668 bp, Homo sapiens
ttctgaactgttgggtatgtgcttgctcctctggacatgcagggtctggtgactggagcgaagcgcattcggaaggctgcggcagcagtgcacgactcgatgttcagaccgggtgtgctactctcatggcgtctggcacatggtatgcactacctctggggcctcgggggagaggagaccttctgggcactcgtgggacagcgtctgcgcgtgtgcactggactgcggacgccggacagggatgacaactgggaaggcgtggcagttggacgagcagggcgtgatgcgcgtggtcgactggagcctgggctagggcaatgcgtgcaagcgacctgcaggcacagccgggacgatctgaagaggggaagggagacagcccggatggagcagggagacaggcacgggacgaagggacggggggacgacagggacagagggtaggatgacgggtcagggcttgacggggaggagtacggggaagcctgaagacgatcagggtgggagagcggcgcgctggcgatccagggtgcacggcggcgtgggtcgtggtacggagaatggtgctagggggcacgagcgcagaggtctcggcatgagtgggcgcgagggacggaagtgcgagggaggaacagcagagcagatgggcggtgctgtctggatggggaggc

SEQ ID NO: 603732 - DNA, 154 bp, Homo sapiens
ccctcctcctttttaatagggtcaacactgttactacttccttttaaaaatgttttttttagttgtggtaaatacatgtacatacattttaccattttaataatgtttgaagtgtacagtgaagtggcattaagtacagtaaaaaaaaaacatt

SEQ ID NO: 603733 - DNA, 240 bp, Homo sapiens
ctaggttggacggcaggcagggccgtggggagctgtgtaggtgctgggagctggctgggggagccacaggggtagctgatgtcctgctgtactctgtgctggggggaggccgacttcctgtagcccagtgggccaggctggttttgatctggggcagatggctttccacatcaccagggagctgaagtgcaaacctgggcttgcagaggcaggaacaacccagaagtcagtgctgaggag

SEQ ID NO: 603734 - DNA, 91 bp, Homo sapiens
atcagctcgtaccatcgatgcagaagatcactcagattgggggttcagactagcctggcacatggcaaaatgctgtatctactaaaaatac

SEQ ID NO: 603735 - DNA, 761 bp, Homo sapiens
ggtggtgtcgatctacgtccaatgtgggccgtaccatggggagaagactcaaaagagtgtgaagattgctcctggagcagttgtatgtgtacgaaagtgaaatcagaggagatgtacactatcggacctcggaacagttgatccaccctaaagcaagaatcatggcggaagcggggccaattagtgatgggcgaagggaacctactagaagaaccaggcccttatcataaatgcttaccccagataatatcactcctgacactgaaagatccagagcgcaaaaactatgatcattgggcacccaattaactgtgttccgccagtggggctgtatattcccaatgcccatgacagactggcgcgctacctcactggtccctttgatctcaacacagctttattgtagggcagcaacgtgtaacttcttgggcacaagtggcgctgcactcaattggggcggcttgtgtttcacaacaccctaacataactattttggacgaggtcatccccctggacgaaattaccgcgagcgcaccttactgggtgcacggacgtcgccttgcgtcagcgctgcaagacctggaggtgcagcgtgcagcccccaagaccaacatacagcttgccatttcttggcaattgaacatctcttggcgcaatttacccatccactcttacaggacagactatgacaacggaagtctccactccagtaacagatattaggaccccgtgctttaccatgtgacgcaaacattctggga

SEQ ID NO: 603736 - DNA, 447 bp, Homo sapiens
atagatcgagccggtacccgtacttttaaacttcctctggtttcctcttttcatcgtttctcccttccccatacacgtaatgtgctagtcttagaataaaaacaagcttcccctatcccattctgaatttttcaatgtagctaataaagtccagccgcttgaccatcctagatgtcttttcaaaccaacgagttgaaaaagatcagattatctcagccattccctcagtctctttaacaaataatgataaagcagacaggatttaaatgagactgctgtaagagcacaaccccaatgcatgcaattgacccttgaacttccagaaatattgcaagaaaaatacacacttatttcatttctgttcccttgctctaatggctttgcaaatacatcctccttagagagcctacctctccacctcttcacttgaccagtttctactcatcc

SEQ ID NO: 603737 - DNA, 110 bp, Homo sapiens
aaggatctcaccaagcagcaccagtatgtgtacataactttaaggagcttacagtctggtaggacgcataggagactgttcacaatataggataataataagtgtgacgc

SEQ ID NO: 603738 - DNA, 132 bp, Homo sapiens
tggcttgctgccgtcggcgagggtcagctcgactcctgactgtcgccgtgctcggagatcagtgccgactttacgtgtgccgtagaagtcgccgctgtccatgtgcgccgacgtgcgaattggagtcacgcg

SEQ ID NO: 603739 - DNA, 283 bp, Homo sapiens
tcctgtgtgctgtcgtgcctgacctgatgcagctacgttgtttactgggtataggtatcatagagagtgctactgctgtacttatggaggctacagttaaatgagtgttacaaatctcttcccccagaatccgagcttctaaatggcatgttactgtgaaagcaaaactcacactgagttctgccacacacaaaaaaaatttactaggaagcaaggcacaaaaatactgttgcattaggtggataaaattcctactctctatgcttttagaacatctgacaag

SEQ ID NO: 603740 - DNA, 704 bp, Homo sapiens
ccagtctctagcagttatgttgttagaatggattcatctgtgcttatttcacaatacttcatttatagcaatgcttttccttaagctaatgtataaatatttctaaaggccattaatagtaacaaaataagtaggggaaaaaatggaccttctgtataaaaaccccttagcttttttttttcacaagttataagtggaataagttaataactgagctcgtaagtgtatctcataactataagagctacatgaagaaaataggaataacacacctggtatttaaacacaatcttcaaaattcttgcaacattaaacatagtaaaatgccagaatataaaatgaggtgtgctaatggtcacaggattgaggccagcattacagtttggggtgatttttcttttatttgctccctcactttgtttcctagatgctagtaggggtatctgggttgcttgagataccattttgcaattgccccttctctttctgcctaccatcttctcaggccctgatgagcttattggtaggcaactgggctgctttaatgttgaacttgtacttctttagaaactgaagtggaatcattgaaaactttcaataaagctttaaagttccatttacttttgaagcacagctaagctcctgctgaggcagctggtttgttgcaaacttaaaattgaactgatatgagccggtaccgagcc

SEQ ID NO: 603741 - DNA, 116 bp, Homo sapiens
gccgagaactaggctagcagttgggaccatagtgaggatgagactcgtgacagatcaggactttgaggcttttggggaagctcttcagagccagcatgccgttaggcagggtctcg

SEQ ID NO: 603742 - DNA, 133 bp, Homo sapiens
  misc_feature (3)..(3): n is a, c, g, or t
  misc_feature (124)..(124): n is a, c, g, or t
ctncctcaaatgttcagtcagatgctgtacctagcatagttccttgtactcagtgggcgactagtaaaatgttgtggattttgttaatactcagactcaggttatattaagagtccattttgtngaatagctt

SEQ ID NO: 603743 - DNA, 1148 bp, Homo sapiens
gttgacgctataactcgcctctgacgagaagcgagtcctgcgtagtcagcatcgccttagctatgcagcagtgtgcagtgacgcacgaatcgtcacggcgacctcgtagctaagatgcgtctagtacataacactatacatatgacatctgtgaacagcgtcacgtagtcccagatcatgcatttgtaggcccaacatgggttgccctgcgtcgtgcgttacacgtgatgcttctgtacccctggaagaggaagcgcgctagaaaacgtgcgcacatgtaggacataccccgccgatgcggatgcttccctgggagtaggtcgtcctggcgcggctgggccctcgactcggtaccaacctggatctccaccggcaccttctgcgtccgcggcaccgccaattgttgcctcccgggggcccctatttacttcgttgacatcagttgggcgcctggtgccttccggcctttttggttccccccgatatctcttcccaagctgtcccatatccctatagaaggcggctcggatcgggcacaggggatttaactgccaccacatttaaaaatagggcaacaaagaaaacacttgttattccccaccaccaagtgaagagacccctctctaaaccacccgtacacgttcatggttctacctcgtaatggcctccattatggaatgtaaacaagagactatacatacatctcccactgccacgtctgtcttctctccctttgggtggctgttctacgccctcgtctccatcctcttgggccccggtatttctcagtgagagcctcccgctgtaacttcggtcctattaatagccctatcttggccgctgacgcttccttcctgaggccttcttgcgccgctctccttacctcttgttagtgccaatctccgtccttactgcggtctgcctatggccggcccacaaaactgtgttcacggcacactgaaggttaaacgcagctctttccaatcacccagtttctctcagcctctttccccaatactcacagttggtctcatgaggctttgcgaccaccctagacattggcaatcgcccctaaatgagttcccaacagcttttcaatcactcttgttgtgccccgaccccaataaggtgcattagaccattcaagg

SEQ ID NO: 603744 - DNA, 86 bp, Homo sapiens
taggttttgtcccttttttacaggacaggtgactttctgtaacaatgcgatgtatattaaactttttataaaagttaaaaaaaaaa

SEQ ID NO: 603745 - DNA, 282 bp, Homo sapiens
gtgaccttggctcactgcaaccttcaggccagcctcagcctccctagtagctgggactacaggcacccactaccacgcctggctaattctttgtatttttagtaaagatggggtttgaccgtgttagccaggatggtctcgatctcctgacctcgtgatccacccacctcggcctcccaaagtgctgggattataggtgtgagcccccgcgccgggccggttgctggcatcttatgttctgtaggtggaatatttccaataaacccaaggtgccgtaattga

SEQ ID NO: 603746 - DNA, 431 bp, Homo sapiens
atgagagaattcattccgcagtgggtccgtatggagattccaacaaagctgggtttctgtcgtgggggagggaatcacccccaaggaaatgatatcacagactcactctccctttctaatgaactatcgatttcttcaattaactggatactgacaatgtaagtagcactagtagtagtagtactagtaattgtcttcctcaagacatcaaacacacaactgcaacttcagctcctaaagcagcttttttttttcttttttttgagacagagtctcatcctgtcgccaggctgaagcgcggtggcatgatctcggctcactgcaacctccacttcccgcattcaagcattcaagtgattctcctgtcttgccctcctgagtagctgggactacaggtgtgtgccaccacacccggctgattgttttaattt

SEQ ID NO: 603747 - DNA, 1197 bp, Homo sapiens
cggttattgttttcgtgtccacatgtcgcattggtctgttttcctcgcttctctcgtcttcttccgctcggcctctaccaagctgtgcgtcttgtcatcagcgtcgttctgctggtgtggcggtctcatctcatttttgtttttggctgctgcgtcgctgcagggcttccccatctcgctctgttggttattcgttcactcgctgcggtccgccgtgtgttggccgggttggcgtattttacctactctcgcctctctttttcttcttcctttcctcgtaggtgggatgggtcagctcctgcatcaacactactcctctcatttcctagccctgcgtcacactcctcttgtgctttctctatcttcgtgcttcctcctctctgtgcttcattgtgaatatcttactgtcttcgattgaacggctgcggccccttgttctatataatcaagagtctgtctccctccctcgcttgcttgctacttctctccctctcgttcccttcccgcatccaccgtgtttttgctgttcggtcttgccgtcccccctcatgcgcggttggtggctttctctctctctccctctctctccctccgtcgcggaggatacaaatagtatgtgtgttcccgccccccttctctcgcggtgggtggtggaccaaaattggtggagggttccccctctcgcactggctctctctctctctctttctgccagcctcctgtggcgcccctgccccgtgctccctcttctcttttatccgttctctggtgcatgcatgcgattcccccctcgcgttctctctctgcgagggagggcgcgccatcgctaccggtccccccctctctgctgctaccgacgctccacaccacactcgccacgcgctctctctgtcggatcctccgccaccgtgaggctcctctctctactacccaccctcatgtttgtgtcttcttgcttctgtttgttcctctccctcgctatctacccccggcgctcttcctctctcacccccaccctgcaggtctgcaggttggtgcctccactgcctctgtttcatgggacagccaccctcggcggatctgttttttttatagtagtgatatgttcatgcccccggcccccttttttttttttttttgcaccccggttttgggggacatttggggggggaggaaaaatttttttttttccccaca

SEQ ID NO: 603748 - DNA, 115 bp, Homo sapiens
ggaacttcctgagggcctgatatgctactgtaggcagttctgggttgagtgggtttctaggctgagcgggtttcttggagccagcttcagattctcatcttcagatcttggacct

SEQ ID NO: 603749 - DNA, 333 bp, Homo sapiens
ctagagatcccttcagccatttagtggaatcgggtcttaatggatacgggtttcttcaccggactatttctccctcaaactcttggcctcggctttttctcttgtagccgggttctcgggtgtgaacaggagcagatgaccaatagcacctagctgggtgacaacccataggaggtatgcctataaaatgccaggggccactgagtgttcacggtgaggatgacactatgggcaaggatggatgattggtatgtgaactactgatgagaaatgctccagagtaggtacggaccagccttctctagtgttccagacacctgtctgagtttcttg

SEQ ID NO: 603750 - DNA, 351 bp, Homo sapiens
  misc_feature (46)..(47): n is a, c, g, or t
ccccccccaccccccccgggggggggaaaggcggggggcttttttnngggggtcttttcctttcccgaaaggggggggggggggaaaccccccccccccggggccccccccaagggggtttcgggggtttccccccccccggggggccccccccttttttttaaaattggggggggggggggggggggaaaaggggaaaaaaaggggggggacctttccccccgggggggggggggggggttttccccccccccgaaaaaagggggcccttttttttttgggggggggggggtttccctgtcttttccccctttcccgggggaaaaaaaaattttttttttttttttttta

SEQ ID NO: 603751 - DNA, 177 bp, Homo sapiens
tagtaacacttaacacataatacgttagtttttctgacaaggattactttttgtgtgtgttaccattacacgagcgactatttatcatgcactgtacaatctatgtgactctgactactatttacactgttatctacaatctaacgatgcgagacgtagtcaattcaacgctggtat

SEQ ID NO: 603752 - DNA, 350 bp, Homo sapiens
gccgggcgcggtggcgcgtgcctgtagtcccgagtggctgggattgcaggcatgcaccaccatgcctggctaattttgtgcttttggtagggacggggtttctccatgttggtcaggctggtctcgggctcccggcactttggggggccggggcgggcggatcgcctgaggtcgggagtttgagaccggcctggccggcatggcgaaaccccgtctctactaaagagtgcaaaaaattggccggacatggtggcatgtgcctgtggtctcagcctcccgagtagctggcactacaggcacccgccaccacacccagctaattttgtatttttagtagagacaggtttcac

SEQ ID NO: 603753 - DNA, 944 bp, Homo sapiens
  misc_feature (13)..(13): n is a, c, g, or t
  misc_feature (121)..(121): n is a, c, g, or t
  misc_feature (132)..(132): n is a, c, g, or t
  misc_feature (168)..(168): n is a, c, g, or t
  misc_feature (191)..(191): n is a, c, g, or t
  misc_feature (205)..(206): n is a, c, g, or t
  misc_feature (234)..(234): n is a, c, g, or t
  misc_feature (236)..(236): n is a, c, g, or t
  misc_feature (241)..(241): n is a, c, g, or t
  misc_feature (246)..(246): n is a, c, g, or t
  misc_feature (255)..(255): n is a, c, g, or t
  misc_feature (291)..(291): n is a, c, g, or t
  misc_feature (300)..(300): n is a, c, g, or t
  misc_feature (335)..(335): n is a, c, g, or t
  misc_feature (393)..(393): n is a, c, g, or t
  misc_feature (418)..(418): n is a, c, g, or t
  misc_feature (427)..(427): n is a, c, g, or t
  misc_feature (638)..(638): n is a, c, g, or t
  misc_feature (640)..(640): n is a, c, g, or t
  misc_feature (738)..(738): n is a, c, g, or t
  misc_feature (781)..(781): n is a, c, g, or t
  misc_feature (785)..(785): n is a, c, g, or t
  misc_feature (863)..(863): n is a, c, g, or t
  misc_feature (937)..(937): n is a, c, g, or t
ggataggaggagntgaaggataagagatgaacatgaaggtgttttctcgtgtgaatgacggttttacgttgttaatgtggtgggtgagtttgccccattgtgttgtcgtagatatgtaganggtgtataggnctgtgactagtatgttgcctcctgtaagtcggagantcatatttgatcaggcgaccgtngttactagcacagnncgttctcccagtaggttaatagtggggngnaaggnggggntagcggggnttgctagaagtcatcaaaaagctattagtgggagtngagtttgangtccttgagagaggattatgatgcgactgtgagtncgttcgtagtttgagtttgctaggcagaatagtaatgaggatgtaagtccgtgggcgnttatgagaatgactgcgccggtgangcttcaggnggtttggatgagaatggctgttactacgagggctatgtggctgattgaagagtatgcaatgagcgattttaggtctgtttgtcgtaggcagatggagcttgttataattatgcctcatagggatagtacaaagaaggggtaggctatgtgttttgtaagggggttgagaatgagtgtaaggagtattataccatagccgcctagttttaanantactgcggcaagtactattgacccagcgaagggggcttcgacatgggctttagggagtcataagtggagtccgtaaagaggtatctttactataaaanctattgtgtaagcaagtcatattaagttgttggctcaggagtntganagttcttgggcagtgagagtaagtagtagaatgtttagtgagcctagggtgttgtgagtataaataagtgcgatgagnaaaaaaagggagcctactagggtgtagaataggaagtatgtacctgcattcaggcgttctggctggttgcctcntcgggtg

SEQ ID NO: 603754 - DNA, 204 bp, Homo sapiens
  misc_feature (62)..(62): n is a, c, g, or t
  misc_feature (64)..(64): n is a, c, g, or t
  misc_feature (124)..(124): n is a, c, g, or t
tacatgtaggcttgtgtataatcatgactaaaaacaataataattatttttgtttctgcatnantattcacttagcatttataggtttacatgacctagactgacgaattacatatttttatcncctgtaactggcatgtaattaacatagtacttcataactgcagatatgcataggtaatgatagtattcaagtaaaaatgc

SEQ ID NO: 603755 - DNA, 108 bp, Homo sapiens
gtgctgcttcttgaaacactgttatggaggaacatttctgctttgactgacagtctttaaactagtttcattatgtgcttggaagaaacacaagtaatctgttgacgc

SEQ ID NO: 603756 - DNA, 1215 bp, Homo sapiens
tccccattgtgaacaaagcatctgctataaggatttgggttgaaaaaaatctccaaaatgtttccccttagtggaaaaatttttccttggtagctgtaaccagttcaataaaggggagttcaaaagttaacattctcagacatttcgtgaatctccgtggtaattattaccttggggatagcctttcctttctcctccattttaattgtgggcgagaaagagagctgctgtgtaaacctttcccatagtgaattcgcgggtgattctccccgacttcactttaattctcatactttttagccagcacagagggcttataccagtgattgaagtgccctctcaaatgtggaggccacgaatgtggggaaagtgcgggggtgcacatgtgcaaaatctttttttccccatagagtgtgccccagttttaaacaaagagcccacgcgggtgtttttgcgcagaaaattcacccccccattgatacacatcacgaggtggtctcatatgtgggcaacatggtgatgctgtgcgcacacccccacaacagaacgcgggtgtgaggcgcgttggcaattatacttctccttataagagggggacaagagcgaaacacgccccatattggggtgccccatgtgaaaggtgactactttacgtctttatagaacaaaagagcgtccttagggaaataacaagtggttttaaaacagaagtctacaccggtgggtgggcgctttatctttccccccccaatgcggtgggacgaaggtttttggtgggcttcggaggtttataaaccatatcattctctcttatcacaccccacggtgtggggcccagacatgtgttgtggtgcggcaacaaagaggcgccccgacacagcggcaacaccaaccaaaagcacaaatgtggtggcccatctcattactaaaacaacatggtggtggggcgccattttaacaccaataatcttctcactccggtgaaagttcataacatctttctaagacgtctttactacccgaggggtggtattataattataagttgctcccccagaagaaggccccttccatatcatgtaggggcataatagtggccgtgggtgccgaggggaaagaaatttatcaccccgccataagaaaaggcgccctccaagcagatcttaaccgtggcaagcgcaagagatttttttacaccgacagaggataacgtaa

SEQ ID NO: 603757 - DNA, 114 bp, Homo sapiens
  misc_feature (42)..(42): n is a, c, g, or t
tcgtggggttactacggtcatgctctgaaatctgtggagcanacacagtttcatggccatcgtcctagaattaattcccctaaaaatctttgaaataggcgccgtcatttaccc

SEQ ID NO: 603758 - DNA, 123 bp, Homo sapiens
actctgaagccaatcagaacaaagtccttcgtccgggtgcagtggttcacacctgtaatcctagcactttgagaggccgaggcaggcggatcacgaggtgaagagagggtatcctctagaggc

SEQ ID NO: 603759 - DNA, 739 bp, Homo sapiens
  misc_feature (295)..(295): n is a, c, g, or t
ttcagaagtaggtttccatgggtgctgctcctgatatcagctgtgaaggggcctgcctttaatatggcatctcctgagctcacgatttgtggtcatcaaccttgacagggcccaataacatacaataggaggtgcggatgtttacaggggtgtcaagtgccccaagacaatcaagcacttggatgaagggcattatgagtgctaaaaggttccagggggtgcagtgcggaagggaccccaagtctcctctgctctcgaacttggcacacatctaagatttgctgggggcctctcnatttctcgaggacccaagatggtggcatatggacggtgtcgaacatggaggtcagatatggactccacggctcctgggctgatgtgtgtctagtggcctcaacggtacacttggaactgtggatctggaagacatgtaacattgccctaaaatgaagatccccaaatttaccttctctggccgtgacgctggtctggcagagaaatgggggtggcatgttcactatccctaaagcagaggccagcatccaagctggtgctggagacggcgagtgggaagagtctgacagtcgaactgcgcagagtccaagatcaaaatgcccaaggtgtatctgtcccaaggctaaaggggaagggggggcaccggcgccaccagaagcatcacttctggggcccaagggggccgtgaaagccccaaggcacccggggccccgggaggagaagc

SEQ ID NO: 603760 - DNA, 1611 bp, Homo sapiens
tacatttctttcggtccggctggctagaataatgtcaaacaaaaattacccaaaaacaaaaaatatgaaaaaaagtttaaaaaatattccgtgacagaggcccagaagaggctaaaagaatatcagacgtgccccagaggaggccagaagaggaaatatcacaaacacccatcgaaagatcaaaaaccggtgcggaacaagacgaagggtgctacacggaagaaagtctgtggggaagctagacaggggccaccgctgaaaggaagaagccccttacaggacaaagctccgagctcaaaacagtgtgaactcttcggcgcgcgagaaaaaatcagagaggagggccgtttggaagcgcaaagccaagcccaaagaagcggaccaaaagacagaagcgagcccgacaatgcgagataactcaccaaagaggaccgggggagaaaccaaaacccgtgggcccaagggaacacagcgcgaggagccccttatcaacgaaacacccactatctctccccacgaggggcgggtcgtgagaacgcaccccaggaagacaaagacagggggaaacatttgtggacacaacaacacggcagaccactgttgatgaaccaaaaccccgaggggcgcaccataacaccggagaaggggccccccaaggaaagaaactttctcggagaaaaagacaaccaccgggagacgactatcggagctggggaaacaaaatcaacacgtatccccacgagcggcaggaggaaatcaaagaggctgcagcttgcacgaacaccccaccaaaaagacctgagcggaaagagcacccacatagggagagacacatcacacaagaccctagacaccaaccaagaggcactccacacccgaacagcagagtggacaacaccccacagcagacatggacaaactagcgacgacaacatcacaacaaagcgtcgacacgcaacacaaccaagacgacctcgcagagaacgtacacacacaccagcgggaagaaacaacatccacggaaaaaagaagcacaacaacacaacagacaaccagataactgcaacgcagacaacaaaacacagcaaaaacaacaaccgcaagtataacaaacaccgagagaacaaaactacccacggagagacacccaccatgaaaagagcgacaaacacaaggatcacagacaacatacacaacggcacgaaaggcaggggagaccccacgaggacctcacaccaccaacacaagacaacagacacattatctacgaaagaagatgagacaacacacacggaagacaaaaacaccccgctcccgaggagaacgtaagacaaaccacggaaccgatcactagcgaccaaaagcgaacaacgcagtatcattctagaaaaagcacacagagaagagagaagacaaaggacaaccaaaaccgcccccacagatggacaacagaaaaaagaccacgaaagctaactggacgaacaagcgtagaacacaaatacccagaaaacacgatggaagaagaaatgacagagacaaaacataacaaacgagcgaagggaccaaccgaccaatacaacaaacgagccaagcgaccagaggaacccagaa

SEQ ID NO: 603761 - DNA, 186 bp, Homo sapiens
aaaaagttgagaagccagatactaaagagaagagacccgagccaagaaggttgatgctcgtcgcaaggtgaaaaggggtacctcaagctaaaagcccacgaggggagcccctttcagccgaaccctgtccttgtcagaggattggcaggtattccgatctgccatgtatccagaaggccatgtaca

SEQ ID NO: 603762 - DNA, 847 bp, Homo sapiens
gtggagctggaccagtgaggagctgcagctgggccggggctggagctgcctgctgtcgcgccagtggcctgcgaggaggggcgtgttgctgctggcccacctgctgagcctgcccccagccctgcgccgaggcgccttccctgccaggcctggctgccttcctgcctctttccatttccccggaatctcatgccggcgcgcctgtgaccctgaccctctcctgggtggagaagcgtcccggctgttcccggtttcactccttctcagcctgtggctcccagccccctctctccttttcctggactggctctcacccccttcgtgtccccttcctttagctcaggctccctagcccttcctttagcccacagtccagagtcccagctcctcagtcactttcctcagccaaaggtcccatgcttccttcttcctttccttttgcactatccctatccgtgccccttcctctatccctagtggctcagtttcccacatctgtcctcccccttcccaggcccggagttccagaccttttggtctcctttcgtggtcgttcctgggtccttgccccctttccccactttggagttccagatttgaaaccagctcccttccaccccagaaaaatttgttccatgggaaattgcctctctaaaacatgaactttttccttaggagactacggccaggtcttctcttccaattgcttgaccttttgtactatgtggccggtttactctcatttgtggtacggcgaggacggtcttggagcaggcaccatggtctgggggctgggatctgtggcctttttcacatcgatttccctctaccgggggggatggcggcg

SEQ ID NO: 603763 - DNA, 586 bp, Homo sapiens
  misc_feature (39)..(39): n is a, c, g, or t
cgacacatgatggagagatgtatgtatgtttagacatcntggtgatgtcttcagtctttgtccaccccattccccataagaaaactgttctggactctgggcggaatagaaaaggatggctggagggaagctaaaggactaagtggaaagttttggagtggtatcaacacaaataggaatagtagtattttgggggtgtgctcagctagttaagttcctgtactgcagacctttacagagtctttcatatgcccatgaatctccaagagggggattgaatattttaagatcatatacaaaacacaggatccttattttcatgggccatcttacggactagtttctgcaaattacactttgaaaatgatgaattagagaactgcagcaatgatcagttccagttaatttggaaggttcatgggttttggaagggggaagccatactggaaagggagaatgtccgggttaagatcttgaagcacagttccaggctgtggctttgttggtggagagctgggttactttccatatcccagttaaacttgtgttctaccattgagtccagtatcagttgagtcatcatatg

SEQ ID NO: 603764 - DNA, 1677 bp, Homo sapiens
  misc_feature (1597)..(1597): n is a, c, g, or t
tcccctttgtgggcccagtcgcccgtgtttctgggggtttttttttttatacttccaggggtccctcaatttatattgggggggagaaaataccttgtgagcaacaactacacaggggagaaaaagagtctcatacccctttttgtgtccagaatgtcattttatactcccttctccggtctggaacaaaaacgtgtgtgtgtggaacatctacaacaccacaccggagccttctgtggggggcaaaaacaaaaaaacagcttgctctcccttctggctctcgtgggtggaaaacctggggaggggtgctatagcgcccgcggtgtgttagtataggtgccattaaaaatcccatagcctttatttccctctctattctcctcgtgaatatatatgtggggccctcagaagaagttcccacgcggggtgtctctcatagtggtaaaaaatagtggaccggtgttacgacatttttcacacaaacatgtgtttctcgtgtttataacattctccttgtgtgtgtttaaaaacaaaaacatacacaagagagggggggggggggcgcgacctaataaagagaaataactcctcgcgagagagggggggcccccaagaagtatatataagcgcgcgttataccccgcgagggcttttctgcgtgccaccaccacagggggtgggcccacccacaataaaagaggggaagcggcgaaatataaataaaagccgcaaaggccaactggggcccgcgagctgactataccacacacagcgctcgcccacgcaccgggggagcacaacaacgctgtggtcaacacaccgcgggggacacaccccctcgtgggcggaaaagagggaacaacccacataaacatctccgagcggcggcggggggaggaacacaccaacatccatcgtcgggggaaccaccaaaacttccacagcaccccacacgaacgagaaagaaacttacaaaacaccagcgcactcaaacgagctgagcggacacacaatctaatcaacccacacctcactctcccacacggcggcgcatcacacacgggggcgcggttcacaacacaaccaacagagcgggcgaccatactatcgaccagcgcggcagcgaacatagcaacaacaacatattctgtggagccccaaccagcgaacgcaatctcactctctgtctacaaacaaattatcatcagggcgcgcggacactaatcaccatcaacacacaacacaccagagacgacaccccgcacagcacagatcacagcagagacagactacagcactaactgcactaaccgccctctcgatgaacagacaagcaagcaaatacacagagaccacacaggtagcgccaagccagtaagtaccagaagacgtactgcagtatcataaacacaacacgacgacgacgcaacgacaaaaagcaacaaccaagcaagaacaaaacagacaaagcggacagaaaaccagcacgaaaaaacggagcaacacaaaaacaaacatactcacaccatccaaagagcagcgagagagcgaagcgaaacaagccataatgcaacaaccaatcaaagacgatcaagtnaagtaaagcaacaccaagcacagagatgaacagataagaagagaagagaaaaagtagatatcaaattgatattacatata

SEQ ID NO: 603765 - DNA, 216 bp, Homo sapiens
tgtccactctaaaggatccccccaccgggataaccactttcgccgggacgagcttttctatcacctataacaatcattctttgtgagtcatgatcatatgtagcgcatgcctgctcaagtggtattgtgccaagtctcttggggtgctcacgatctgtggcgtcatatactgttgtttttccttgtgaaacatattgcagagatgacgagcctttt

SEQ ID NO: 603766 - DNA, 1417 bp, Homo sapiens
  misc_feature (598)..(598): n is a, c, g, or t
  misc_feature (605)..(605): n is a, c, g, or t
  misc_feature (631)..(631): n is a, c, g, or t
  misc_feature (653)..(653): n is a, c, g, or t
  misc_feature (671)..(671): n is a, c, g, or t
  misc_feature (804)..(804): n is a, c, g, or t
  misc_feature (905)..(905): n is a, c, g, or t
ccgctcttttgacttgtgggccactgcctctgtgtgtgctgccgcaggactgcccctgtcttgctgcgtactcggtcgtcttcttccggccgggcagcttggcgactggcccgccttgagagtggcacccgcgtcttcacgatggtcccagattatttgtacttgggtgtggcctgcccttcccgttctgacccccaggttcagccatccctctcacctgctttcgtcgaagtttcgtctcttttccccctctgcatgtttcccgcgtgtagattggtggggaagacccgttgcttgcttgtgctgtcaccttccgaggctttctgggccaaatcagcccgtgcaccctgggcagagccccttaaagctgctgtccaatagaatgccccatggtcccgggccttgtgggcttagaggataagtgccgggccagataactgggcaaccctgacttgtatatcaaccgggggagctccccagcttcccagcccctgcctccagccttcctgaggttctctctcctgaaccctactctctcctttttgcttcctcagtttttatcaggctttctctgggggacagcagtctctgagcaccngggagcngttgcctcaggcctgtgccccccctntttatacgaatgttttctaccngtgtgcttgggtttgccntgatgcgaggctgagttgctgtagcgtcttgattctctccctgggtctgcgttccctcccctgggcctgactgagcctgctcattgtttttccctttattacacaggacagccaggggaggaggggggcccanccctgggaggctggtgggaggcagggggcaggcctgcggatgcatgaaataatgttggcattattttttaattttttaaaaaataaatggtatcttatttnagtttgtcctgtttccttcccatatacccacggcctcctaggattgttatgcccaacgtctcagggtaatgcccagggggtctgggagacatgaagccagccaagtgggcgactggggaccaggttgcccttcaagcatgtcttctagagttccctactcgtcctcgcacatagctccattcttctacctccacagtacatgactgtccccaacttaaccagtgtttcactcgttataagccatgttgtcagctttacaatgtggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccacaccctaatccctccccagcggaaagcccctcttttcagagtgggcagagggttgcctatggtgggcactaaggaatgaggtcccctgcc

SEQ ID NO: 603767 - DNA, 1448 bp, Homo sapiens
  misc_feature (598)..(598): n is a, c, g, or t
  misc_feature (605)..(605): n is a, c, g, or t
  misc_feature (662)..(662): n is a, c, g, or t
  misc_feature (684)..(684): n is a, c, g, or t
  misc_feature (702)..(702): n is a, c, g, or t
  misc_feature (835)..(835): n is a, c, g, or t
  misc_feature (936)..(936): n is a, c, g, or t
ccgctcttttgacttgtgggccactgcctctgtgtgtgctgccgcaggactgcccctgtcttgctgcgtactcggtcgtcttcttccggccgggcagcttggcgactggcccgccttgagagtggcacccgcgtcttcacgatggtcccagattatttgtacttgggtgtggcctgcccttcccgttctgacccccaggttcagccatccctctcacctgctttcgtcgaagtttcgtctcttttccccctctgcatgtttcccgcgtgtagattggtggggaagacccgttgcttgcttgtgctgtcaccttccgaggctttctgggccaaatcagcccgtgcaccctgggcagagccccttaaagctgctgtccaatagaatgccccatggtcccgggccttgtgggcttagaggataagtgccgggccagataactgggcaaccctgacttgtatatcaaccgggggagctccccagcttcccagcccctgcctccagccttcctgaggttctctctcctgaaccctactctctcctttttgcttcctcagtttttatcaggctttctctgggggacagcagtctctgagcaccngggagcngttgcctcaggcctgtgccagggggacccaaaattttgggggccccttccccccctntttatacgaatgttttctaccngtgtgcttgggtttgccntgatgcgaggctgagttgctgtagcgtcttgattctctccctgggtctgcgttccctcccctgggcctgactgagcctgctcattgtttttccctttattacacaggacagccaggggaggaggggggcccanccctgggaggctggtgggaggcagggggcaggcctgcggatgcatgaaataatgttggcattattttttaattttttaaaaaataaatggtatcttatttnagtttgtcctgtttccttcccatatacccacggcctcctaggattgttatgcccaacgtctcagggtaatgcccagggggtctgggagacatgaagccagccaagtgggcgactggggaccaggttgcccttcaagcatgtcttctagagttccctactcgtcctcgcacatagctccattcttctacctccacagtacatgactgtccccaacttaaccagtgtttcactcgttataagccatgttgtcagctttacaatgtggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccacaccctaatccctccccagcggaaagcccctcttttcagagtgggcagagggttgcctatggtgggcactaaggaatgaggtcccctgcc

SEQ ID NO: 603768 - DNA, 454 bp, Homo sapiens
attggggtagcagggactgagtgtgagtccctgttgtaaactcggaccagtaattttgcatctataggcctccaccctcccatctatgaattgagactgataaacccacctcaccagggcccagtgggtccggggaccaacatgtgtgaagatgcttcactggaaagcattgtggtgacatgtgtgacgcacgtggggaagggtcagaaaatgggttgagtgaagcctcgtacagctaagtcgggtgggtgggctggaatttggagctggaatcttctggggtgatggtgcccagccaagcctcggtggccttgactggaaaagtctgcccattgtgaatgcgcctcctgctctgggcaaactgtgctcattacttgctcactcgtaggctctccagactctgccctgagtcactttccccatatgttagctgtctccaccctgtgttatcaaa

SEQ ID NO: 603769 - DNA, 254 bp, Homo sapiens
gacgccccacaccgcagggatgcggacagacagcacctctatgcctcgagtctagtgaggcgcgtcacacattcgcaggagccaaagccatctcatctgacatgttctttgggcggccagtggatgcggagtatgaggccaggtctcggctgcaacacctctcagagcacagcgccatcagctcttcagacctgtttggggacatggatagagctcacagagcacgaagtgtatctctggggaacgtgctgcct

SEQ ID NO: 603770 - DNA, 618 bp, Homo sapiens
ggaggaaccaggattatctatgacgggaaatttctgatggagtgtcggaactacctgtggccaaaccccccaaaaggacctgccagccattcctggggtcactagccctaccagcgatgagcctcccatgcaagccagccagagccaactgcccagcagcccggaagataagcgggcaggcggtgaagagtcacaatttgagatggacatttaagggaccagccgtaggacgcaatgatgcttctatgtcccccaaggcccttgggaggagagctgcacagcattcaggcctcataccaggcagacactgggtgtgggtcggccacccagtcctgctcctcactcagggtgccagctctgccttgaattttgtgaacaccagcacatacctccttgtgcctctgtctaaaccgagctgctactgcaggggaatgactctcactcacaccctccctgcatggagctccagcgagtggactcagaggagtctatcagaatgatctggcaatcctagccccagcctccggagcacacccatctttccttaggctgggttacctgggaaagccacacttttacttctttccctgacaggaaataaaagccacatttacccta

SEQ ID NO: 603771 - DNA, 142 bp, Homo sapiens
ggtggattagcagtaaactgagagtagagtgcttagtttgaacagtggtcctgaagcgcgtaacccgccgtcagcctcctcacgtatacttcaaaggacctataactaagaacccctacgcaataatatagaggagacaagt

SEQ ID NO: 603772 - DNA, 131 bp, Homo sapiens
tcacagctactcaccaaagccaagctgagagtggttacagacttacctaaggtcacacagctaagaagtcgtgaacctgggatcgaatcaatgtctgtgtttatggagtttaacatatcatgttgatggcc

SEQ ID NO: 603773 - DNA, 413 bp, Homo sapiens
  misc_feature (94)..(94): n is a, c, g, or t
  misc_feature (175)..(175): n is a, c, g, or t
ctctggcgtgttagcagattatgcaacgcttggtcaagctttaattgaagcaactgaacaagctattcaagtggatcaagtgacgcaagacgantatgttgccattctagaaaagaacgacttgccacatgatttggccgtgctctttgcttcattccaaagtcccattgccgangatcgcttgatgtggcttcagatgatttagtaactgttttgggtcgcgacttaacgccattgcccgctgctttgaaggaaattttgtcacggtcaagcttaacggattgccagtaaccaatcactgggaattcaaaggtcaagggaggcatacgctaatatgcgttttctttaaattaagcgatccatccattttagcttatattcaattaatcaaccaacggctttcaagtaaaggg

SEQ ID NO: 603774 - DNA, 374 bp, Homo sapiens
  misc_feature (114)..(114): n is a, c, g, or t
ttgcccagctgtctccctcccactcagaacgaaatgttctgtctttttgtggttgtaacctcttttcacttggaatgacttgctatgtctggacgttgatcagggctgctgctntaagacgctctcacgcaataataaattacccagtaagccttggtgtaagatctcctcccccgcccccgcccacttttttctcctccccgtcctcctcatcccactggaaaagtcgctgtggttggttcttaggcggcttccaagcccatgctgatcagcatcacttgcctctggccaccctcccctgtgaccggcagcacatgtcgccccacgcggccccggcttggggagcgtaaggcatgtgggcctccatgcggccg

SEQ ID NO: 603775 - DNA, 163 bp, Homo sapiens
  misc_feature (80)..(80): n is a, c, g, or t
tgaactaacccagtgaactgcccatattttgttgggttgtcccccttgaaaaggaatataagcactaaagtgttaatgtncacttggtgttacatttccctacagatttttgtatagtctaatttggttaatccttgtgacattaaaaacacatacacttttt

SEQ ID NO: 603776 - DNA, 398 bp, Homo sapiens
tactggtgcagctcagactcactagaatctctgcgctcccgaggtgattctcctcctcagcctcctgaggagcggggattacatgtgtgcctgccaccacgctcgtgtactttattgtattttttacgcagagacagggttttgccatgttagccaggctggtcttgaactactgacctcaggtgatctgcccgccttgacctcccaaatgctgagattacagatgtgagccacctgcgcccggccgctgggtgccctttctttccactttgcaacctcagttttctcatctgtaaaatggaaaagataatcctaccaactcatagggctgtggtgacgattaaatgacagcggtaacgcattcagccctgtgttccctcgtagtgagtgttccatcg

SEQ ID NO: 603777 - DNA, 110 bp, Homo sapiens
  misc_feature (30)..(30): n is a, c, g, or t
ccctcacaagacctgcaaacagtaccgctngcaaaccagtattcaccggcgcagtcattctcataatcgcccacggacttacatcctcattactattctgccgctgcaaa

SEQ ID NO: 603778 - DNA, 360 bp, Homo sapiens
accatgtcttactactgaactcatacactcactcactttaaaggtccctccatactcatctcaataaactacactcaccagtgagacaggtccctccataccgttatctcaattcactcactcaccagtgagacatgtccctccatacctcatctcaattcactcactcaccaggagccaatgtccctccatacctaatctcaattaactcactcactaggagccaggtccctccatacctgatctcaattcactcaatcagcaggagacagagtccctccatacctcatctcgaattaactcagtcacgcaagtgagcccggtcgctccaaagctcatctccgttcgctcagtcaagca

SEQ ID NO: 603779 - DNA, 153 bp, Homo sapiens
tgatggtgactctagaggtatccccaatgcagcagcctcctgagcaccatccatgccaccgcaccttaggcctctcgttcactcatcacactgccctcagtatacaccccgcgagaaaagaccaagttggccctagcatgtacctcaccgcgg

SEQ ID NO: 603780 - DNA, 138 bp, Homo sapiens
cggacagcatcccgggttttattttcaagtagggtgcgcagctccaaacaaagttacaagggtaagtgcaactccaagttcctgacacagctaatccctgctcggtcttcaaaaaatagaggtctgtaattccttttt

SEQ ID NO: 603781 - DNA, 208 bp, Homo sapiens
ctggagttcgtgtccagtcagctgagctccaccttgatgccagtgttgagtgtccatcgggcctgtaacggtaagtacctgtgtcccctcaccaggccatcttgtcaaccgagcccatttcctccaaggtggactctagccaagcattgagagagatctgtctatggaaccaggtgggtttgttttctggcacacccataattcgttg

SEQ ID NO: 603782 - DNA, 333 bp, Homo sapiens
ttagaggaaccccgctaagtgacgatcctcatgaatgactatcctaaatttaagtatgttgttctctttttgctgggtttattcgtgcgggttcatcgtgagtaagaagcctgcctcgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtca

SEQ ID NO: 603783 - DNA, 1016 bp, Homo sapiens
  misc_feature (1016)..(1016): n is a, c, g, or t
ggtgatttgcatgtttgtgtgaggatcccggggtcgccgacgtcgctcgtggtccccggcatgggctgtcagcatcgatgctcaaatacagcgtgcatgcaggcaggaccttcatagcatcctgctagtggcagccgtgagctgagtaccggtgacaggtgctaaacaggacggaagatagtaagctgcagaagggtctgttgattgcgctttcctcgctgatggactagtgactgtagacaactcaatctagtgcctgtgctaaagaatctatggaagttgatcggatagtcccctaatcgaggggtaccttactcttgccattcggagtgaaggaacgagactttctcgtgcgtaccgtcaattgggtgacccaaggaccaaaatgcctgtggccagggttagccttcgagtcaacgcgccgcaagggaagggacccatcgaaccgcaaacgagcgatgggcacgccgcaaaggaagattcccgtccgtgagaagattcccgtaagacgcaccggcacaaggagaggcaccaggagaaaatctcgcgaggaggccacatgaggcacccggaggaaataccgaaccggctgaaggcaaacgccaacagagaaagctaagcggcagagcagagcggaagcgagcaccacctacaggacgccacagtcgcagacgttagcccagagcggcgaccaccacaaagagaagcggtaatcaccacggctccacggaaagggaaccattgggaagcacaacacgatcgcggaatactgcaaccagcaacattagagtgacgcaacggtaaccaaaccagagcaccccgagaggacaggtaggaaaaaccgagaccaccgaaccgacagacagcgggcccccaacgccgatggaagacacataacagagcaagtaggacaaggaggggagcaacaataggggaaaagagcacggaatgcagaccggacaagcacaaaaggacaggcagagagcgcagagagaaagcgagaccagacccaagan

SEQ ID NO: 603784 - DNA, 510 bp, Homo sapiens
tgaggcgtagaccactgggtgcccgtgcttgtgttttcaaacgtggctgtgaacgtgattgcgtcacttggggtgcattttaggatttggatgtgatccaaaatgtctacaccctgaagctcagtcttctgtcatttggcgtgttagctttctgtcaggaaaccttttgctgttctttttttaatgtgtccagggctctttgaagaaaactgcattttgtttgcacaaactgctgcattcttacagacttctggataacaaaataagaagcacgcttgagggtggggtctttcattatgatgacaaaaggggagagagcaggggtgtcagcggagcagctggaaagtattagcaaggacttaggggaattaatagggtcctcaatttggaatggtttgtttgctacagggctcaatatggtagtcaaatgtttttcttttcatcctttttcttggaaatcaattttttaaaatatagtttgcttcttggctccctgttctgcatctcgct

SEQ ID NO: 603785 - DNA, 328 bp, Homo sapiens
  misc_feature (160)..(160): n is a, c, g, or t
cttgtcgttgatgggtatgtgtttaaaaacatgcacggtgaggccgggcgcaagttgctcacgcctgtaatcccagcactttgggaggccgaggcgggtggatcatgaggtcaggagatcgagaccatcctggctaacacgtgaaaccccgtctctactnaaaatacaaaaaattagccgggcgcggtggcgggcacctgtagtcccagctactcgggaggctgaggcaggagaatggtgtgaacccgggaagcggagcttgcagtgagccgagatcgcgccactgcagtccgcagtctggcctgggcgacagagcgagctccgtctc

SEQ ID NO: 603786 - DNA, 392 bp, Homo sapiens
agcagacatcttaccattatcagatctgaaaaccccatgagtgttgtatagctacaaactttaggtcttctctggcttgtcgcacaatgtttttatagttaccagagtgtacagattttgcacatattttattaaattttcccctgattacaaattttgctatggtctgaatctctgtgtacaccccaaattcatatgttgaaatcctagcgcctaaagtgatggtatcaggaggtgaggccttagggaggtgcttagatcatgaaggcaggacactcatgaatgggactgctgtgcttataaaagaggcccctgagagcatgtttgctccttcctccatgtgaggacacagcaagaaggtggctgtctgcaacctggaagagagccctcac

SEQ ID NO: 603787 - DNA, 785 bp, Homo sapiens
ggcttcttcgcttctctcttggaagtccagtctctcctcggttgcaatggaccccaatgctcctgcgccgtggtgtctcctgcacctgcgctggttcctgcaattgcaaagagtgcaaatgcaccttcctgcaagaagagctgtgctcctgttgccccgtggttggtaacgcaagtgtgccccagggttgtgttttgcaaaagggggcgtcagcagaaagtgcagctgttggaattgatgcccaaggacaaaactttttctcccagattgtacaccagagagacctatgtacaaaaccctggattttttttatataccaaccttgtgaccccatttgtgctacatttccttttccctggtgaactactgtgacgtgacttaatttaacagcacttttagaaccttcaaaaaacaaacaacaagcatgaagctgacacaaaaaaacaatattgtgtgtcggcggtattcatcgggccctcttggagaacaagacgttttttcataacgcacccaactacttcgtgtttagtagccgccggcgcggcccccccgctagtaagggcatagctgtggccaaaacagttgggcgtccaatgacgcggttggtcccccaaaagaggaacgacctcgtgtggtcacggtaacacaacgggcggttggggattctctccaccaccaatagtgaaacaacagggccggcgggggaaacagccgaggggcgtttctaaaacacattccgacagagtgggacgcatcggggggcaccaccagggggcctcacacag

SEQ ID NO: 603788 - DNA, 200 bp, Homo sapiens
tcagcacactttagtaggtaataggacggctctctcctttaatccaatatagcagccgtgaagtcatttctgtatttcaggaggacgggcaggagatttatggaaaagactctgacaaggactccgtgaatacaagttcctgaataacttcaagaatcataccactgtggactaaattgtgcgtgagagggtaccggagc

SEQ ID NO: 603789 - DNA, 215 bp, Homo sapiens
tcagatacaggttctaatcacagagaaataacatatatataaagctaaaaaattgaatatcgatctcttgagtaaccagaaagaagcaaacacatatttgcttacctctctcggatacatcatgtgagcattatacatgcacttgtactactttacccttccctgctaagaaaattaaaatagtttgcataaatcatttaaggcaactcactacc

SEQ ID NO: 603790 - DNA, 257 bp, Homo sapiens
atcaaaacaatacgcataagttagacaagattaaatcttgtttgatatctgcccaaacagatatgccccatgttggaaacatgtgttttcctagtcccatccaggcttcccccaagaaagccatgatgtgggtttaaaccatatgttttgagtaaaggagaatagaaaaaggggagtgtccccaaaatggaaaaagatgaagatgttccaaggaaatatgctgaaacagaacagtgaccgttttgcccaaaactcca

SEQ ID NO: 603791 - DNA, 455 bp, Homo sapiens
  misc_feature (145)..(145): n is a, c, g, or t
  misc_feature (177)..(177): n is a, c, g, or t
  misc_feature (254)..(254): n is a, c, g, or t
  misc_feature (383)..(383): n is a, c, g, or t
  misc_feature (405)..(405): n is a, c, g, or t
ctcgactcgtatctattttaataccactcctctccccatcttcctgcgtataggagcttaccattttagtaaatcaggcaattttatcatttattattagatactaaaaatgaaaaagatgcaacatagaccaagttacatcaangctattagaaaataactgaggccagtagcagnggctcatgcctgtaatccagcacttggggaggctgaggtgggtggatcacccgaggtcaggagttcaagaccagctnggccaacatggtgaaaccccatctctacaaaaatacaaaaattagccaggcgtggtggtgcatgcctttaatcccagctactccagagactgcggcaggagaatcgcttgaacccaggaggcagacgtngcagtgagccaagatcgtgccnctgcactccagcctgggtgacagcaagactgtctcaaaaaaaaacaaaaa

SEQ ID NO: 603792 - DNA, 760 bp, Homo sapiens
gccaagtccctcatgttcgcagcccatcgcttcaagagcctgctttcttttcagcgtcaccaagcttatgcggtaaagaggctcttacgtacattctgggggaaaacaggatgatgatgagggaggaggtataggaggaggaggacttcatatccatcctcggcagtgtaaacgcaaatggagaccgagattctggactacgtgtgaccgggccccaaggctgggcctccctgacccggcccagactggtggtctggccttatgagggaaccggggctcccccattgccaccccaccagtgcccggaatggccctaggaggccctctgaggagagctagagtccccagccaagggtgcagctgacaccctagcactggctgtgacatagctgcttggtggctgcctctggtcctgaggggttagggacattcccccaagggtataaccctggctctgccaccccatgagacccagccccagcatcccagcccagtgagtgggcaccccatagcctctcaggatgagacccagtaaatagccggaggtggagctgggccagctgtggagcccccaggcccccaggccagtttcgcttggctttcatgactgtggtggtggagatagcgtggggaggcctcgcccatggtctcacgtggccagaagtgcccttagctttggatccccaccgtttggcacaggactttggccaccagcccggcccctttgggattgtcccttatttaacccagtttcccgaga

SEQ ID NO: 603793 - DNA, 246 bp, Homo sapiens
aggcacactgactcctttctacacttgcattcaacatagtactggaactgctagcacaggcaattaggcaagaacaagaaaaggcactcagattggcacagcagaagtgacaattatctttctttgcaggtgatatgctcttacatgtagaaaaccctaaagatttcacacaaaatactgtaagaacaactaaatgacttccagcaaagtcggaggccacaaagtcaacacaaacaactcaattac

SEQ ID NO: 603794 - DNA, 175 bp, Homo sapiens
gcaaagcgagccgtcagtcctagctatcagtcaaacacaggattccgggaatccagatctgctgcggtcttcctagattcactgaatccacttctgtgtagcacctgggtcagctgtcaattactgctagtcctcaggatttcaaaaataatcttaacgcacagtccaaggcaca

SEQ ID NO: 603795 - DNA, 993 bp, Homo sapiens
atagtggtctataatctgctctgagtatccgagtgtcaccgatatattttcactctatacttattcatacttcacaactgcgaaagttatctattcgaacgtatacgtagtacatatcgactggttgggcgtatagacgcacaagcgttacgatcgcggccactctcccgtagttaacgccgtggacgcgtgtcagcgaaacatctctctcttactcatccctgtttatcgtcctccatcttctctacatggtgcgcttgagtgatcgtcgtgtcctcccactcgcccccgtgtccggggccctcgcccacacgcctcgccgctcgggtggtcttggggtgggcttcctctcgcgtggtgtgtgtgtgccggcgccttcgtgccgtcgactgtatggcgatcttttgagtggtgggagacggccagccggcggtgcgagtcgagtcggctcctgctggtggctcaggtctctctcggttccccgtcagtcactctcgcccgtctctttgctcgctctcctcgccgtgtcagacgtctctcttctgtctgccttgtctgtcgtcggcgtcgtcttctcctggtgtcttgcgtctgttgtgtgttccgggtcccgccgtgagcgtggcgtgcgggcgcggtcttctgttcttctcgtctctggcttggcgtttgtgcggagggcgggtgcgcccgcgttgcgcgggcctgccgtcctcgtgtgggtcggggggcgctgtgtgggggtgggtgggtgcgttggctggggcggctctgccggggctgtggtcggcgcgggtgcgtttctgggcgtggtctgctcggctcgcgcgtgccgtgtgctcggtgtgcggtgtccccttgtggttgggtgcgctcgtcggtcgtcggtgggctcggcgcggggctctggttcgtgctgcttgctttcgcttcgaggtcggctggtgtggtcgtgtgtgctggtgcggcgcgcgcgcgtggtcggcgtcgccg

SEQ ID NO: 603796 - DNA, 846 bp, Homo sapiens
  misc_feature (1)..(1): n is a, c, g, or t
nggccccacatcgcgttcttccgctttctttggatgggatccggcccctccccgggcctgggttcccaaagcggcgtccctccctccctctcttgtccctcgcccgagtccttcttcgcgtccacgtccacagggtttcttccgacagtcctctccccctcgaggtgcctgccatcagcctctttagcgtgcggagatccagttagtattggccggccctcccccagcacctgttgggccctccccctctagggtggaactgaccccttccgtcgtgttcttgtctctccacacaatttcgtgccgccgcaccttagatgtggcgtgcgccccaaggcttgttttatagccagccccggtttctcgcgccccggtccgagtttcataagagatatagacaccccgcctggttctcctcgaagattggctccctcctctagcaagatagatagggtaagagataagggatgagagttcctttggctctgcaaaaacatgcaactatggagggggacagaaccattgttctctctcgctcacatagctcctcccgagcatagtcactcgctggtgaaaacggcacaaccattgtctacttctaagcgcccccacagcttcttatacagggggataagccttaacactcgtgttatttttacgaccttcacacccataaatggtaggaacgagcataataattcatcaccaccatacgatcaccccgaaacatactacctcctttgagcccacagaccccgccgtgataactaataacgagacgaacagacattcccctacccgaactgtcctaattaaaaaacggaatcccccccttctaacaaaaca

SEQ ID NO: 603797 - DNA, 1090 bp, Homo sapiens
  misc_feature (45)..(45): n is a, c, g, or t
  misc_feature (143)..(143): n is a, c, g, or t
  misc_feature (1048)..(1048): n is a, c, g, or t
  misc_feature (1080)..(1080): n is a, c, g, or t
  misc_feature (1083)..(1083): n is a, c, g, or t
  misc_feature (1086)..(1089): n is a, c, g, or t
aagcctctacaatgggctgttgcccgcctgcagcgccaaatgagnttgctctgtccgcatcgcctgtatgattctgtcaaacagtctacaccaagggctctgagcatgccagcattgggagccgcctcctagcaggccagacnacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccncttgtcatccataaagcaagctcaaccttggngtntcnnnna

SEQ ID NO: 603798 - DNA, 1162 bp, Homo sapiens
  misc_feature (52)..(52): n is a, c, g, or t
  misc_feature (65)..(65): n is a, c, g, or t
  misc_feature (68)..(69): n is a, c, g, or t
  misc_feature (84)..(84): n is a, c, g, or t
  misc_feature (86)..(86): n is a, c, g, or t
  misc_feature (100)..(100): n is a, c, g, or t
  misc_feature (105)..(105): n is a, c, g, or t
  misc_feature (110)..(110): n is a, c, g, or t
  misc_feature (117)..(117): n is a, c, g, or t
  misc_feature (125)..(125): n is a, c, g, or t
  misc_feature (131)..(131): n is a, c, g, or t
  misc_feature (138)..(139): n is a, c, g, or t
  misc_feature (159)..(159): n is a, c, g, or t
  misc_feature (163)..(163): n is a, c, g, or t
  misc_feature (174)..(174): n is a, c, g, or t
  misc_feature (176)..(177): n is a, c, g, or t
  misc_feature (215)..(215): n is a, c, g, or t
  misc_feature (1120)..(1120): n is a, c, g, or t
  misc_feature (1152)..(1152): n is a, c, g, or t
  misc_feature (1155)..(1155): n is a, c, g, or t
  misc_feature (1158)..(1161): n is a, c, g, or t
tccttcttgaatgtaagccgtaaaacaagaaaatagggcaggggcaaatagnccatacgcgttanggnncatttacctggggantnggccccgagcttanatggntgttncggctgngcgcaatnagtttncttttcnnacggcttttgatctgtaaanagtnacacaaggctngnnatgccagcattgggagccgcctcctagcaggccagacnacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccncttgtcatccataaagcaagctcaaccttggngtntcnnnna

SEQ ID NO: 603799 - DNA, 128 bp, Homo sapiens
  misc_feature (22)..(22): n is a, c, g, or t
  misc_feature (51)..(51): n is a, c, g, or t
tcgcctcccaggttccagcgantcttgtgcctcagcctcctgaattgctgngattacaggcatgagccaccacaccaagcccaggttgttgttcttaagcaagtaaacgagttattccagtgatggct

SEQ ID NO: 603800 - DNA, 1697 bp, Homo sapiens
cttcagcacgcttgcacaagggagctcacttacaaaggagaaattgtatacgttttaaaactatacttctctgtgcaaaatacctctcactcatgcctcataaaccaccatctaacaaaccacgtgtcatccgatatcggctacttcaacatattatcccgcgagctgaacaactctatcactcaaagctaaccatgcacctccaaacgaaccacctcatggctattcaatctcattaaacacgagatacctgctactcagactcctggcccccaaaggctcccacgataaacatctcacactaaacaagggctaattccaaacctatccccttctggagaaatcacaagccccctctcccggctgcaataccacagctcactacggcctggtctacattccggtcaatgagaccctcagcgcataacaatacgcttcacacaaccgtacgccccacaaagaaacatttcacacaaggaacccagctcccaccccccttggcaacgccaccccccacggacaacgaattggcccatccgcattaaaaccactcttcaaacaaactcaaaggacacaaacacgcacaccccccacccgccccttggaaatcatcccacaccccaactaccccatcctcctcacaaaccccccacgcttacgccaaaccacacaacttacttcatacgagcccccctaaacatccccctcctccaacgcacaccaagcatataggagcccccacgaccggcgctgagcatacaacacacaacacaccacgcacccctcgcgacaaacccccccgccgggacacacaacctctcaccaccccatcaaacaacacggggaccccaccctctccgaaacctaccacataatcctcacaacacgacgggaccaacacaaactcctcataagcaaacaacataataaaaataatcacacacaaaataaaaccaacatacacgaaaaccaacagtacacaacccaacttacataaactaccaacacacttcaaaacctataaaacactcaacaacaacacaaacaaaacaaccaacaaaaaacacatacatcaaaacccaaccctaaccacaacaactaccaccacacaccaaccatcgcccaagcaactacattcatcccaacaccactacaagcaacaaaacacataatatcaacacacaaccaacacacccactctataaaaaactcactacaccaccaatgacaccctattcaatcataacactacattacctccatttcaaaaactatattcacaccaacctaatcattaactaaaaccaacatataatcatatataaatctcaacacaaaatacaaataataacaatactataaaaactaccaacaaatcacacccaacccctcttaataataaatcacgtcaaacacttattaaccagcaaaatagcactcctcccacacaccaataacatcgactacaaaaacacacaaaacaacaaaaaaaaaataaccatatatacacctacacccgccccccacttcctcactaatgccgtaacacacagcactcactacctaccgaaaacaacccaataaatcatacaactacccaatactaacacacctcacacccaacaatcattaacatcccactgtaacacaaaaaatgtattgccaccccttttagcctacctctactcaagagataa

SEQ ID NO: 603801 - DNA, 1404 bp, Homo sapiens
gctggtgctgagtgccaacttatggcagagtgtgcgtgctgcctgggttccccagtgcacctgttggcacgtgacagtgttggcacctgtcctattcctgaaacagcctctctcaccaagttcccttgcctacagaagtgccactccctcccacacccactgaagtgtggggatagtcgtgtgtcctagcagtgcctcagtggcctctgtgtggctctggcccagacagatatctgcagtatcttgtgctatgggtgggagtcattcttcctcaagttatcggctagctgtgctgctgactggatgggctgatcctcccagggctcaagggctgatggtccgctcagcggtctcatttccccaaggccaagttcaaggccagcagaccttctgtgaggcgctcttggtcccctgggcctggagggagacactgcacgcttcacactcgatcaacagggcacgtgcgaatgggccctcgggtgcaggtgccacaccattcttgcataactcgagagctcatgacctgaatcacgtcctcgggtccatcagactgtcgtccaatgttgataccgagactgccaaggaccaggtccacttgtggaatcctgaccgccattggggtagtaagccgttgactcactacaacgcatataactgcagtgcctgagcaatgcgttcgcgtcaaaggcggacacactgttccagcttactgagagtagaccgacgttctatgcacctctagagtgagaccacgttgcgagccaaaccaagtgatggcatcaggccctcacgacaatacacagtgagtccttggaatcatgacatgaatttaacacattcggctagattctcccatgtgatttagcgcccagcgtgacgcaacatctcttgggaggctgcctcagtagaagtatatgagcgcctctagcggcacgttcagacaggtgagtggcaccacctcacatgcgcgccatagtaggagaaccagagcgaagcgaccgcgtacgcgctgtctctccactgcatcctataaccatcatctcgctgcggccccacgtccaactagaggggacacgaacagactgcaccgccatcactctaccgcacgtgtgctctggccgtcgcccacccgccagcacgactggagcacagcgccgaccagagtcgccgacactccgctctagctgccagatggcgccaacggccaagcgcgcggccatcgggacgcactcaccacgcgcgagctaacaacaccagcacgaccacgcaacggaacggcgctgcaagtgtagctcctgcggtctgcacaacgcacagctgacaacaggagcggcctagaccacgccccggaccagggagtcgctgagtgcacgtgcaagagcgagcgctcacgacccgctcttt

SEQ ID NO: 603802 - DNA, 222 bp, Homo sapiens
  misc_feature (180)..(180): n is a, c, g, or t
  misc_feature (212)..(212): n is a, c, g, or t
  misc_feature (215)..(215): n is a, c, g, or t
  misc_feature (218)..(221): n is a, c, g, or t
atgtggacgcacagtagttaggtggacgcacagatgaaggtggacgcacagagaggtggacagcacagagaaggtggacagcacagggaggcctcgtaccagccaggatcccaagcgtcccgtcccttggaaagttcagccagaatcttcgtcctgcccccgacagcccagcctagcccncttgtcatccataaagcaagctcaaccttggngtntcnnnna

SEQ ID NO: 603803 - DNA, 117 bp, Homo sapiens
gtattttccccttaatgcctaccttctttaaactagtccccatcccacttcccccagaaaggatattcagttttttatcttccttcatagccaggtaacgtttttgcagtacagccg

SEQ ID NO: 603804 - DNA, 787 bp, Homo sapiens
  misc_feature (745)..(745): n is a, c, g, or t
  misc_feature (777)..(777): n is a, c, g, or t
  misc_feature (780)..(780): n is a, c, g, or t
  misc_feature (783)..(786): n is a, c, g, or t
taacattgatgactcgctcattggtggaaatgcctcctctgtgccctcctctgtgctgtcccatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccncttgtcatccataaagcaagctcaaccttggngtntcnnnna

SEQ ID NO: 603805 - DNA, 650 bp, Homo sapiens
cgcgagcatatgattctcatacccaggaactgtaaatttaaacctaaatatttggacgatcgaccacatcctggatgccccgtagcctctgcccgcatcctccagggggcccaaggagcctgcactttgctgtggtaggcctgatagttgaagaatgtaagttgctcatcgaggccagtgaaagcgtgcatctgttaaaggccttcaaggaagagaaaccaggccctgcgtcaggcagtgtgagtttgccgtttgtccttaactttcttttttttttttttttaaaaaaagaaaactttaaaaaaactcccattaaaaacaaaacatctttgtgtttttgtgaaaaaaagcaccaaaaatgccgtaacttgactttcaaatgggacggaggaagagctttttgaggcccaacccccataagagccgaaggatttctgcagggggggggaaaaaaaatagggtgtaaaaaaccgggggggaacccttttgggccccttgccccacattccttttttatcggatgggttttatagggggggcgctgggggttcttggtcccaacccttatgaggggtggataaaaaaacaagcccgggtgttaaaaacggggggggggaaaaccgggggaaacaaatataaaatccggaaaa

SEQ ID NO: 603806 - DNA, 1044 bp, Homo sapiens
  misc_feature (45)..(45): n is a, c, g, or t
  misc_feature (143)..(143): n is a, c, g, or t
  misc_feature (1002)..(1002): n is a, c, g, or t
  misc_feature (1034)..(1034): n is a, c, g, or t
  misc_feature (1037)..(1037): n is a, c, g, or t
  misc_feature (1040)..(1043): n is a, c, g, or t
aagcctctacaatgggctgttgcccgcctgcagcgccaaatgagnttgctctgtccgcatcgcctgtatgattctgtcaaacagtctacaccaagggctctgagcatgccagcattgggagccgcctcctagcaggccagacnacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgtcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccncttgtcatccataaagcaagctcaaccttggngtntcnnnna

SEQ ID NO: 603807 - DNA, 316 bp, Homo sapiens
ctccttttacggatgtacaactgccaccgaaacagggaaataaagaatgaaagacaggacttcccgctcgtggctcagtggtcaacgaatcctactgggtggcggcgtaagacataaccgcggccgcggttatatcttacgtactgcctttatttccagcggtttcatgtgtcgccatctcttgctaacgtgttgtcatttatcaatcgctttcgccgagcatcatcgtttataccacgttgctctctcgggggaattggcaccgatagacgcttgcaatccatataagccgaagccatgtacgatctaaccgcgt

SEQ ID NO: 603808 - DNA, 765 bp, Homo sapiens
cagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgatacaagaactatcttagaactcagaagaagaaagaatcaaattcataggatcagtcaactaccttaatggtggtagagcctttacctgtagcttgaaaggggacagattggcaggataagagagaaaactgaaagaacacctctgggtccttctgtccagttttcagccactagctcttactcagctatccattatagctcttgcccttaagaagctcatgcattaactctcatgaacaacacatctatctgggggacacggaagtgctgataccttcctttggctatcctcctccgccagccctcaacatcctatcttcctgccccacaactgtgcgcagctacccctgagtactccctctttgctctacctgactttcaccctattccaactctgtttcaacctccttcatcgcgtgatacgtcgcatcatcttccctcgattcccgcgactgcccttcttgtctcctctcgtatccgcactgccccgtgtcatgccacggcctcccgccgcctctgcgctgggggtcacctccttgcccttccccctcgaccgcacggtcccct

SEQ ID NO: 603809 - DNA, 288 bp, Homo sapiens
  misc_feature (47)..(47): n is a, c, g, or t
gtacggagacgctgtcacgctcggtagtgttcttgagtgcacgtgtntgataaagaaataagacataaacccaccatcacaaataaaaaaaatttggcagcgaagagaaatgaagaaaaactgaagaaaaaaaaaaaaacgggaaaaaaggacccatccaaatttttccccccacccttacccgagggtggcattggcccggcctgggttttgtgcagccaattcaaaccaagaggcttaaaaacattacccgaggggtggcgggggcccctcaaaagttcgcccggc

SEQ ID NO: 603810 - DNA, 559 bp, Homo sapiens
caatgaatctagctctactagctcaggctgtatattcagtctctgaagcacttcttcagtgcatgctaaagacaggattaacaggtttaatctgttcttctcccaaaagtgactatccagcaattccaaataaggtatgatcaggatccaccatatctcctggcctgtctgcaaatccccccgtttcttcatcttgacatgctaaaatgaaattacgcagtttctctctatcaatccaatgaagtcttccaattatctttagggaagccaggacccaccatgagtagcatacatctggtaacttctccggccttccattgagcccgcctgagggtaattgtcgttcacaaagccaccagccaagtcaatcagaatttacttgatgcaactgacttgtaatagccagaaatcctgtgcaacagtagatctgcccagcatgggattcagaacctggtctgcaaccaaagtccacccgtcaaaaaggttcaataacagggataaaatacagaattccgattagccttttttccaacatttaatgggcatccagcttccccaa

SEQ ID NO: 603811 - DNA, 1077 bp, Homo sapiens
cgtgggcggacggcggctgcagcgcggagtgagctggggtcgctgtgaggtctgcgaagcagagcccgggacgtgcgcgcttggtgcactgatcctgaatggggatgctcctgaggtggccctggggtctccagtggctgctgcggccattccctgggagcccggcggctgggtgccctgcgatggatacttggtttacggcctgtcccatgtggctcctggtgcgccaccctgtgtggcccgctgcttgcagcgtgacgtggagctgctgtgcgagctgcgagcgggctccgtgagacaggcagttatctccccgtgcaatgtcttccctctgggtgcagcgaggttggcgaagttggtgaagcctgtgaggccgtgccaagcttggcatgcggttcctcatccggcagggggtctggcgaccacatgccggccccttgctcaggcccttgcaggccagtgggaggcgcccattgtctttgtgggcttagacacattctttgacccttaggcacgtttagccttttatggcacgcgttcgtgaggctcgcgactagcctggtggacctataatggctgaccctttgtcaggttagagacaaaacgccacgtgaacggttggtgacacaggaagagcgtaacatttaattggcggttccagagcaacttgtggccacctgaaaggaacccacgcgttaatgtgccggagagggaacaacacatttctcgacatatagaccggaacagcttggttacgggaaggaacccccctttccatggagtacattaagcggttggtggagccgagcgataccagactttgaggacagcctttatgtagggggtccgccctgcacgttcataggcatcgtgctttgaagaaccgccggacgttcgttctacgatttacggagcaatcgcggatatagaggcacacctttattcagaagaagctttctaatggaacacgcgagcaatggaacacttttcgacgagcgcggcacatttccctttatgtactggccgcccaggcaacatcgacgtttgtactgggagtggcacagattacacgttgtg

SEQ ID NO: 603812 - DNA, 233 bp, Homo sapiens
  misc_feature (129)..(129): n is a, c, g, or t
  misc_feature (153)..(153): n is a, c, g, or t
ccaggtagacctacgttggcttctgtgatggttatattgcctagcaagcacacccgtggttgtgaaaatagtatagcaaaaaagaaaaatccccgggttattgatgtgctagagtattgtgtatgtctntttaaacaagttctacgtttcacncttacacagtaataatcacggaaaagtgtaaaaattcaaagagtgaaataaaaattttatcatgttaggtctacctgggt

SEQ ID NO: 603813 - DNA, 188 bp, Homo sapiens
ggttgtttacttagaggccttatatttgtagctgtatataataccattatcacagcacaaaatcataccccatctggctctcttaaggtacatgatacatcagactactgctccttcatcaaagtgtcatcatctcaggatatgtcctgcgcacctatgatggctaccgatgcatcgtacttcgtcat

SEQ ID NO: 603814 - DNA, 139 bp, Homo sapiens
cacaccactgagtccaagaaccagcctggttatcaactatttgaagagcacttcctgtgtattcagatcccatgaaatgtgttttgtctatttttattactagtgtttaagtcattttttacttgactcaggtggtgtg

SEQ ID NO: 603815 - DNA, 218 bp, Homo sapiens
ccgcgcaggttgctccaccggcaggttgtactgtctttgtctggttttggtatcagcgtaatacctacaaaccagaaaattttccttttttttttctaaaggagattgtacagaatttgaagttcactctattttatttttttgagacggggtcttgctgtgtcacccaggttagagtgcagtggtgcaattgtggctcactgtaaccttgacctcca

SEQ ID NO: 603816 - DNA, 407 bp, Homo sapiens
  misc_feature (15)..(15): n is a, c, g, or t
  misc_feature (90)..(90): n is a, c, g, or t
  misc_feature (139)..(139): n is a, c, g, or t
  misc_feature (147)..(147): n is a, c, g, or t
  misc_feature (179)..(179): n is a, c, g, or t
  misc_feature (222)..(222): n is a, c, g, or t
  misc_feature (245)..(245): n is a, c, g, or t
  misc_feature (265)..(265): n is a, c, g, or t
cccacccttgccctnccccctcatgttgatgtccaaagagcgttccccctagcaaactccccccaaatgcccaatctcccagccttagantcctgcctttctggggaaactgaactgtgacagttacctaatacaaagnattaatanttttatgtcacattatacttagatagccttgnaatatatatgctcatccccacctcaatatttcagccttctggntctagttacttaatacattattnaaaaactttttactatatcnaaaattactttttaaacgttttagtaactgtatttcaagataattttctgtgttatcctatgccttttattttatgcatcttaaaacatcattctgagaaggacctataggctttatcactgccaaaggagtccatggcaat

SEQ ID NO: 603817 - DNA, 105 bp, Homo sapiens
catatagaagcaggtaaataaggaacttagtcccaggttcaaatgggggaaccgaggcccagtagagtgacactgggctgtggcgagtgggagactgctcttggc

SEQ ID NO: 603818 - DNA, 255 bp, Homo sapiens
  misc_feature (13)..(13): n is a, c, g, or t
  misc_feature (89)..(89): n is a, c, g, or t
  misc_feature (172)..(173): n is a, c, g, or t
  misc_feature (177)..(177): n is a, c, g, or t
tccccgacttctnccgccgcccccgaccagatcgaccgcttcgtgcagatcgtggacgagccaacgcacggggagaggctgtgggagtncactgtgctctggctttggcctcactggcaccatgctggcctgttacctggtgaaggagcggggcttggctgcaggacataannaaantgaaatccgacgactacgacccggctccatcgagacctatgagcaggagaaagcagtcttccagttctaccagcgaac

SEQ ID NO: 603819 - DNA, 392 bp, Homo sapiens
gcaatggcgcgatctcggctcaccacaacctccgcctcccgggttcaagtgattctcctgcctcagcctcctgagtagctgagattacaggcatgtgccaccatgcctggctaattttgtgtttttagtacagacggggtttctccctgttggtcaggctggtctcgaactcccgacctcaggtgatccgcccaccttggcctcccaaagtgctgggattccaggcatgagccactgtgcctgacctgattacttgttttaaatacaggcctgattaggcttgtgaccactctgtttggcttcactgaagggctgccaagagatggacttttgagagtgacactgcaagataattgagatcctaagtaaggccgtgagagagggaaggaggt

SEQ ID NO: 603820 - DNA, 280 bp, Homo sapiens
cccccccccgaaagggaatagggtttttttccggggcgggggccggctaaaaccgggggggttggtttttagggaaaaaaattggggcccggggtttgtaacccgccgggtttgcccctaggcgggttccggatttttttggggaatccgggggggttttttccggggccggcggggggggcatttggcttccgggggggcggggttcggggttttttcttttttgggggcccccgggcccttgggtttttgggatgggacccaatatccccctgggaga

SEQ ID NO: 603821 - DNA, 798 bp, Homo sapiens
  misc_feature (1)..(1): n is a, c, g, or t
ntcgtttgctagcgaagctctaggatgtgactttaagctggaaagactctcaggagctaggtttgatatggcacaatctcaaggcatcgctaagtctgaagttcttccagcaggtctgtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaaaataaaattgttaaatatttgctatgtgtaaaatgcttattcctttaaagttttcatgtcagttaaaacatgttattggcttgaatcctgactcaagaacggaaatagtaattgtgtctgccattcagggtgacacagttatttccactggttcaaggtggtggggtgggagcttctagatagaacaggtggggcaattcttgaacattttcgtgtttttggtactactaaccaccaacttttgttttactcaaagcacaataaatgacctatttttatagacggaaaatgataatgagataattttaaataaaaggaaagggaatattgctttaaaggatgattataggtctgatggtaatttatagcctgatggagctaaaaat

SEQ ID NO: 603822 - DNA, 487 bp, Homo sapiens
  misc_feature (406)..(406): n is a, c, g, or t
ggctcggtgcttgcgatcatggctcactgcagccttgacctcccaggctcaagcgatcctcctacctctgcctcccgagtagctgtgactgcaggcctggatcaccacgcccgattaatttctatattttttgtagaggcggagtttccctaagttgcccaggctaattttaaactgctgggttcaagtgatctgcctgcctcagtcttttgtttgtttttttttgtaatccaatgctcccaataaatatccttgaatacttgcacacatatgggagtatatttgtgagagaactttctagagctggaattactgggtcaaagagtatgtaaattttaatgattcgttgtagaagtattcgtactagtttacactatctttaataatgtacgagtgacacatgcanagctcagagtgtgatgggatctcgtttgcataaaaatgaaggatcggaataggctatatacttgtagatgcatgaacacac

SEQ ID NO: 603823 - DNA, 776 bp, Homo sapiens
  misc_feature (1)..(1): n is a, c, g, or t
ntcgtttgctagcgaagctctaggatgtgactttaagctggaaagactctcaggagctaggtttgatatggcacaatctcaaggcatcgctaagtctgaagttcttccaacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaaaataaaattgttaaatatttgctatgtgtaaaatgcttattcctttaaagttttcatgtcagttaaaacatgttattggcttgaatcctgactcaagaacggaaatagtaattgtgtctgccattcagggtgacacagttatttccactggttcaaggtggtggggtgggagcttctagatagaacaggtggggcaattcttgaacattttcgtgtttttggtactactaaccaccaacttttgttttactcaaagcacaataaatgacctatttttatagacggaaaatgataatgagataattttaaataaaaggaaagggaatattgctttaaaggatgattataggtctgatggtaatttatagcctgatggagctaaaaat

SEQ ID NO: 603824 - DNA, 99 bp, Homo sapiens
aggaggaggaggaatacgcccaggaggaggaggaatacgcccaggaggaggaggaatcgcccaggaggaggaggaatacgccaggacgaggggtaccga

SEQ ID NO: 603825 - DNA, 693 bp, Homo sapiens
gtctctgagacccatctcctgcctagacatccacctccagagcaacactggccccacagtaaaagaggaagtcttgtaccgtcaggcaggcccgagtctagagactatacgccgtccgttcccgaacagcaagagggtatcgtggatgacccttgagaatccattctctggtcttctgaaaataccaagggcagatgtcaccgtccttcctcaggcaggacgtgactctgggcatctacaaccagagtccttcacataaagggtttagagacgtccgccttggctcgccagtcaccatatccagtgtcgttgtacaagagactgggccaaacgaggaccaacgcaagtcgagccttgacctcatcgcgcagtacagagattgaccctcatgagcttttcgatttattcaaagctgctgtggtgacaggcctgttgttctaaaatgaaacttagatgctatgattggttgacaaaacagaagccgaccaaccagcgtgacgtgcgaaactggcatgatgcagtgtgggttcctccgtggtgatctgttgttagaagcacccttgcctgtttacattaatggcaaggtagcagtaacgtacaggctgtactgtacgatcctgggcatggactctgtgacattggctagcatatccaaagcaccaccagttgatttctcctgttactgggtggggg

SEQ ID NO: 603826 - DNA, 211 bp, Homo sapiens
gaaaaggagtccccctttattgcccagggtggagggcagtggggtgatcttccctccctgcaacccccccctcctggaaacttcctttggaggtcatgatcaaattccatttagtttttcaaagggtgttttttgaactccaggcatcaaaattacccaaaaaacttattaaaatgcaaatttttgggctttactcagccctataaaatca

SEQ ID NO: 603827 - DNA, 445 bp, Homo sapiens
tgtttgaaaagggaagatgaaacattttttcagccctttaacgggcctttttttcctttgtcctttggggggtttatttggcccgttcctcctgaaggtgcctttgagatggggggttatgaaaagattttcccagggggaaattaagccatatttttactttggtttttccggagaaagcttccagggtttcagggtgtgatttattttcaaaaagggggtggctttgaacccccctttgttcccccgccttgaggtttgtatttttagggggggccgtttttgccaagggagatatattcagagaaatttttaatccctttatgccagttaatattgctttggtgatgctatttggttttttgaggttaaaaaaagcttttgtaaaaaaaaaattttgggggttttgccccctttaataaattttaaagccctcggggtttta

SEQ ID NO: 603828 - DNA, 259 bp, Homo sapiens
tcgatcgagctcggtacctacttttccacagtgctgggtgcagtggctagcctggcgacagagcgagactccatctcaaaaaaaaaaaaaaaaaaaaaaaataaaggttcccttgggccaggagggaatttccctttttttccctcccccaaaataccccggtgtccaatttgggtcatttcttttttaaatttttaaccggggcggggattacgggggtgagccacctccgccggtggagaaccacactttcacaggt

SEQ ID NO: 603829 - DNA, 377 bp, Homo sapiens
gcctggttcctcccccttccctcaggggtaaacaagggacctttgattatttttagctttgtttttttataaccctttttgggggttaaaataaagtttcttacatttttgggacttttttaataggcatttccttttttatatgaaaaattcccatccattgggccccttttaaccccaaaatgtgacctcctcctccagttacccccagccctgcccttttcagggttgggggtggtcaacggtaccccggggttaggcatcctaaacaccacccttaggaaactgggaaatttgggccatgtaactccctttgttactctatttattttagtcccttgtataaaaccccaaataaaccaataaaggcaaactca

SEQ ID NO: 603830 - DNA, 197 bp, Homo sapiens
gggggggggggcccccccttccctttgggggccgggtttcccccccccccccttttaaccctcaaaatttgggtggggttttccgggggggggggtttttccccctttgccgccgggggaaacctggccccttttttttttttacccccccccccctttgccgcccccccccttccctaaaatttttttttttttta

SEQ ID NO: 603831 - DNA, 129 bp, Homo sapiens
gctcggtacctgatgtgtcttcggtgtgcctggcgggcggctggtggcgctggcgggcgcacaggcccatgttttccagcaccagcccggtccccatgctctgctgccaccgaaaagccggtattgatg

SEQ ID NO: 603832 - DNA, 690 bp, Homo sapiens
gagttgtttcataacatgggtcttgcctagaaaataggggcaatactacaatgcatctggccccactgagcaagtctgtcatgaaatggagcacacagcaaattgggtttaatgtaaaaggatcaatacctccacctctcttcacttgaacactaggtcccacagctagcggttgatagatgcatttcatcacctgatagatgcatttcaaggtttttctttgttttgtgtcttttaaaagtcacaggctaagatccctctcacatgtgagaaaaatgcaagctgctatggattgaattgtttctactcaagaattatatgttaatgaacctcagattgtgaccttgtttggaggcagggtcataacagaggtaatcaagttaaaatgaggtcatcagagcgggccctaatcaaatatgatagatgtccacatcagaaggggaaatttggacacagagacacacacacagggagtacaccacatgaagatgaaggcagagattgagtgatacatcgtcaagctaaggaacacgaaagactgctagcaaaccacaaggagcaaggggtgcggcgtggagcagattctctctcacaggcctcaggaggaaccgctctgctgatgccttgattttggacttctagcctccagatgaaatgtatgagacaatagatttctgttgtttaaaaaaa

SEQ ID NO: 603833 - DNA, 212 bp, Homo sapiens
tcacgcaaaggactcatcgtgtgcgttctcaattgctttattatcaacttgtaatttgttcataagcgaaaaaagtattagacatatcgagtccatactggctggtgcagttgctcgcgcctgttatccctgaactttggcaggccgagttgagtagatcacctgaggtcaagagttcgagaccaggctgttcaaggtggctgacatccctt

SEQ ID NO: 603834 - DNA, 355 bp, Homo sapiens
aagggatctgtgggctatgtggttcacacctgtggtcccactactgtgcagagtgagggggctgaggtagaaggatcgcttgagctcaggagttccaggctgcagtgagctatggtctcgtcactgcactccagcatgggcaacagaggaagactgtctcgaaaagaaaagaaaagaaaagaaaagaaaagaaaagaaaagaaaagaaactctataggatacgtttctttttcactctcttcaatgaagattgccatttcagtgaagcagctaaatgctcaattgaattaagtactctttagaactggacactttaaaaagaggagaatatcatttattaggatgcatggataca

SEQ ID NO: 603835 - DNA, 1507 bp, Homo sapiens
  misc_feature (1)..(1): n is a, c, g, or t
  misc_feature (646)..(647): n is a, c, g, or t
  misc_feature (651)..(652): n is a, c, g, or t
  misc_feature (689)..(689): n is a, c, g, or t
  misc_feature (701)..(701): n is a, c, g, or t
  misc_feature (827)..(827): n is a, c, g, or t
  misc_feature (858)..(858): n is a, c, g, or t
  misc_feature (1117)..(1117): n is a, c, g, or t
ncttgtcgtctcgtacttctcttttcatcttcttgtgctgtgtattgtttcgtctactgctgttattttttcctcttctctctttcttcttgttgttatgtttgttttacacggctcgtgtgttggtttcccactttggtgtctctttctgtttggtttgcccattattctatcacatggtggcgccctctttccggacaagtttcctctgggtttcaattttcccctcattttttccagggacatcttctattctaaacgacccgggtactttataatggattcccccgttctggacagttcacactcctgtggacggccaaattggtccacccagtgacaaaatttgctgataccgaaggcacacttggttttttgccccgccctttctcacgcatgggattaatctgtattccagacgggtcgtttctagatttccttcaccgttttgctcttaaaactgcttctctgctctgaggaagcacagctacctgccttcactgatatatacctcaggctgaaatttggggtgggatacccggtcacattgatcttctccccggaaggtgcacgcttttccatatcacgctctaaccaccgccgccacgtccacttcttaaggaaactgccgactaggactgatganngcanntttagctttgagcttttgggggttattctacccaccnaaccagtccatntggaaagaaaacagtccctggaaattaacagatcagaatgttcacacctggttgaatctttttttaaccatagagcatgaaggtagcagaagctggtgtgtttccagatggttcttctaacccaanctaatttttcactgttgaccaagcgaggcanagggttgcactggacccaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaanaaacccacatgatttcaagggagtcgggcatccctgaatccttcttccctgccagggtgcctgtcacctggtcttcactggcctccttttccctggtcatggctcatcagctttatgggcttctggtctaagcacctgaacagaggactggaaacctccacttggcaggcgggtttaaggtctggaattatgtaagaaatcttggcacagcactggctaaggtaaatttcagtggtttttccctctaggacaaacactttaccaaaatatgcaactttttttggggggggaagagagattgtccggtgatttctacccatttcctgaggcctgtggaattaaccctttatgtacttaaagttatacgaaacttagattattgttattacc

SEQ ID NO: 603836 - DNA, 186 bp, Homo sapiens
aacagccgttcgacggcaaatctgtcaagatcagaaaaatagggccacgtgaagtttaagttcgatggcgcgataccttaaaccctggcatcactgcaaagagaggcagagaaactgagcagtccctgcccacggtttggcagtgaggaactgaaatgaacaatcagtgtgtctggttcgtcgacg

SEQ ID NO: 603837 - DNA, 113 bp, Homo sapiens
  misc_feature (24)..(24): n is a, c, g, or t
gagagagactgtggcgaagtctgnctatctcacagtgctaccatgcttagatgagagctgagagctaacaggagacatttgacccgagaggagacatcccgacattgacctaa

SEQ ID NO: 603838 - DNA, 117 bp, Homo sapiens
cacaacttgctcttctccagaccctgcccctctcaattaaaacaatgctctcttttttcttttctttttctctttgagacggagtcttgctctgtcacccggtgctggacgcggtgg

SEQ ID NO: 603839 - DNA, 372 bp, Homo sapiens
cctccgagtcaaacaagttctcctgcctcagcctcccgagtagcccggattacaggtgtgcaccaccacacccggctaatttttgtatttttagtagagatggggtttcaccatgttggccaggctggtctcgaattcctgactttaagttatctgcccaccttggcctcccacagtgctgggattacaggtgtgagccactgtgcccagcctacctggctaacttttacatgtttttgtagagatgggatttcactatgttgcccaggctctcaaactcctggcctcaagcagtcctcttgccttggtctcccaaagtgctgggattacagatttgagccacagtgctggctggtgctcagatcttgaaca

SEQ ID NO: 603840 - DNA, 394 bp, Homo sapiens
ggaaggccgaagtggagaagggttccagtgtgagtagctataatgaacagcgatagtatcgtcccgtctaggaatactagtatatctgtcaagtgatatactccctagtatgccctagaaggaataataggtatcggcgggtaacagtgtgatagactagggctcataaccctcgagggagtcgcactccctcgttagaccaagtgattgtgcctagtgccatgagccgtaggtgcgtttgggacggccggccgaagcgggcgggggggcctagtctcctacgtgagtctcaagtgcgccaagtcacatatggctctagagctacgtacatacacgtaaacgctactcgaacggctgaaaactagtgcgtcccacacaataatagttactacca

SEQ ID NO: 603841 - DNA, 113 bp, Homo sapiens
aatgatgagtaaaagattcaacaactcacagccctgggggcactcaggctactgctaaggcctgagagttttgcaaaaatgcgcagagaaacaccctttgaacgtggctttct

SEQ ID NO: 603842 - DNA, 354 bp, Homo sapiens
tagttgtccaagcatggctgagcgctgggaggagcatcagcactcagcctcaccagccaaggataatactattccagcaacttcccagccctcaatatggaagcagtggtagaagcgccccccagtgtcagaagatggtgaaccaatttctatccaaaggtggaacactgtgccatgtgcgcaattgtgctcatgcctgtaatcccaacactattggacggccgaggatgggacgatcaagcggtcaggagctgacgaccatcctgtgacaccattggataaacacccgactcatactcacatccaaccaattagtcccggttcagttgactcgtgcctatactccccgtgctc

SEQ ID NO: 603843 - DNA, 274 bp, Homo sapiens
  misc_feature (136)..(136): n is a, c, g, or t
gccgagatgtctcgctccgtggtcttagctgtgctcgcgctactctctctttctgccttgaggctatcagcgtactcccaaagattcaggtttactcacgtcatccagcagagaatgggaaagtcaaatttcctgnaattgcctatgtgtctgggtttcatccatccccacattgaggtgtgacttactgtagagtgggagagagaattgaaaaagtggagcagtcagacttgtctttcagcaaggactcgtctttctatctcttgtactacac

SEQ ID NO: 603844 - DNA, 326 bp, Homo sapiens
cagtcagacgggaagttcgggaagggatgcagagccagctcggttacacgtcaaacaaaataaagactgacaaaaactctgtcggatttagccagctagaatgtgaccagcaacagtgtcagccagcaccacaggtgacttgggcgagtgatgggcaaaaaaggcagatgagaccagggcaacaagcacagcgtcagcatgcaaacacaggcaggggcaactcctgcggtatggcaaggcaccactgtctcggcacagctttcagcacgcaaacgcacatcaacaccaggggcagcagcactgaaagcaccatagcaggcagagca

SEQ ID NO: 603845 - DNA, 849 bp, Homo sapiens
  misc_feature (123)..(123): n is a, c, g, or t
  misc_feature (127)..(127): n is a, c, g, or t
acgtatctttcgaggaataacagtttcctctggtacattgcaaatcgtaagagcactgtgaatgaaaataaggtagtctctcgtcgcaaccattctactttccatgcacccgtatctgcggcncgcnctttgcaccctagactcaggagtgctatccattagtaggtggaggacgtgagatgatggtatcgatttgtgaggatcgagacttggacacattagtaattcgtacgggctaaacactatccttatcgggctaggttgctgcatcttggccaagtctctcattcctgacactaaatgctcggattctatctttcataactagagattgaatcaaagaccttttgtatagttcaaaaaacaacaacatcacggcctccttggactacatggtggagctctgcctcctattctcttcacaggagtataatccatgatcctgggtctactgcctcccccattcggacccttccactttaccaactgcctcagattacttgaaaggggactaccgatctccccgcaattctcgtgaaccactaaaaacacttgttaaccagcaagtcactctcagtgccgctacccttcccacgccaaatcccccgctttatctcccaatggctagcccccctatcggcttcacacccccttgctctaaagtcataacttgcaaaatcccccactacgtccgctgcactccctgcggtatccacttgtagaccaactttacccccctctcaccaatactggcttccacccacacccccccgcccctctcgttctctcacctttgccctctctcccacccacccctccccgcacccacttccttatccattttatttc

SEQ ID NO: 603846 - DNA, 213 bp, Homo sapiens
ctgcgccactgtgagcctccattgaagctccccccagcctcgtgtcaatgggctgctcagggaggctgccccgtctcagtctggctggctcacgctcacccttcccattccccactgccctcctcgcccagctctgtcagcctcaagtcttgccaaactctcacacctggactgccgacctcccatggcctgacgtcctttccctgaccatct

SEQ ID NO: 603847 - DNA, 280 bp, Homo sapiens
  misc_feature (18)..(18): n is a, c, g, or t
  misc_feature (73)..(73): n is a, c, g, or t
  misc_feature (223)..(223): n is a, c, g, or t
tgtacagaccagagacanagcaagagaagaagcagagactggttgcccgcgccgagaagaaggctgctggcanagcggacgtcccaacgaagagaccacctgtccttcgagcaggagttaacaccgtcaccaccttggtggagagatggagctcagctggtggtgattgcacacgacgtggatcccatcgagctggtgtcttcttgcctgccctgtgtcgtanaatgggggtcccttactgcattatcaagggaaaggcaagactgggacgtctagtcca

SEQ ID NO: 603848 - DNA, 814 bp, Homo sapiens
ttaatctcaggaatcagcttgcaacagagcacaaaaaacaccaacacaaatttcaaacaagaaaaaagttttattttccctcctgccagcgcaattaattggcatcatcatcatccagctgacaactgcatagatcgcatatttcctgcatcgttcattatttgtggtaatcaagccatggcacacatgcacactttcataccaccaccccactggtgctctgtccagcagcatacaatcattcaggagggttgcttctttcaacagccaacacaagcacacacaaaacaccacaacacacccacaacgtcattcaacacatcgcgtccatcatcacacatcattcttattcttccgtctataccaagtgtttttcgacaacgccattgctaaaacaccagcttttcattggtcaccgtctacttggcaacacaatcattcaaccaatctcacattgctggcaatcaccatagcgtggtataacccagacgttcccgttcaattccgtcaaatcaccgtgtggaaaaaattattcttttttcccaacgggcattagcatttacggcatgctccaccaccagcacccgcaccatttattccaagggatatcatttacgttggaagggacattgggggctaactaatcaccaacattacattctccttcagggaacacaaacttttccaacgttctaactttcaaggttacttcctgggactcgcacctgaccccggttgccccccgttttatattcctgccacgctgggtcagaccttagggcctttactgttgttcgcaagactgctcccttgt

SEQ ID NO: 603849 - DNA, 213 bp, Homo sapiens
caggaataccttattgctatcaacggacactctttgtgaaaaatccaagtaatattatagttcaaacgtgagcggagccaaggcccactgccacctctgggatgggagtcggacctacataccaagtgacaagttcacctacaacatctagcttccatgaatggctttagattcagctcgtgccagtgcaacagcaacaggtgtcagactcct

SEQ ID NO: 603850 - DNA, 93 bp, Homo sapiens
gatttgctggtgcagtacaactaggcttaatagggactcgaattcgaggcgcgaattcgagaagcttctaacgttagaagcttgaattcgagc

SEQ ID NO: 603851 - DNA, 136 bp, Homo sapiens
gtgcggcctcagcctcccagtggggtagtattacaggtgtgacgcctcgtgcgccgggcctaccttttcttcgtatactcgacatgagtttcaggtaagttggcgtagacataaggtcgtcagtgtccatttggag

SEQ ID NO: 603852 - DNA, 150 bp, Homo sapiens
tgaccagtgtcggctgagtggaagcacgggctggatcatccatgaccagctacagacatggagtaccagattgtgttcgaggtgagtgatagggaaaggacgttccggagagattgccattgatgacatactgtgaaatgaaccaagcta

SEQ ID NO: 603853 - DNA, 1156 bp, Homo sapiens
ggagaaagcagcgacgtgagaggggaatggtggcgccaggcgagcacccgtggagccagcgtggacctgggcagtggggcgcccggagcaggcgctgcatgctgtggccccgcggcggtggatcctggctggaagagagctgtagcactgtgctcgcactgagtcctgtgtggcctgagtgtaccagtgtgatgctggccatgctgcaccctctggcttgcgacgcgcccgtatggtgatgcccctctagaagctatgcccctgtgtggcccatgtccagaccactattccgtccgtatcctggggctggacgcgtacgtaacatggatccacgtcaccctctttgcggggaagggcagggacaaccataggagggaggtggcttcccattgttacaatgtgcaggcggcaaagctccccattgtaccccaatggacaattgggcacctttggcaattacactccaagtggcaccttgagaacaggtgaactttggacacctccgagcgttcacgccgagaagaaacgcttgctcgacaattgccccagggccgttcacgaggggaactcccccgtttgggagccttggcaggccgccaacctttcctttgccacgcaagtgagctctttgtgccaatcccacttcgaaggaaggccttggaggcaggagcaactcccaatggaacaggggggaccatgtgtgtgcacaatttggggtttggcaccatttggttagcttgggcatcccccctagaaggaccacgcaacacgaggtgaaacggttcggccagagaactagcgagcgccgtcaatacagatcattccgcgcccagagccgcaatggcgtggccacgcgtatacagcacaggaacgtttacagcacgtctccgcgatgcgaggtgatttgccggcggtcaagcgctttcccccacggtaatttcgctgcgcgtatcacgagggggtgcaagcactcggggaacctgcaacgcttgggtttgcatgggtctagccaaccattgggatgattatcatatgtattgcctgtccgcccctggtcaacaccttggcagcgagtgttccgcagtgggaacgggcccttggtgtgaccgaactattggtatccgctgtgcgacagtgtgggccacaagccctttgt

SEQ ID NO: 603854 - DNA, 1380 bp, Homo sapiens
ggagagaactagtctcgagttttttatttattttttggaaatatggtctgggctctgttgcccaggctaaagtgcgggggcacaattatgggctcacgtggaacctcgcgcctccggggctacaagccatcctccaacctcagcctcctaagtagctgggaaccaaagggcacatgccatcatgtccagctaattttggcatttttggtacgacacaggggatttcaccatgttgccaggctgggtcttgaactcctgaactcaagcaatctggcccacctcggcctcccaaagaggtgcgtgggatcatagtgcattccatcacgtgcgaccgtggccaaccagtttttttatgttataaagcatattacatccataaagtttaaagtataggaataaaggatttataagtggcaacttataactcagaaagaagcactttcaagaaagtgggataaatcgagagagtggtgcggggggatcgcacatatagtgttcccccagcagaaaacattacacgtgcatgaaaaggccacaataacacacatttatcaccgtgataccgctttcatacaagtgtcgacgatcatcatagcgcacaccgcatagggaccctgaacacagagcgcatcacgtaggcggatacaaccacgtggcgcatgggatcaacagaaggtgcgcgcacaccaaagacaacacaacaccccggagaaagagggagcaaatccaagtattaatctaaaacagcccgcaacaacatataggaggacacaaaaaagaacaaccccaagaaaaacagaaggacgaaccaaccataaacaaaggggacaacacagaaacaacagaagacggcgccgcaccaaactcagagacagcagccaacaaccgacgacaacaaaagtggcccccccaagaaaaaagcatacttcaccaagagagcttcgtaagaaaacaaccacctctatcagcaccagaggacagacttatctacaacgacacctcaccccgacgcgaacataagtgcgtggagcagaacagaacacaacagaacgaagaacacacaaaatggagggaggatataaggcccacaacccaacagacaggacgggtgcgaaaccaccatagtcgaccgacagacgaggaaccacataccctataagggacgcaacaacacacattacaaaaacaggagggatagaacacacgccgcacggtagaatgatcgatgacagacaacacatcattctacgacgcgccaaatgagtgattgataacaacacatatcaagaacactattctcacagacagcgcccaacttagtatgtgcccgcggcaatataactaccaaagaaggacaagccaaacgacaaaaacagacgc

SEQ ID NO: 603855 - DNA, 81 bp, Homo sapiens
gttttactatgatgtaaaaattaggtcatgtacattttcatattagactttttgttaaataaacttttgtaatagtcaaaa

SEQ ID NO: 603856 - DNA, 328 bp, Homo sapiens
ccagtgcaagagggattgcagagaagaagaaaccccccaagcaaaaaaccagatgaggaaattaagctaaatattaactatctcaagaatattcccagaagtgactgctaaatttaaatccctgctcacaatgaaatactgtacagcaggggttctcaaactttttggtcttaggacccttacagccttaaaaattattgagaactccaaagaactttcaattatgtgggtcataactactgatacttactgtattataacttgaaactgaaaaaatttttaaatatttataaacatttaaaaataataaacccattgtaagctaaaa

SEQ ID NO: 603857 - DNA, 1064 bp, Homo sapiens
  misc_feature (1064)..(1064): n is a, c, g, or t
cggtgtgagagcggtaagatggctggcgtgcgtgtggtggtggagttccagagagcccagtctctactcaggcacctgacctgggaggcctccatcgacatcctccactccatctgtgaatgctgtgacattcatgtgaaaacgatgaagatggcatgtgcaatgtcaaatgatgcagatgcatcctggaacttgggatctctcctgtgcaaatgactggacaatgctgcagagcttggaggactcctgaagtatgtactgacccttcttgaattccatcagcaatggctaaagcagctcgcctggtccgatctcttcttgatctgtttcttgatatggaagcagctacatgtggcagtgagtgtcgagctgtgtttagatgtgcatctgaatgtggccaagtcagagaaaagaactttcttacgccaagctttggaggcaagactggtgtcttatgtacttttgataccaagaggtaccaggaagcatttgcatatgggttctcagctgctgcgggagttgaacaagatggacgacaaagctcttttggtggcagtacagctttgagaaagcaaaagataccatgccctgagcaagctgccgaaagcccgagctgcattacttctgctcgaaccacagcaaatgccatctactgaccccctaaattgcaggccaccttggaacatgcagtcgggtataatccatgcagcagaagagaaggactggaaaagcggcggtactcatacttcatatgaggccatttgacggttatgactccagcgagaagaccccaaggtgcctcacatcatctgcaggaccatgtggcagtgcaaaatcagtgccaagaccccagaaaggatgaccaaggctactggtgaactgtgacagcttcggcactacggtcaatgccgtgggagagaaaatagagcgcatatacaaccggcctggaccaagagataagagagcaagttcactggcgagttaagacaagggatagacaggacacgtagaaactcctcgtggtagcccactatactcaacaccattgcagatgtctagcaccn

SEQ ID NO: 603858 - DNA, 298 bp, Homo sapiens
cacgaggaatcccagcattttgggaggccaaggtgggcggatcacctgaggtcaggagttcgagaccagcctagccaacatggtgaaaccccgtctctactgaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaata

SEQ ID NO: 603859 - DNA, 156 bp, Homo sapiens
gacctaatcttagcatatttgtccttggcgccagtacttttgtgcacgcttttgtgatctgtgttaaaaacctgcattgccaacattgcagctcgaacttaaacttgttattcaaataaatatttaattttttaaattgctattgaaacttctaaa

SEQ ID NO: 603860 - DNA, 1062 bp, Homo sapiens
gaagtctcatttgagaagtcagtgacgtccaacaggcagacttgccaggtgttcttgtcgggtcaccctgcattcccgaggtttgcttccatgcctgcagtttcatatcagaaccaacccatcaataatggcgaatttgacattattgtccttaggtgagaatgagaagaatattgttgagacgaaatgtgtccaccgtcaggcagtgagcatttactttgaggcttacctttacaatgctaacaactgtaccagcacaccatggcatcttcctcccatgcacatgagctcttctcaacgccggccctccactgctattgaggaggacgatgaagactcaccctcagagtgtcacacccctgagaaggtgaagaaaccgaagaaggtgtactgctatgtgtcaccaaagcaattctctgtgaaggaattctacctgaaaatcatcccctggcgcctctacaccttccgagtgtgcccaggaacaaagttttcataccttggccctgaccctgttcacaagctcctcacgctggtggtggatgacggcattcagcctccagtggagctcagctgtaaagaaaggaatatcctagcagacactttcatccgttccttgcacaagaacattggaggctctgagacctttcaagacaaggtgaacttttttccagagagagcttcggcaggttactttcgagagaactccattccaaagtccactctgaaggtcgccagaccggcctgttcggagtcgcttggacaggcccctcgcacatttcccatttcggacgggcccagaactttgacgatgttcacggattaaggaacctgcgcatttcgacaagccactccacgggaaacagctggaccacactctgcaccgttgtgatgccatcccaacatatacatatcatctcgaattcaatggtcacacccacgacaaacttggttcaacacacaatagcccacaacacacgcagaagatagtacatcaaggacacgtccacctcgatgcatcattctcacgagacaccaacgaaacgcaccaacaactctagacaa

SEQ ID NO: 603861 - DNA, 706 bp, Homo sapiens
  misc_feature (310)..(310): n is a, c, g, or t
caacaataggggaggttggtgccaaaagaacggggtgctttgttgccccctctcttccaaaggtgtcgtttctaaagctacccagcgttgtagagagattaccccttcgcctcgatttaaactgccccgaatgttgctacccaactcacggagctgcgtgatttgcaccgagataacgccctagcattcgagagtcgtcttcggcccgcgcaacgcgaacgagttatgtatcgtcggcacacacatgttgttgtagtggcagaagggatctatcagcaggcttttcgtctcgctgatgaagtgtaagtgntaaagagtgaaaagatatatctgcttgaaatagaggtagcgaacgggtgttctcttggcactctctctcgcgtgacaagtggcccccccccagggtttagatctcacacgagtgatagagtgagggtccccccctctcttactatagagagaccaggcgtcttcgcgcggtcgagccacaaacattgtgtggtgtgaagttgtgtggcaccctagagccctccgtccgaacacggagtgtggtctggggagtttgcccacgtatgcaggtgaaagaagttggtactgcgggttgcgccgggcgtggaggtatactatatgtgagcagcatccatctaccaccaccacaagtgctgtttaaagagaagaaataacaaccgccccgccaatgatcaag

SEQ ID NO: 603862 - DNA, 196 bp, Homo sapiens
gctgtactgaggggatgacgaaagccccgtcttcaacgtcctctcacgtttttaaagcattgatattagtatcttctcagatacagaccgttcttatgattttgtaagaagtaaaagttctaacatgaagtcacacaggacaattattcttatgcctcagttaacagtggataaaagacttttctgtaaacaactc

SEQ ID NO: 603863 - DNA, 367 bp, Homo sapiens
cgtggagcaactgcgcagtgagcaactgcccaagaaggacattattcaagtttctgcaggaacacggttcagattcgttacttgcagaacataaattattaggaaacattacacatgtggccaacacagctaacaaggaccacttgggttacagcctataaccatctttttgaaactaagcgttttaagggtactgaaaagttattagtaaagtgtctgagcaagtaaaaaaatgtgaagcttaatgaggataaaacccaaagaaaccaaacctgaagagaccctggatgatggtccaccaaaatatagtaaatctagtctgaacaagggagataaaagcaactttcccaaaaagggagatgtcgtt

SEQ ID NO: 603864 - DNA, 419 bp, Homo sapiens
  misc_feature (287)..(287): n is a, c, g, or t
agaaaacgctatttttctccattgaatttttttgcacctctctcaaaaatcacttggacatatctgttcatctagtttttgcattttctactctatttcattgatctgtgtatgtcccccagctatataatatatatgtcttgattatctattagctatagtaatagagctttggaaatcacggtacgctgattgatatgcccctattatatttctattttcaacaattgtatctaggttatatctagttcctattgtcttttcaagataaattttaagcatacacnttttctagtatctagaacaaaaatcttgctgtgattttgcataggaattgcatcaaatctttggaagaattgacatctttactgtgttgagtcttccaatctatgaacatggtatgtctcaccatttgttta

SEQ ID NO: 603865 - DNA, 1125 bp, Homo sapiens
  misc_feature (500)..(500): n is a, c, g, or t
  misc_feature (503)..(503): n is a, c, g, or t
  misc_feature (508)..(508): n is a, c, g, or t
  misc_feature (514)..(514): n is a, c, g, or t
  misc_feature (516)..(516): n is a, c, g, or t
  misc_feature (612)..(612): n is a, c, g, or t
  misc_feature (719)..(719): n is a, c, g, or t
gcggaggcgtgcgggggcatgtcgggtctcggaggcagcggtagggctcgacgtgagaatcggtagctggggtctagtacagtgcattcgtgcgagttggaatcgatagcctctttaaatatgtgcaatgatgacttggacttcgagacaggagatgcaggggcgctcagctcagcctttcccaagtgcagatgctcaggattacgtaagaatggctttgtggtgctcaaatggcgcgtggcatgtaagatcgtcgagatgtctacttcgaagactggcaaggcacggccagcgccaagggtccaatctggataggtattgatcatcttctacctgggaaggaacatattgaatgattatcttgcctcgtcaacctcataatatggtatgtccccagatcgagtcaaaaggaagtgacttccagctgattggcatccaggatgggtacctatcactgctccaggacagtggggaggtacgagaggaccttcgtctccctnagngagancttggnanggagattgagcagaagtacgactgtggagaagagatcctgatcacggtgctgtctgccatgacagaggaggcagctgttgcaatcaaggccatggnaaaataatggtcccagggtgggcggtggtggcagcagggatcctctgaacctgtagaggcccctccccgagctggctggctctggaccggtcctaaagctggactcntcctacacaattgacttgacgtgcatttagggttttcgccaccccgtcaatctggacggggagacccttcccttaacctaagtacgtgtgcaagaaccgacgaagtgaggccttggagaagtgcatcatttgagccataaataagactgcgggggagaaaaacgggggggaactgcaaaggacaacaaggaaggcgcgtatataacacgcagaaacgaaagcgggaacaggacaagaccgtggccaccacaaaaaggaggagccgagaaagaacaagcagaaaaacccaatgggcgaccacggacggtgatccacaatcgagataacaaagaagcaccacagtagaggccacaacagcagcaaaagaaaaggaaaaggagacgtccatcaccgggcataggacgca

SEQ ID NO: 603866 - DNA, 1149 bp, Homo sapiens
  misc_feature (500)..(500): n is a, c, g, or t
  misc_feature (503)..(503): n is a, c, g, or t
  misc_feature (508)..(508): n is a, c, g, or t
  misc_feature (514)..(514): n is a, c, g, or t
  misc_feature (516)..(516): n is a, c, g, or t
  misc_feature (940)..(940): n is a, c, g, or t
  misc_feature (991)..(991): n is a, c, g, or t
gcggaggcgtgcgggggcatgtcgggtctcggaggcagcggtagggctcgacgtgagaatcggtagctggggtctagtacagtgcattcgtgcgagttggaatcgatagcctctttaaatatgtgcaatgatgacttggacttcgagacaggagatgcaggggcgctcagctcagcctttcccaagtgcagatgctcaggattacgtaagaatggctttgtggtgctcaaatggcgcgtggcatgtaagatcgtcgagatgtctacttcgaagactggcaaggcacggccagcgccaagggtccaatctggataggtattgatcatcttctacctgggaaggaacatattgaatgattatcttgcctcgtcaacctcataatatggtatgtccccagatcgagtcaaaaggaagtgacttccagctgattggcatccaggatgggtacctatcactgctccaggacagtggggaggtacgagaggaccttcgtctccctnagngagancttggnanggagattgagcagaagtacgactgtggagaagagatcctgatcacggtgctgtctgccatgacagaggaggcagctgttgcaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtctttttttttttttttttttttaaatccaatcgggaatcaaaaagggggggattcgggcaaagggtccttgggcccttcccaacttcatcccgtggctcgggtccccgtgttggccttatatagccctttataccctggtggagcaccaccccaangagacgtggggaccagcccccttcgctgtgccgtggtgttctcttcccaanaaccccttttagaagtggggaggcgaacagacggcaggaacaggggagggggacctgccccctcctcaggcatcggggagggcccttgccccaatggggtttacccttcccgggggggctctctcccgcgaactttggttcaattcaaacctgaatta

SEQ ID NO: 603867 - DNA, 491 bp, Homo sapiens
tctaccaggctcgctcgcagttccaccgaacgagcccatgtcctatcccgcctcagtgccttgcagctgctggtgcacatctgcccggagcaatcttcctccagatgtctagctgctccttcaagcctcctccttgtccacatcaccttctccatgcggggacaccagctccgtaaggcttcctgtggctgtctgtacccagtgaatcccactgcaaacacttcctaagtctgtgctgaatgaacaaatgacagacagaaagacagacaggggtggaaggaaagtggggccaaggcacagggcagaaggggtccccagggcatagctgataggaaatgatcactcttcagacacagtgtcatgggaccctggattaccaatctgtctctgggagtccaggagagggtaaggcaggggcaagctgagctgagctccaggcggatcaatgtgtgtagtatagtgacagcatacctattaacaaaggtataaag

SEQ ID NO: 603868 - DNA, 209 bp, Homo sapiens
cccccccccggggggggggggggttttaggggggggcctagggggggggggcccaaacccccccgtccctgggggaagccgggaaaccggggggacttttttttccccccccccccgccccggggcccggccccccggggggccctggggttttccccggccccccccccggggggcagccccccccccttaggcctttttttagggga

SEQ ID NO: 603869 - DNA, 880 bp, Homo sapiens
  misc_feature (172)..(172): n is a, c, g, or t
  misc_feature (210)..(210): n is a, c, g, or t
  misc_feature (271)..(271): n is a, c, g, or t
  misc_feature (307)..(307): n is a, c, g, or t
  misc_feature (319)..(319): n is a, c, g, or t
  misc_feature (323)..(323): n is a, c, g, or t
  misc_feature (339)..(339): n is a, c, g, or t
  misc_feature (366)..(366): n is a, c, g, or t
  misc_feature (396)..(396): n is a, c, g, or t
  misc_feature (451)..(451): n is a, c, g, or t
  misc_feature (515)..(515): n is a, c, g, or t
  misc_feature (641)..(641): n is a, c, g, or t
  misc_feature (663)..(663): n is a, c, g, or t
  misc_feature (667)..(667): n is a, c, g, or t
  misc_feature (673)..(674): n is a, c, g, or t
  misc_feature (676)..(676): n is a, c, g, or t
  misc_feature (685)..(685): n is a, c, g, or t
gaagtggtagcagttcctcctaactcctgccagaaacagctctcctcaacatgagagctgcacccctcctcctggccaggcagcaagccttagccttggttctgtttctgctttttttctggctagaccgaagtgtactagccaaggagttgaagttgtgactttggtgtcncggcatggagaccgaagtcccattgacacctttcccantgaccccataaaggaatcctcatggccacaaggatttggccaactcacccagctgggcatngagcagcattatgaacttggcagagtatataagaanagagatcatagnaaantcttgaatgagtcctnataaacatgaaccaggtttatattcgnaagcacagacgttgaccggacttgtgatgnagtgctatgacaaacctggcagccctgtttcccccagaaggtgtcagcatctggnaatcctatcctactctggcagcccatcccggtgcacacagttcctctttctgaagatcagttgntatacctgcctttcaggaacatgcctcgtttcaagaacttgaaagtgagactttgaaatccagaggaattccagaagaggtgcacccttataaggatttatagctacctttggaaaactttcaggnacacatggcaggaccttttganttgngtaagnnangacctttanatgtggcgtgtcccaattccttactctggcatgggcacctggctagtgcgccatggcgattggccctgccttgggatcaacgaaagaaacacgccaggggctggccgaacccacataaagacgacacgaaatcttgtgggcaccgggccaggcaaaagaccctctcgcgagatagacggccacaacacccccctg

SEQ ID NO: 603870 - DNA, 306 bp, Homo sapiens
agcactggatggcagataccttcagctctgctctctctctctctctctctctctctctctctctgtcactgttgtgctctctctctcttactctcgctctctctctctctttcttttttggagacagggctcgccctgttgcccaggctggaatgtgtgcatgtggtgtgatcatagctcattgcagccttgaactgctggcctcaagatgatcctcctaccttggtctcccaaagcactgggattacaggcgtgtgccactgtgcttggcctcaatagttttgactttggattgtaatatatatt

SEQ ID NO: 603871 - DNA, 479 bp, Homo sapiens
aaccaatttccaccaatcacctctaccatcactaactgggcctcatgggatagcagtcaccgggagatgacgtccggggcgggctctgccccttctatccagcagcagcactaatggtcgggagacccaagctcacttttggatgactcggttcacaatggctggatttattacttggcaagaaagctaacaaagctagaagcacaaagctggttggcactggtaccgagaatatttgggcaaagctggtgattttatggctggatgcggccctctctcttcatggattggtgggcatatggcctagggacacggcgacccttcgggaaagcaaagtcccctatacaccatggtattctggagcatgggggagctctctcaggtatcgcaatggaggctggaagacatttggcaatgtcctctgggcttccggttggggggacaacaaagctaagcagtaattaatgctaaccggatag

SEQ ID NO: 603872 - DNA, 176 bp, Homo sapiens
caggcgccattttttactgcaaagtctactacttccaaatgttattccaaacattaccttttaacagtctatcaatcaataaatgttgaacattttttttctaaaaaaaaaaacacacacaccaacacaccaaacagaagacacataccatatacgggtgacacacaaaacaaaaa

SEQ ID NO: 603873 - DNA, 318 bp, Homo sapiens
agtaactcagaatggaaaaacggacatcgtatagttctcattcatatatgggagcaaagctatagcgatgcaaaggcgtaagaatgacacaatggacttcggggaatcaatgggaaagggtgggaagggggtgagggataaaagactagcaaattgggtgcagtgtatactactcaggtgatgggtgcaccaaaatctctctaatcaccactaaagaacttattcatataaccaaacaccaactgttcccccaataacctatggaaataaaaaaatttatatatctcagaactccaataatgtgtggcaagtttatag

SEQ ID NO: 603874 - DNA, 277 bp, Homo sapiens
ttcgcggctgcgtcgacgttgtggtggttcacgccttataatcccagcacttttgggtggtcaagggcagaggattgcttgagcccaggaattcaagaccagtctgggcaacatggtgaaaccctatctctataattgaaaactcagccgggagcagtggtgcacacctgtagtcccagctgctcgggaggccgaagcaggattgaggctccaatgaaccgtgatcgcgccactgcactccagcctaaggagcagacaagacgtcgacgcggccgcg

SEQ ID NO: 603875 - DNA, 384 bp, Homo sapiens
  misc_feature (232)..(232): n is a, c, g, or t
gcctggtgcagtggctcaggcctgtaatcccagcactctgggaggccgagtcaggtggatcatctgaggtcaggagttagagacaagcctggccaatatggtgaaaccctgtcgctactaagaatacaaaaattagccaggtctggtggtgggcacctgtaatcccagctacacaggaggctgaggcaggagaattgcttgaacctgggaggcgggggttgcagtgagccgngatttcgccactgcactccagcctgggccaacaagagtgaaactccgtctcacaaaaacaaaaatgtacacctcgtcagatgctatgacaccaatttttctctttttctcttcctcgccgttggcgtttatatctgggctgtttgcctcccg

SEQ ID NO: 603876 - DNA, 137 bp, Homo sapiens
ttttgcggtgcctttccttatgtattaatatttttcaagatatgcttcatagctattgtatatgccagatactagtataccataattatttatcccattggcctactactggggagttatttctaaatgcttcagta

SEQ ID NO: 603877 - DNA, 396 bp, Homo sapiens
atgagtttctccaagactaacacaagatgctacagaatttttcaaacagctaggtcattttctttatatgtacttacttagaacttttataaatgtagcctaaagctttgaaaaacttgagattaaaaaaagtcaacaaaatattttaaagagtaaatacaaaaggtttaaagaaagtttaaagaacaattactatttatctgaaagaagagaaaattcaggcatagctggaagactttgcaagcatagaaaggattatacaaaaaaggtgaccatatattctctctctagtgatgaattaaatgaaagacaatggctcaatggtagtggaagaggataattttaatagtaatggttattaattatagaaattatttattaaaattaaatagtaga

SEQ ID NO: 603878 - DNA, 1143 bp, Homo sapiens
  misc_feature (708)..(708): n is a, c, g, or t
ggggcgcgccccattccccaaagagtgaaatctccgggctcccaaaagagaaaaatggaggaagaagggggaagaagctgcccccccatgtgggacacccgagggatcccccggggtttttctccacaatagagagacaaccccctgtcgagcccaaagcgccacataggacttcacccaaggaccgtttggcataactggcgccacaggagaggagagacaagccccaagatggggggtgagagattgaaaaacactaatttgttgaacccggtgggggaagccctttttttcaaagaaattagggacttttaaacatcttttgcacacgaaaaaagatgggtccccgctgccagaggacattttgtgaaccctccccgagaggagaggtcttacacacgatgattctctcccctgtacgcgggacacactgcgcccacatcgcgcgcatacttgggcgcccacatgttgaccacattttgagaggtgcgcacaggcacagggattgcccttcaccccttctctaaaaaataatttgtggtggaagtatacctgaggccacccccacacggggagaagggttgagacatgagtctataaatcacggaaaactggggagtttctcttggtgataaactcgagagaactctttaatttgtgggaaaatgtagaaagacccctctttaaaaagaattctgtctttcactntcgcttgtagacactcggtgacactcttttccgctcgccactcttttgtttccccacaccacacaaatttttgtttgtgggggttatatgtttatactgagaagagatgtgaccacgagtgaggtataagctggagaggtgtttatatgtatataagggcactatattgtgacacttcgagaaattctgagagacacctcgcacgccacgagttttataaattaccacacacttcttgtgtattaacctctttttataaagagttgtgaaaatatccaaatataaatgagatcacagtgtttaatatacttgtatgatgggtggatgaggctgtcccttgtaccactttgtttgaattttcacaggcactggtttggcaagtgccagaaattttgtaaccctttaccaattccattaaaagttaataatatggga

SEQ ID NO: 603879 - DNA, 329 bp, Homo sapiens
gggcggggggcgggggggtttttttttggccccttggcccgccccgtaccaattttggggggttagggcggggggggcggttgggtcccctccccccttttttgggggtttgcccccgccccgggttgggggccggggtttttcccccccccggtttttaaaagggggtttgggggttcccccttgggggggggcccccccttttggaaaaaccgggggttttggggcccctcccccctgggggggtgggcctttggtcccttttttttttttgggggggccctggggcctttttttttttgggccccccggggccccccctttttcca

SEQ ID NO: 603880 - DNA, 393 bp, Homo sapiens
tgctacttgtagtgcagtagtgggaacacttcggccacctgactcttcttcatgagctacgaacaggggtgtttcatacattcctaaacctccttgacaagcaaactggccaagatcacagtgactagaacttgtttgtggcatatctacaagtggcccaaaccgcaatctagggaccacagaaacctgcggcgtatgtatagcttcaccaaatccatcagtacgatgtggcaccacaagagtcggactacttgcaactgttctgtctatcatcatcaaacaaatgctgttgcatgaccaccattcctggagtcaactgaaggccacgtccttcaaactgccttcgggtcatcctgaattctctgcgcgccacgataaagggaatacatctgc

SEQ ID NO: 603881 - DNA, 238 bp, Homo sapiens
cgggtggatcacttaggagtttgagaccagctgggcaacatggagaaacactgtctctactaaaaacagaaaaattagctaggcatggttgtgcgtgcctgtagtcccagctactcgggaggctgaggctggaggatcgcttgagtccaggagttctgggctgtagtgcgctatgccgatcgggtgtccgcactaagttcggcatcaatatggtgagctcccggtacatgcaagggta

SEQ ID NO: 603882 - DNA, 228 bp, Homo sapiens
  misc_feature (22)..(22): n is a, c, g, or t
caaaaaaaaaaaaggccccccntttttttttttgggggagggggccccctggcctttgaagggttttatcccccccttttggccgggggccaaagaaagggataaaagggttttccccaaaaaaaaagggccgggggggttctttttaaccccccccccgggggtttttttttgggtttttccattgggaaaggggggaaaaaaaagggggggggcccccccccccca

SEQ ID NO: 603883 - DNA, 336 bp, Homo sapiens
ctcaatggaattcaaccaatcaggaaccaaacattcaaatacgagcctgtgaggacctccttccttcaaaccaccataatgaatgaaaatgtatgcatgagtgaataaatgagccaatacattcatcaaaaatggcaaagattccatgctgatatgctatcaattgcaatcagagtgcatgcattggaaggcgcaatgcgtccaccaccacatttggggacctagatatttcctccagctctttgaagactgaaataccaacaagctaccaagtttacaggttatatatagccacatgcctagaagaaacagagcacatgaaaagcactaatggta

SEQ ID NO: 603884 - DNA, 219 bp, Homo sapiens
ttttttttgggggccttttttgggggggccctgttgtgggcttccccccgcgccgggggtcccccgggtttaaaacccggctttgggggcccgggcctggttccccccttgttttccgggggggaacccccttttggggcctgggctttgggttggaaagggttttaaaaaaagtgaagggcgggaaggggggggaaaataaaaagcttttttgcccca

SEQ ID NO: 603885 - DNA, 806 bp, Homo sapiens
  misc_feature (34)..(34): n is a, c, g, or t
  misc_feature (63)..(63): n is a, c, g, or t
ttggtgcaagtgccaaagttgtgcatttcctccnacaagtggaagggtggaattatacttatnatcccaaaacaaaaagtgtcaaaagtgaggcccatgatcccaacatgactcatccagagtttctcatcctgtggtggaacatctttaccaccaacgttttacctctgcttcaacaatttgttcttgtcaaagaggtgtgctcatatgtaaatgtgaaagataaataaggagccatatcacatctgtccctttggggagatcccagctatggcacagccgtttgtatcctcggaaaaacggaaggaacgactggaacaaggccctgctgattatttgggaacagattccttttaccaactgcaaaaggacacttgacactaacccttcaaaaaaaacactgcatttttctttggaacacatccactccacagacctttgtttctgataccttagtgtccaagagctggggtttaaaaaagtgttgtgtcagtgtgttagaaaattatccaaacccttccccagacgggaaggctttttttagaatcaaaaaggggaaacctgggcaataatttgcggacgcaacccctcctggtgatatgagaacggggtgccgctttttaagacctcctacgaacttggtcacaagattttgacgcttatggtggctgccagcattagcagtgctggtgaacttttacatattacgcagcggttcatatctcttgtaaactcgtcataaagcctggtaaaacatgcgccttcctttcagaacaccaagatcccgcgtcaggtaagatagataa

SEQ ID NO: 603886 - DNA, 108 bp, Homo sapiens
aatataaaactataagtattaaattgttattttctcacattgggaatctctaatgtgataatgttttctatgaaaataatttttttatattaattgttatatattaaa

SEQ ID NO: 603887 - DNA, 533 bp, Homo sapiens
  misc_feature (399)..(399): n is a, c, g, or t
agaggatcccctatgtctcgatgttaggtgttgtaggggagtgggcatagacagcacgtggctcaggtgtggaatgaagctagacaggtggaagccgaagggtcggctctccaggcaggagagaaggatgatctaagggcaggtgcaggccagaatgtctggaaagcatttctggtgcgggattgccagtttggtgacgtggactctgggaagcaaggggacaggggacagcagtcagagctgagctgctgcccacagagcaggctccactgcccagaggctaagcggtatcaccaagcggcggacaactggcaggtcaggaagaagtgccactccagcctggacaacagagtgagaccccatctcttaagaaaaaggaagaagcagcaccagaactgngccccctagtcttaactgtctgggaggctgaggcaggaggttgcttgaggtcaggaggtgaaggctgcagtgagctgtaatggcaccactgcactccagcctggacagcagcacgagaccttgtctgttttttc

SEQ ID NO: 603888 - DNA, 232 bp, Homo sapiens
gatccgcatgaagctgagcagtgtctcctcgtcctgaagcagtacctctgacagcagccctggagcaggtcctcgcgctgcccatagaacagtgaccactcgctcatgctcatatactctgctgtgatctgcaccgacttgtcacagccagctgtagaagaaggtgccatcgatttttgaatgaggatggacaggacctgcaagcaatgccccaggactgagtcaggccccg

SEQ ID NO: 603889 - DNA, 147 bp, Homo sapiens
ataagaaaagggaagagcaggagattatggttattcatacataaggtctcacgtgtctgtgatatgttaggatagtacaaataacacctagatgaagattggctagaaaaatataggaactgtttactattggttcccgaaagcata

SEQ ID NO: 603890 - DNA, 830 bp, Homo sapiens
atccgagacgggcgaggagtgccgatgtgtgcacctggacctcatcaaggagatgcggcagtttctgccagttccctgtttccccgttgtggcctatgccttacttgctatccatccccacctaccccagcggccagatcgggtcttcatgctgtgcagcaaagaacccgagcacgaacttccaggagccgggtgcagccgttgacacaagcagcaggtggcgcagatgcaggctgaagtactacaactccgacgtgcaaccggcggagttggtgctgcccgagttttgcccggcaaggctcttgaattgattgtagaaaggctgagccccatggtcgccatccaatgtgattgccagcccaggggacctcggacccttgtgaaagcctggcgggagtgcctcggaccccttccaggcgccccgggcgggacctcctggcttgagattcatcgccacacatcaagacaaggtgttacaaagccccaagaaatgctggccgggccttgcccaatgatgggggggggacgtgcctgagaagtcatagtacctcctcttgggaagttgccaaacggttcccagaggcctattacccaagatgtggtaacggggccatcctcttctggccatttcatggtgggcccctttcaatttcaaccgaaagcagcggttgtaattcaattagccaacaagaaagaaaagatatagcgtgggcgcgcacaacaccactttggggggagacaatcggcccctaaaaagaatattgggaagacgggtctatgagacacgcaagacccccaatgtggggggacgaagtgggcaaagatcgata

SEQ ID NO: 603891 - DNA, 718 bp, Homo sapiens
ctaggtagaggctgggtgttgaatcaggagaggagctggcgagggtctacagcctccggcacatctccacctctcttggtcagcgatgcgttgacgggccagtgtcaagctggagggctccgactggcgcggacggagcgaagctgccgagccatggtgcaccaaacgggcatccacgccactggaagagctgaatggaattctttgccaaggcacgggctggctctgtgcggctcatcaaggttgtgatttgaggactgagcagctcgtgctgtgtgtgcctcgcaggagccagtaggccgctgggatcaggactatgacagggccgtgctgccactgctgtgacgcccagcagcccatgctacctgctctacctgcctcgactcacagaatgctcagggcttcgaattggctcttcctcgcctgtgtctgcctgataagctcccccgtgactggctgaatgattgcttgtactgctggccacggctggggccacatgtgaaaacaggagttttggatggtggacaacatcaaggatgacgctcttctgggacttgtgaagtgatgacctctctttatgcttgggtaccatgaaacacctgtcgtcctgtgcggcaccttggccctgttgacctcgtgcttgagagagagctccagcagatccgcattaacgaggtgaagacatgagatcaggtgtggaaagcaagcaccagacctg

SEQ ID NO: 603892 - DNA, 169 bp, Homo sapiens
aggagatccaccctccttggctcctaaattgcttgggattacaggtgtgagctactgcgtccgacctaattatttttattttgatagagacgaggttcactatgttgcctaggctggtattgactcctgggctcaagcgatcctcctgccttagcttccaacgtgctgg

SEQ ID NO: 603893 - DNA, 821 bp, Homo sapiens
ggcctgttgagaaggaaaaggagaaggagaaggtgacacgcgagactagttctctctctctctctctctcgagagagagagaactagtctcggttttttttttcttctttctctttctattatctatatttcttttttatttcttgtgggctttaatattttctattctatttttcttgttgctttaaaaccccctctctcttctagaacctcttccactctctccgatatgtgctcctactcctacaaaggaatctgtgcgtcagaagaggcgcgtacgaaaatacaccgaccttcacaaaagaggcgctgctcgcccaagaagagagagaacagaacgcgccccacgtatctgcgtggtatctccacccacagagcgcgtatgataaatgacgcggcgcagtacacagcacagctctatcacacacacacccacagggagggcggaaacccccacacagagtgaattctacacgcccccccccgactaggccacgctgcgacaacacatcacgcgaggaaaacaacaccacacgacccaagaaaagagtgtatctctctatctctaccacaaacattttaacatctgatgagggagcgtgtattattccacacagtatatatagaagagaatttgttgagtagacggcatgcgaggagatattaactgctggttatatctctaatctcctctatagacgaccagtgagacgttcgcttccctgggtgtgctgattgatcaaccaaccgccgcgtgccgcgttgattaataaatgcggcgtgagggacaaataacgtcgaatattaaagatgtgcagccc

SEQ ID NO: 603894 - DNA, 101 bp, Homo sapiens
ggcatgacaactgaccttcagcgcctcatgtccagtgcaatggagtcctccaggatcgttcttcgtcgggggaagctggaaatgaacgggcggaacagagt

SEQ ID NO: 603895 - DNA, 188 bp, Homo sapiens
  misc_feature (32)..(32): n is a, c, g, or t
  misc_feature (36)..(36): n is a, c, g, or t
  misc_feature (86)..(86): n is a, c, g, or t
  misc_feature (97)..(97): n is a, c, g, or t
  misc_feature (188)..(188): n is a, c, g, or t
tttgcgagggaggcgctctggctgtcacgggnggcnatgcctgcgccgagcggatcgcgacgtatatcccaacccactacaattgntacgacatggncgtcaccactcaggattggcatattgatcccgataaccatttctccaacaaccccgactttgtggactcctggccgccacatggggttgan

SEQ ID NO: 603896 - DNA, 165 bp, Homo sapiens
aaccactcacctactacaacacctagcaacattaccaataagattagcgatagaattgaactgcgcatagatttgtacgcagaagagaaatatacaagcatatttgcaggactaccctgtactctgcatagaatactgaatacttgcagggacaagctagacccg

SEQ ID NO: 603897 - DNA, 603 bp, Homo sapiens
gggctggagtgcagtggcaagatctcagctcactgcaaattccatctcccagattcaagtgattctcctgcctcagcctcccatgaagctgggattacaggcagccaccaccatatccagctaattcttttatttttggtagagatgaggttttgccatgttggccaggctggtctcaaactcctgacctcaagtgatccacctgcttggcctcccaaagtgctgggattacaggtgtgagccactgctcccagccaagtattcaataattttcataagaaaagaaaccaacagtcagctgactctcatcctagaaattctaaactactattttttttccccctggataaagttgggtttttagaaactgatgattttttagtaaacttccctggagtaaccaactgagtcagtgcctttattagttacaaatacatgtgatccctaaattctcacctgtaggatctaatctcaaaggcttgggccctgagactatgcagctataaaaattggttaggtaccaagttgatcacaaaatgggattatctttctaagtaaatatttgccaaaaactagttaatcaaagatatcccccaccccttg

SEQ ID NO: 603898 - DNA, 944 bp, Homo sapiens
  misc_feature (30)..(30): n is a, c, g, or t
  misc_feature (112)..(112): n is a, c, g, or t
  misc_feature (230)..(232): n is a, c, g, or t
  misc_feature (259)..(259): n is a, c, g, or t
  misc_feature (267)..(267): n is a, c, g, or t
  misc_feature (274)..(274): n is a, c, g, or t
  misc_feature (278)..(278): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (292)..(292): n is a, c, g, or t
  misc_feature (309)..(309): n is a, c, g, or t
  misc_feature (323)..(323): n is a, c, g, or t
  misc_feature (336)..(336): n is a, c, g, or t
  misc_feature (347)..(348): n is a, c, g, or t
  misc_feature (354)..(354): n is a, c, g, or t
  misc_feature (357)..(358): n is a, c, g, or t
tgggcgtcagctgtggctcctttctggatnttttccctccccacccgtattttccgccatcctggcccctgtgtggcccacctggaccccctgcccgaggccggcgggcctncaggggtgggttggcggtttggggaagtgaatgcggttaaggcaacggagtttattctgaggtagatgtggcagggtgtggcacagccccgtgtggcccagccttggccgccgcgtgnnnccgggtgttccctcccccggccgcttngctgttgnctggctngctngccgncngcngccngccgcctctcttttgtngggagacgcaagangtgttgggctgtngggtggcccgnnggtctnganncaaaacagagaaactctcttggtggtccatgagatggcctgtctggattctcacaccagacacttgcgctgagatgcgcctgtgttgcgctgcgccatgtagagtgatcgcccctgttcagtggtgtttacatcagagcaaagaatgtccctggggcggagtctataccggagaggcggtctatggcgctgtgtagagatcacaagattggctacaattgggcacaacgttggggcgccccgcccttgtgggcaccaagagaaaagatctcagatgaagtggaaagttcgccaccggttctggccatttcaagcccaggatgtgacgtggcctccactgcagggccccaaccagagggggcccacaattctctcgtctcctcccggcagaacgggcctcaatggacagaacaacctcccgaggcttttccatcaccgacaaagtcgtgtttccccaaggggacacgcatggcacctgatgacagagacacaaacgattgctatatgggagcaagagccgtgcgtgaatctgacacaagagtctgcagttccctgtgggcgtgcacaccacaaagagggttgccccg

SEQ ID NO: 603899 - DNA, 441 bp, Homo sapiens
tcgtaatgcccggccgcatggcggccgcgggaattcgattaggtgaccgtccgctccaacaaccgtcctcgagccagcagactcacgccgctggtgcacgcggtaaaaaggaccgaattgtcgagccctactgacgtacacatgcacgaaggttctaccgtgcatgccacctgctgccaaaagtgcattatacactccataggcagccttttgacagcagaaattatctgcatcccccagcaaatgacggccgatgcagacccaaccaaagcgccgtccacaattgagtaggtgcacatagacgctgggcaaacggtcgtataagcaactgtttgatccacgccaacttatccaaatcagcatcctcgacttaaaggctaacaccgttagctcacgagctgtaccgcagcaaggttttgccaaacgtagctgagcacgcac

SEQ ID NO: 603900 - DNA, 205 bp, Homo sapiens
  misc_feature (190)..(190): n is a, c, g, or t
  misc_feature (204)..(204): n is a, c, g, or t
aaagtggaacaaaaggcacgttttggagtctcttgtcttaatgatatgtccatccgtctgtccgtccatttgtgttttctgcgtcgtgtcattggatataatcctcagaaataatgaaacttgcctctgtcaaccagaaggaaaaatccgttaaaatgtgggtcgaacttgtagactcggtcacggtatnaaaaaaaatctatna

SEQ ID NO: 603901 - DNA, 856 bp, Homo sapiens
ggccgcatcttcttttgcgtcgccagccgagccacatcgctcagacaccatggggaaggtgaaggtcggagtcaatggactttgagtcgtatcgggcgccatggatcaccaggtgctgcttttaactctggataaagatggcatatcgttgccatcaatgaccccattccttgaccgtcaactacactggttaacagtgttccacatatgattccagcccactggcaaattccatgtgcacgcgtcaaggcatgacgaacggagaacgctatgtcatcaactggcaaatcacaatccaccatacttcacaggagacgagaatccgctccaagaatcaaagctgggagcagatgcttggctgctgcagatagcgtcgctggcagtcccactggctgtacttcacacaccaatcggcagcacagcgctggggcatccatatcgccaggcgtgggcacgcccacaccaggtgtccatacatcatctgaccccacatcctgcatcgatgccccacaatgcttcagctcaatgcgagtagctgcaaccccagtgcagcacagctcatgcaccaaccagaacatcaaacgatccatccagaacacatgcaactccatagccaccaagacgacacatgccttagacaacacccatgagccacaaggctccagtacccactgaccaacaaaacgggccatacagccgccaaaccgaaccgtcacaatgaaacaccaaaaaggaatgcgcaaatgcccaaaatccacatggaccacgccccaaggaaacgacccatgaacagagcaaaaggacacacaccttacacagaagcgaacaacaatgaatgaagaagaatgcacatgaa

SEQ ID NO: 603902 - DNA, 107 bp, Homo sapiens
ttgggggcggggggccggaaagccctaatcgggaccctaatgggggccccgttttacgcttggacgggaagccgccaacgtgggaagaaagaaggggagaagccaag

SEQ ID NO: 603903 - DNA, 264 bp, Homo sapiens
atgttctcatttttagcccgactttgtggcatggtcggaacttatttccttctttaaaggcggaactatattccactgtgacatatagtacctcattttgtagatcctttcctcgttgataaacacttagcaccaacgacttgagtacgtgtaatattccacagttcatcatatacctataataatctagtacatgccgatcgtaattactccttcctggcatatacctgcccgtggcgacacgttgggtactacgctttggca

SEQ ID NO: 603904 - DNA, 846 bp, Homo sapiens
  misc_feature (81)..(81): n is a, c, g, or t
  misc_feature (86)..(86): n is a, c, g, or t
  misc_feature (99)..(99): n is a, c, g, or t
  misc_feature (166)..(166): n is a, c, g, or t
  misc_feature (190)..(190): n is a, c, g, or t
  misc_feature (200)..(200): n is a, c, g, or t
  misc_feature (204)..(204): n is a, c, g, or t
  misc_feature (206)..(206): n is a, c, g, or t
  misc_feature (215)..(215): n is a, c, g, or t
  misc_feature (221)..(221): n is a, c, g, or t
  misc_feature (227)..(227): n is a, c, g, or t
  misc_feature (236)..(236): n is a, c, g, or t
  misc_feature (239)..(239): n is a, c, g, or t
  misc_feature (243)..(244): n is a, c, g, or t
  misc_feature (251)..(251): n is a, c, g, or t
  misc_feature (263)..(263): n is a, c, g, or t
  misc_feature (267)..(267): n is a, c, g, or t
  misc_feature (279)..(280): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (299)..(299): n is a, c, g, or t
  misc_feature (312)..(312): n is a, c, g, or t
  misc_feature (334)..(334): n is a, c, g, or t
  misc_feature (336)..(337): n is a, c, g, or t
  misc_feature (339)..(339): n is a, c, g, or t
  misc_feature (354)..(354): n is a, c, g, or t
  misc_feature (357)..(357): n is a, c, g, or t
  misc_feature (359)..(360): n is a, c, g, or t
  misc_feature (372)..(372): n is a, c, g, or t
  misc_feature (378)..(378): n is a, c, g, or t
  misc_feature (384)..(384): n is a, c, g, or t
  misc_feature (406)..(406): n is a, c, g, or t
  misc_feature (435)..(435): n is a, c, g, or t
  misc_feature (437)..(437): n is a, c, g, or t
  misc_feature (447)..(447): n is a, c, g, or t
  misc_feature (469)..(469): n is a, c, g, or t
  misc_feature (498)..(498): n is a, c, g, or t
  misc_feature (615)..(615): n is a, c, g, or t
  misc_feature (639)..(639): n is a, c, g, or t
  misc_feature (645)..(645): n is a, c, g, or t
  misc_feature (714)..(714): n is a, c, g, or t
  misc_feature (720)..(720): n is a, c, g, or t
  misc_feature (723)..(723): n is a, c, g, or t
  misc_feature (763)..(764): n is a, c, g, or t
  misc_feature (794)..(794): n is a, c, g, or t
gcccgccgcgagcacctccagttctgccggcttctgcgcgccggggccgcctctccttccgccggtgccgcggcgcctcanggaanccccggaggcggncggaggggggcctgcagcgcggggcccggagggcagccggcgcccgaagccagggtgcacttccgantggcgaggttcatcatggaggcangtgtcaaacnaagnangcggtccantcccantgccantgcttgcancanttannaaaaatncttttgcgaaancaanctggacgcctannanccttanctgantgccangtcttcaatttanttggccggcaaaatggaaaaanannanctgcggactcgtganaanannaatgtgtccaanaagtantttaanccaagcggtgagcccctggaantggactcccgcttctgggaactccggganancatcgtgcantgtgagcttctcatgctgaaanttctgcgcttccaggtctccttccaacanccaaaaaaatacctgctccactacctggtttccctccaaaactggctgaaccgccacagctggcagcggacccctgttgccgtcaccgcctgggccctgctgcgggacagctaccanggggcgctgtgcctccgcttccangcccancacatcgccgtggcggtgctctacctggccctgcaggtctacggagttgaggtgcccgccgaggtcgangctganaancgtggtggcaggtgtttaatgacgaccttaccaagccaannattgataatattgtgtctgatctcattcanatttataccatggacacagagatcccctaaggtcctggccaggctgcccaaa

SEQ ID NO: 603905 - DNA, 1116 bp, Homo sapiens
  misc_feature (32)..(32): n is a, c, g, or t
  misc_feature (1055)..(1055): n is a, c, g, or t
  misc_feature (1063)..(1063): n is a, c, g, or t
aaaagaacagagttcgctggtgaaggaaaggngaaggggtttcggccgcatcacgttttaatacatgtttaggttaattcattattgaaaaataggagtcttcttttcattgcagcaaacaaaagtcctttcacaatattggtcatgggccgttcaaatccccaaatgctgaaactcctctgagggatgcgctggcgacaggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggatttgtgaaaatctagatgacatttgccattctatcaaacaaatgaaagaagagcttcaaaagtcacatgatggggaagtgggccttcnaacttgancttcaccttgacactggccaaattgcccggcattgggccacacaccatggccc

SEQ ID NO: 603906 - DNA, 521 bp, Homo sapiens
  misc_feature (32)..(32): n is a, c, g, or t
aaaagaacagagttcgctggtgaaggaaaggngaaggggtttcggccgcatcacgttttaatacatgtttaggttaattcattattgaaaaataggagtcttcttttcattgcagcaaacaaaagtcctttcacaatattggtcatgggccgttcaaatccccaaatgctgaaactcctctgagggatgcgctggcgacaggatgccctgcgcggggcggcggagcgggtgcgtgcggcggcggttgcgagagagatgagccgcggcgatgagcccgggtaagagttggacggggcggggctcctaggggagccgcgggaacggagggcagcagaagggcattcagcaggcggctccccgctcgaaaacccgggacatcccgggtccgcccttctgcactcgccgcacatctcccgctcggccctagggctgagcacccgctgcggccccctgcgtccgctgtggcttacaggctggctacgtggtctgccgccgccgcccgcccagcgcgccctcgggtg

SEQ ID NO: 603907 - DNA, 1215 bp, Homo sapiens
  misc_feature (32)..(32): n is a, c, g, or t
aaaagaacagagttcgctggtgaaggaaaggngaaggggtttcggccgcatcacgttttaatacatgtttaggttaattcattattgaaaaataggagtcttcttttcattgcagcaaacaaaagtcctttcacaatattggtcatgggccgttcaaatccccaaatgctgaaactcctctgagggatgcgctggcgacaggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggatttgtgaaaatctagatgacatttgccattctatcaaacaaatgaaagaagagcttcaaaagtcacatgatggggaagtgggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaa

SEQ ID NO: 603908 - DNA, 804 bp, Homo sapiens
atttgccactgttagtctctggtttcaggctccctccttttcagcctcccaggcttccttgggggcaccatcccgtggtgctctttgattaagaaagggggaggtgagtggaatagggggctgaggatataaatcagagcccgtggcctgcttggtcgttgatagaaatgggtaatggtccttgggctgagatcttgagattcctagatctatatccataggaaaaaagtaaattaatttaataacagtgtgatgagcttccattttatacttatttcatgccagaattaagattaatcttcacaacaatcgcaccttagagtagtaggtcctattatgatccccatttcagagatgactaccttaaggcattcaaacacctagtgagtgatggagctaagattcaaacccaggtagtatgctcccttttaatcacagctctgtaaagcctccatcaagcaacaagcaatttttgtactttctttctgagcagggaagcaaaatcttatttaaatcatactataactggatgatttatatgtgcagttaaaaaagcgggggactgcatgagcaggtcagcccagagaagagtggctacaatgctctccagaagagtggctacaaatgctctccagccctggttgaagaacttggcatctgtctgtgaccagcagcttctcattgcaatctctaaggttactcatcaaccttgaacaacaaacccagcagctggtttcccaaacaaatcgtattacttaaaagcaagaagaaagaatgtggttgtctgtgcatccattatatcga

SEQ ID NO: 603909 - DNA, 225 bp, Homo sapiens
cttagcttcagcttacagcttctgttgttgtgccagcaattccttgattggaaattgtcctttgtgttttgttgctctgttatcctgtaaatatactcggggatgcgtcctgtgtttgtccatctactgctttgattcctttgatcccacccattctttcacttttagaaagaacaaatcattgttgcagaggtctctgtattttgcagctgccctttctggtgg

SEQ ID NO: 603910 - DNA, 1326 bp, Homo sapiens
  misc_feature (32)..(32): n is a, c, g, or t
aaaagaacagagttcgctggtgaaggaaaggngaaggggtttcggccgcatcacgttttaatacatgtttaggttaattcattattgaaaaataggagtcttcttttcattgcagcaaacaaaagtcctttcacaatattggtcatgggccgttcaaatccccaaatgctgaaactcctctgagggatgcgctggcgacaggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggatttgtgaaaatctagatgacatttgccattctatcaaacaaatgaaagaagagcttcaaaagtcacatgatggggaagtgggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaa

SEQ ID NO: 603911 - DNA, 1107 bp, Homo sapiens
agcggagccccgccacgccacgacccgcgacagaacagccccggacggttctgttacagaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggatttgtgaaaatctagatgacatttgccattctatcaaacaaatgaaagaagagcttcaaaagtcacatgatggggaagtgggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaa

SEQ ID NO: 603912 - DNA, 1268 bp, Homo sapiens
  misc_feature (32)..(32): n is a, c, g, or t
aaaagaacagagttcgctggtgaaggaaaggngaaggggtttcggccgcatcacgttttaatacatgtttaggttaattcattattgaaaaataggagtcttcttttcattgcagcaaacaaaagtcctttcacaatattggtcatgggccgttcaaatccccaaatgctgaaactcctctgagggatgcgctggcgacaggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacgtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggatttgtgaaaatctagatgacatttgccattctatcaaacaaatgaaagaagagcttcaaaagtcacatgatggggaagtgggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaa

SEQ ID NO: 603913 - DNA, 1691 bp, Homo sapiens
  misc_feature (326)..(326): n is a, c, g, or t
ggagggggaagcaagtctggtctctgtgcatggacgaagtcggctctgagctccattgggggattcacacagatagctcagaatgccggtgtctaagttgtggatggttatcagaacacgataattgtccctgagtgtggaagatgtactgatgggcgaatgtcgagatccattgctgaaatgggggcttatgtcagcatcgctggaatacaagaactgtgaaggcatgattcttcttagtgaattatccagaaggcgtatccgttctatcaacaaactcatccgaattggcaggaatgagtgtgtggttgtcattagggtggacnaaagaacaacaggcatcatcattgcatttagtccaacacacagcacagcagtttcgtcccagcaggcacagccaatcacaacatgtgcaagcacacaaattcaacaacacatcccaaacagctgtttcatcagccattcgttacgtccatgtatgctgcaggttgttcagcacataacaccacaggcatgcagcacgctgtgaacagcctattcccagcaggcactgtcctgggatctattgcatgcacaaagtaccacagaagcaccctggcacatgggtgccgcatgcatgcaatttcacgccattgcagatctccagcagcccatctcatctttgggccatcagtatatagcaatttagacatgcaagcatgcaaccgggcaagtcactccattcaatcacatcatctcacatcaggctgctgtgcaccccgacagggctggtccaaacattctgcagcccagactcactctgcaaggtcgggacttggtcgcctgcgctactggacaggccatctgacatggcttgtcacacacaagaacagccccttacagcaggccaggtctatggacattgtttctcacagaaacacattgccccatctacagctttccatctaacattacgcgtacatacactcggggtactgtacacatgaccgtcactgaacaaaccattggaagaagaaacacagacaggcacctatcctggtcccttccagtacaagacatattgagatcggatatcacaagacagaacacattggcggacacacgcagggatggatgtaccactggttcaacacgtgcgtcagcccaaaacaagttgttcacacagacattcacgaactgtaaacattgggacattaggcgaccgccacgcacatggatgaacgagcttgccaccacggaaaattggcgacaaagtgaagcgcgaacacgatacagtgcgacagaaaagtgttaaacagacaaagctttcaaactataaccgttcgtgagacaacacacagtccacaacctttaggagccgcacacgagcagcgcgtcacctgaggtcgcaaccaccacactggagaggagaaccacggacgggcacgacctacaccagcagacagctatagtagaacaaaacaagaggacaactacaacagaaacgatagtgaggcacatgaacgagaacgcgtctaacccgaaccgcacccactctcactactctaggcgaggcacgctacaacacagcacgaccaccactagacatcacgtgacgaccacgaaccccataaaccaacgcaactgacgctagatacacagaccaagataccgcatcaacgaagaccatcacgacacacgacgaatgacac

SEQ ID NO: 603914 - DNA, 175 bp, Homo sapiens
gtaaccacgcatgggaggagtgcttgtgattgatactcagatctgagacaggtgtgctcaagatggaagcaccaggactcagacccagatatctgaagcagggtcagagctccttgacgatatgcgactcctctggaggagactttacaacacccacccatgcgtgcattgccag

SEQ ID NO: 603915 - DNA, 933 bp, Homo sapiens
  misc_feature (326)..(326): n is a, c, g, or t
ggagggggaagcaagtctggtctctgtgcatggacgaagtcggctctgagctccattgggggattcacacagatagctcagaatgccggtgtctaagttgtggatggttatcagaacacgataattgtccctgagtgtggaagatgtactgatgggcgaatgtcgagatccattgctgaaatgggggcttatgtcagcatcgctggaatacaagaactgtgaaggcatgattcttcttagtgaattatccagaaggcgtatccgttctatcaacaaactcatccgaattggcaggaatgagtgtgtggttgtcattagggtggacnaaagaacaaacggatatattgattgtcaaaaacgaagagtttctccagaggaagcaactcaacatgtgaagacaaaattcacaaaatccaaaacctgtttatacgcattcttcgtcatgttgctgaggtgttagaataccccaaggatgacgcagctggaaagcctattccagaggactgcctgggtctttgatgacgagtaccagagacctggatttggtgcctatgatgcatttaagcatgcagtctcagacccatctatttggatagctcagattggatgaagaatgacgggtgagtactccttagtcagtttaataaggcgctgtaacccacggaactggcaaaacttcgagccgatattgaagagggtgtcaatgggtactgaaagcatgagggggaaagcaaacccagaaccggtggactggtctacgaaaacatgtgccataagacagcagagcttagtatgtatggacacccgtgacaacatggtgcatgtgatagtgtaacaacactgaacggactctccactccccagcatgcgctacacaaacagacaacaagcacgaacccactacaccagctagcccgaatacatgtctacacg

SEQ ID NO: 603916 - DNA, 703 bp, Homo sapiens
  misc_feature (1)..(1): n is a, c, g, or t
  misc_feature (15)..(15): n is a, c, g, or t
  misc_feature (25)..(25): n is a, c, g, or t
  misc_feature (27)..(27): n is a, c, g, or t
  misc_feature (32)..(32): n is a, c, g, or t
  misc_feature (34)..(34): n is a, c, g, or t
  misc_feature (47)..(47): n is a, c, g, or t
  misc_feature (50)..(50): n is a, c, g, or t
  misc_feature (76)..(76): n is a, c, g, or t
  misc_feature (95)..(95): n is a, c, g, or t
  misc_feature (131)..(131): n is a, c, g, or t
  misc_feature (142)..(142): n is a, c, g, or t
  misc_feature (150)..(150): n is a, c, g, or t
  misc_feature (158)..(158): n is a, c, g, or t
  misc_feature (168)..(169): n is a, c, g, or t
  misc_feature (205)..(205): n is a, c, g, or t
  misc_feature (208)..(208): n is a, c, g, or t
  misc_feature (254)..(254): n is a, c, g, or t
  misc_feature (261)..(261): n is a, c, g, or t
  misc_feature (268)..(268): n is a, c, g, or t
  misc_feature (286)..(286): n is a, c, g, or t
  misc_feature (309)..(309): n is a, c, g, or t
  misc_feature (334)..(334): n is a, c, g, or t
  misc_feature (371)..(371): n is a, c, g, or t
  misc_feature (373)..(373): n is a, c, g, or t
  misc_feature (386)..(386): n is a, c, g, or t
  misc_feature (395)..(395): n is a, c, g, or t
  misc_feature (401)..(401): n is a, c, g, or t
  misc_feature (428)..(428): n is a, c, g, or t
  misc_feature (472)..(472): n is a, c, g, or t
  misc_feature (474)..(474): n is a, c, g, or t
  misc_feature (519)..(519): n is a, c, g, or t
  misc_feature (543)..(544): n is a, c, g, or t
  misc_feature (617)..(617): n is a, c, g, or t
  misc_feature (700)..(700): n is a, c, g, or t
naactttaataaaanaaaataaaananaaaananaaaaaccaaaaanaanaaaaaaaacaggaaaaagggtcaacnaacaatttgtttgcaaggnggaggcaggaaaaggaacaagtaaacagaaaaaaantccaagaccancccaaagnagccaggntacaaaaacnnaagagtaaaaagccaaaaaaaagtataaaaccactnaanccacaaaagaacaaaaggggagtaaaaagtttaaccggtttagggnaaaaacnttaacancacaaaaagggattcacntccaaaaaggggcaccggcaacntttagaagaaagaagttcccaaaangggtggaccaaaaaaacccaaaaacaacaaagcagcnangccaaagcccagnaaggcccantaaacngtcccgggccagggtacatttcagggnaaaagagaaccacatttgggggttttagaaaggcagccaaaatnanatttgggcttttagtccagaagcctaacaaagtcaaggcgacagnccaagcaaaaaaagggaagggagnnaaaaattaagaatcaccacaaacccctgaaacccacatacactgtttaatgcttacatggaatgaaaccagtnttcttaattggcattttacacacacacacacagaatttaaaaaaaaaatcaaaggcaattattctaaatgtactatgatagcntgt

SEQ ID NO: 603917 - DNA, 473 bp, Homo sapiens
ttcccagtctgttggagatttaaagcgcctcaagggtccttctagaagcttccagagaaggtgtaaggaacttcacccaaaatgccaggaagtgaacaaggtcaggcccctcccgttccttccccctccccagcacaggcaatcagtgaacaggaagaaacagtggagtggagggaaagaaaacaagaaaattaagacggccaggccttgggccatgaggcttcctggaacccgggacctggggagcttctgagcaggcggagtgtctccatatctcacgcaggctttgggaggaaaatcgcccccaacacccacagggagccagcccttgggccctttaaggcttcaaagtcaagaacgcagctttttgtgttgtttttgtttctctttgcaagacagctccagcctggccacttgtgggccagcagagctcaaggtcatgtccaaacagggggagggagacgaggtaaatc

SEQ ID NO: 603918 - DNA, 309 bp, Homo sapiens
atgcaggggctgggagggttaggatgaaaaaactggggcccttggaggccccctgtaggtgggagggagcttattttggggtggggggtggggctagagggccatactgaaggggttaaacaggtttttgctcctcaagaatttgtttgcctgggcccaggattggaggggttcccccccataccctggggattcaagaatcagatttttaatacttccccttttttgttaggtatgacccctattaacccaatttttttgaaaactgggggctccccttgtccttagcaataaaatgtgttgggccga

SEQ ID NO: 603919 - DNA, 501 bp, Homo sapiens
agcggggggggagtttgcaaatggcgtctccctcgactaggagcggcagaaaaaggcgctggaaaaagtgaattgcgtaaccagaagccgaagccggagaaccaagatgaatcaggaactccttacggttcctaatggttggaaggtaacagcgggggggggcgaggacaatccctagaggactttgggagagaaagcagtttcgcaactatgtgcccaaaatacatgggaagcttacttgcacagagtgttggacatcggtgcagacagccttaatatgaacatcatgttaatgcaaccctgagagctgatcgaaggcagcatgactgtttgtactacaaatgaagacttgttgatccagtatatcatcattagggccagagatctcgataaaactgtgagcaaggagatgtttcatttgaacaggcagtacgaattcttcaggatgatgttgcactgtgacatcattaaaatacggttctttagtaaggaataaagaga

SEQ ID NO: 603920 - DNA, 455 bp, Homo sapiens
gtgaacgccaaaaatcctactttttaaatttaaaggagtaccttttccaaaagaattagtactgctaagtagattttatattaatctgcctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaacgcacagaaaacttttgctgtgcttcctttttctgtcctacctctgaaaataaactaagcaaaaaaa

SEQ ID NO: 603921 - DNA, 175 bp, Homo sapiens
cttacgaggatccccagtcaaccagctgcaggagagacaggcagctctgacgccactgtggttagtgtgtatgtgctgctatagaaatgtctgggggtctgcatggcgccccaattactctcagggactggttgcgtggcttctccaatgccggagcccgtcaggccatttttag

SEQ ID NO: 603922 - DNA, 619 bp, Homo sapiens
aaacagccgggaagaagcaccgtggctgctattatctgctctccgcgcctgacccctccctaggactcgtgatgccaaggccgctgcgagcggctacgtaggagtcggggttgagccccgagctgagccgcgggctgcgcactcttctggtctcccaggcccagacccaccttgaagaacatgagtggtggatttggctcctaagtaagagcacagtgtatgtatccaacttgcctttttcccgtgacaaacaagtgatcttgtacccggattatttttccaaggtatggcaaagcttgtacacacggttaccatcagtgacacgatacacggataccagggacagagtaaaggggttgcattgagtttaattctctcggactaaagacctctgcacaagaactgtaccagggcaataaacaacagaacagttattgggtaggagtgataagaagcaaggcattggctatttgccaactggacagagcacgctgagttcatccgaaggcgaaacttacttggtaaatctaagtgtcatgactgtggggaaagtggacacttaagttatgcctgttccgaaaaatatgctcggagaacgtgagcctccaagagaacgaca

SEQ ID NO: 603923 - DNA, 466 bp, Homo sapiens
  misc_feature (176)..(176): n is a, c, g, or t
  misc_feature (253)..(253): n is a, c, g, or t
  misc_feature (280)..(280): n is a, c, g, or t
  misc_feature (385)..(386): n is a, c, g, or t
aactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggnaggttcaggaagcgacaccgttgttatcaggggcccttcctcggatgtggagaaggccaagaagcagctcctgcatntggcggaggagaagcaaaccaagagtntcactgttgaatccgcgccaagccaggggggcaaaggttacccgaccaaccttttcctccagtgcggtgcaaggtgggggccggcgaacaatttctgggcaaggnntgcgctgacagcactggagcacgtgtcatcttccctgcggctgaggacaaggaccaggacctgatcaccatcatggaagg

SEQ ID NO: 603924 - DNA, 93 bp, Homo sapiens
  misc_feature (50)..(50): n is a, c, g, or t
actttttattttccctgttgcgttgctatagatgaagggtgaggacaatngtctatctgcactagctcttttctattaaagaaacttttccca

SEQ ID NO: 603925 - DNA, 961 bp, Homo sapiens
gtttgagaaggggtgcacaatcctggttaataagggtggttcttgcgccacatcttgatggtaaaagaaagttttggttcgaataaggcttgtaagaatgccgatgggtaatgccgtctgccaaggttaaagctgcatagaccttctcggggaatttctcagcacactgcagcttctttgcgccagcaaggcatccatgttacgcgcaaaatgcactggcagcagttcggagtgacagctcctcaggaccaggaatgatcctcaatgtgtatggaattatgtctcatcctgttctttacaagcatctattaccgtctcttgtggcgcatggctctatgcctcttaatcccagcattcttagggcggctgaagctgggctgtggtctacattgagcccaggagctttgagatccagcctggacaacatggctgataagccgtggtttcaaagaacatacattaaaattaggtgggcgtggatggtacgcacttatggttctagctacctcaggaggatgagatgggaggatcaattgagcgtgggtaaggatcgaggactgcagtgggacggagatgcactaccactgctaactgaagtgcaagcctgggcattcagagtaagatccctgctctcaaaaaacaatacataccaaatcaaaagcaatatatcactgtccattcatcactatgtttgtgctccgtagtagcaccacctacatgtgtctctcatactatcagatttcattgtaaaattttttgggttttctttttcctcttgatgcggggaaggatacataccaaactaaatagtggtgttctctgggtagtggggattgtgatggaaggcttcttgtttctactgtttattatttgaatgttttaactaatgagcatgtattattggattgcagtcaaaacaatttttaaagaaacatacaattgcccggtcatctcaattggg

SEQ ID NO: 603926 - DNA, 111 bp, Homo sapiens
acatatataccaagacagcacacattcttatctcatttgcgatctataaaaagtccataactgtaagcatggtgtcacttatcccgcatttgacacaacaaggtcatcagt

SEQ ID NO: 603927 - DNA, 1075 bp, Homo sapiens
cgtgacgcgtaggtcgagggacgcgtgggtcgatccacgtcggtccggtctcctaaagagacccgaacagctgaggaagctcttcattggagggttgagctttgacacaactgatgagagccgtgaggagccatatttgagcaatggggaacgctcacggactggtgtgggtacctgagagatccaaacaccaagcgctccatggggctttgggtttgtcacatatgccactgtgcgcaggaggtggatgcagctatgaatgcaaggccacacaaggtggactgcgaagagtctgtggaaccaaagagagctgatctccagagaagattctcaaagaccaggtgcccacttaactgtgacacacacagatattagtaggtggcattaaatggaagacactgaagaagcatcacctacgagattattcggaacagtatggaacaacacttgacagtgatctgacagtcatgactgaccgaggctagtggccaaggacacaagggcgcttgtgccttctgtaaccttaatgacgaccatgactccgtggctacgattgtcattcagcactattaccatactgtgaattggccacaaacttgttgacacgttcgaaaaggccctgtcatagccatgagatggctaagtgcttcatccagcaacagaggtcgaagtggcgttctggcaccctttggcgcggcgtccgcggacggtgggaacaggtgcgaattgcgcagctaggggacgtgagcggaaaccaccagaagcccgaggtggcatttggtgacacccgttctagctggatcgcataattgcaacatacatattgcataactgcactcgccaagtataggctccataagtatgccgtctgtgatacaacgcccggaagcagccgcccgtggacctgtggcacagtttaattaacaccaggacgcgcaatgtcgaatctgcgcactcgcaccccacccacagacagtagaacacactcatgctatctcaaccacagccatctaagcacccacacacatcgacacacccgctacaaatcatcacaaaagctaacattgtaacacaa

SEQ ID NO: 603928 - DNA, 469 bp, Homo sapiens
catatactatacactgacagcagcttcgaataggtttactatgtgtattacaagcatagtaaaaataaatgccctggtcctgaaagttcaattatttcaaaatgtatcaatacttactctctatgtatgtttaaagctggcctggtgtcactcccatatccctttgagtgtattaagccaaataagaatgtcaggcttccccaagcacactttggtctctaaccacaacccttaacagcatatccattatgtccttcaatatctttcagctctagtaaatccttgcctgctcaggtgaacattagtcttactttgaaagaatctgcagccctcataatgtggtcgttcctaaatgccatcacttcacaattaggattccctggttacaaaatgccaatcaaaacatcagtgggctttagtatctgatacaggctaggtttgtaataactccaggaggttttatatctac

SEQ ID NO: 603929 - DNA, 166 bp, Homo sapiens
catcatgttgaatgtgcgcgcgagcgactatcagagcatattgaatttgcgcagtgctaggaatagttctagaagtaccggttgtgaacgtaagccaggcatacgtatactccggaatataaatatgtgtaggatgcatttggcggccgtcggcagctggggccat

SEQ ID NO: 603930 - DNA, 1391 bp, Homo sapiens
tcctgggttgagcacagggtactttatggagggtccatgacaaggtggcggtccccctaggcccctccccttcttacaaggggttcctcacagtggaaacactgtggtgaaggaagggtgacaaatccaggtgtgtgggtgggggacagtggaggtggtggcagtggaatctcccccaagcaaggtgaagggttcctcttcttcttctccctcttgtggtgcctcatgggggggagcgtgggtgtgctcacaaggggggtctcttaatctctcctgtgtgtgaggagcacatgtgtgtgcgcgcacatgtgaggggctcaacacacaccctctgtgtgtgtgcggggtatacacacaaaatatctcgtgtgtgctcatataccccaggagacacatgtagagcgctttgtgacacacaaggtgttggtccctagtctgagagagttcgacacactgtgcgcaaggcccccacaggagtgtcaccaaaatagtggtgtgagaccgagactgttgtggtgtgtgtcaccgctagtgtgtagaagaaatgttccacagagagagagaagaccacacctctggggtgtggggctccacactgtgtgtgaacgcccccaatagaggtattttgcccgcctattgtgagaagaggggggcgcccccctcctccctgtagagaggcccctgtgagattctcaaacccacaacaccttcttgttgtgacagagtggctccaaactcaaactttattgtggggcgccaaagggagttttcatcccctaaaaacaggggggcagagggcttcatgagggtgtatcccaaaccccaaacgttgagaacaacgtggtttgttgcgccctactgtgcgggtgtgggcacccctcctgtagaaatgaggggcgctaatgagccgcaatgttgtagaaacgatcattcccccctggttgccacaagggctccctaggggagggtatatgcaacccttttgggccccacaaaataggccttttttggggggcatagacccgcccatgtaataacaaaggagcctacgggtgtaatcagtactacttcccttgctgggaaaaaacgacgccccccgcgatgagcaccaataacacaagaacgccgacaacaaaggtttattcccacgcgagagacgggagggcaccaccaacacacaacaagaactcgcacatcaggagggagcatgaggcacacagaatcaacagagagcagacagtagcgacaagcgtagtggtgggagtccaccacaatgaaatggctctccaccgtcaccgacagacgattcaaacacccgcccaagaagtgttgtgctaacgcatggagcactacaaacccgccgtgttgtgccgcaccggaggggcggaatt

SEQ ID NO: 603931 - DNA, 149 bp, Homo sapiens
atctggcgctcgataaaggcgtgggcgtgtggaaggaaggcagagcgtgcggtgggcgtcggccaaccgacgctgaaactggatacgctgaccgtcggcggcacggcgtaatctttcctcaaggagccacgcgctggctcctttatcca

SEQ ID NO: 603932 - DNA, 390 bp, Homo sapiens
tctgaaaatgtctacattagcttatgtctccagctactttgaatgtgcacattagtgtcccattcacatgtgcagcgcagctcaagactaagtgcaggtcatttgcccaaaggcatacaaaggtcggtagtagggctaaaatccagatctgcccagtatcaagaggtagtgcctctaaatgctgtgctagcctgccttcatcctccagctccatgcaggaaggagacaccccacggtcaccagtgggctcctccttacttcagatctggttagcaccaaggtcatgctctgtaagacgtgtatgttctgtgtaaaaaaccaacaactcacaatgttctcagcaaaaattcaggaatactggagtaaaatggactaagacagatactgtgt

SEQ ID NO: 603933 - DNA, 169 bp, Homo sapiens
tcgtccagcatcaagtatcagacttcttcaaatcagaatcttccaccactttctggacgggcttcatagtagaccggaacagatccaggttgagctcttcaaattgggcccgagtcagggtctcagaaaagtcttctcctccatagaaggactcaatttcaattcttcc

SEQ ID NO: 603934 - DNA, 483 bp, Homo sapiens
gtgttagaaataatatttttaattaactttttttaagcctctttgctttgtgttagtaactcttttttaaaccatatcttatgtagttgttagatataaggaaataagtaccttctgtgtccttgtacgttaaccaagatatttggtctcgacgtgctcaagcatgtcccagctcacagcttatgccctttccttatttggaaatgttattacttctccaagtcttttggcaagcaacttcctcttttcctttgttctccattgcctttacctatttaagaaagttttttaagttgttagccaattgggtttagcttagactgtgaggtccagctccaaccaatggagacaggacacagcagtaaggacccaatgcataagggataaatattcctgcctttctttgttcatggtgctctcctggcaggattgataatgggccgcaccctttccacagaaagtaaaataaccttgctgagaaaa

SEQ ID NO: 603935 - DNA, 545 bp, Homo sapiens
  misc_feature (58)..(59): n is a, c, g, or t
  misc_feature (117)..(117): n is a, c, g, or t
  misc_feature (151)..(152): n is a, c, g, or t
  misc_feature (264)..(264): n is a, c, g, or t
  misc_feature (281)..(281): n is a, c, g, or t
  misc_feature (359)..(359): n is a, c, g, or t
  misc_feature (395)..(395): n is a, c, g, or t
  misc_feature (426)..(427): n is a, c, g, or t
  misc_feature (486)..(486): n is a, c, g, or t
gagggcaaggtgtctggctgcgcgtttggctgcaatgagctcggcctcggggctccgnnggggcacccggcaggtggggaagaaaacatgacagaaacagatgccttctataaaagngaaatgtttgatccggcagaaaagtacaaaatgnnccacaggaggagaggaattgctttaatcttcaatcatgagaggttctttggcacttaacactgccagaaagcgggcacctgcgcagatagagacaatcttacccgcagtttncagatctaggatttgantgaatgcttaatgatctaaagcagaagaactactgctcaaaatcatgagtgtcactgttagccacgcagatgccgatngctttgtgtgtgtctcctgagccatggcgaagcaancacattatgctatgagcttcgaattcagacnnaactggctgttcaaggagacaagtgtcacagcctgttggcccagatattatcatcagcngtcggggaaccagcacgatgtgccatcatccttggatgtatagtatcgacgagttggac

SEQ ID NO: 603936 - DNA, 215 bp, Homo sapiens
  misc_feature (215)..(215): n is a, c, g, or t
gcctctctctctccttttttggaaacatggtctcactctgtcaccaaggctggagtacaatggttctatctcatctcactgcaacatctgaccttccgggagagttacgttaacccaggaggcaggacttgcggtgagcttagatcgccccacttcaacagatcgcgcttgggcaacagaaatgagagctcggtctcaaaaaatataaatataan

SEQ ID NO: 603937 - DNA, 214 bp, Homo sapiens
gacaagagcaccaggagccttgcactgacttactgtactgtaggtagagatgtgacatatgaataatacaaaatacccgtcatggttagacttgcagattaagtcactgctagactacagccttaatgccctctcttgcagaccctagccaacataaccagtcttccaggaacaataccatgttttaaattgcttgaggtttcactacctgctg

SEQ ID NO: 603938 - DNA, 1618 bp, Homo sapiens
  misc_feature (250)..(250): n is a, c, g, or t
  misc_feature (1171)..(1171): n is a, c, g, or t
  misc_feature (1556)..(1556): n is a, c, g, or t
  misc_feature (1616)..(1618): n is a, c, g, or t
taataaaaaaaatggtatttacttaaaagcattcaaaatggtcaacaaaacagctggcaacttttgtttttttttgggcgaattacaggagtgggttattcaggttaacaagaacaacaatttattccggtataacctggtatcaagagacaatctggaaagatggaaaaaattaccatctccccattattttaatctaaattgtggtgcgctgtgtggcaccacaaacaagagaaccctggtttataanattttccacttgcgcccaattttaaaaaccccccacattatgtggtgcccagggcaagggtaagagtggcgctatgtggaaatattccccaccaaggagacgagggggctatatctctataagagagcacacatttctcgggatagtgtggtgtgtgtcaccttattacccaaaaaagagagaccttgtggtgccccgtgttatacaaacaccaaattttttttacacgagcggcttataactttttcacaatttattttgttacgtatataacaaagggggatgcgagacgtttgggtgtggtccccacgggggcgggtgtaaaaacagtgggccgttatatttaagcgagccaccagagacatacacacaaaaacagacctgtgggcgcgtcgtaaagcacaccccaacatgttttattctcccctcacatctcattacaactcacttcactgctcctaacaaacttctcgacaactacttcatctttcaaaagctattatagtccctactagtcagatacactatgcagctaattaaaataccccctctgtgtacaaaattactgccacccaatacaaatatataggcaccgagccacatgattgagcaccgatactatatgtaaccgccagggcgcgacatattaataaccagcgctcttttgagaacaaaacgcccccccccttatattatggagggagcgaggaaaacaagagccggtattaccactttaaagagccgccgaaataatggtgcactgacgacaaaatacaccccctgttagtggaaaataatttgatcccctgtaaagaggaagtgattcgcacagcccctctaatttctcaccaaaaaggagggggacgaggatagaacaattcgagcagaaccagaggtgtattattccccccaacagcttcnctgcccccgagatgtttgtttctgcagacacatattcccacagaggtgacgaggcggcagaaaggtagtgctcgcccatgatgatatatggggaagcaaaacataccagaccaacacaaagaaaataagcgcgagaacaggagcccctttggtgggagaggaggcatgcatcacaactcttaagttcgcaggcactaagggaggagaaagcaaggtcagtacttcatcaaacaaggcagcgcggcgggcgcgacgagcaaaattcaatcattatcatatacagcatagaaggcttggttcacgcatcaaaacatcatgaaagcagggtgtgcaatatacgctgagcagaagaaaaataatgcatcgatcacgtgaattacatgcncgcgagacagaagtgagtctgatggtcactctatgtacgtcaagcattcattcgtgcggnnn

SEQ ID NO: 603939 - DNA, 181 bp, Homo sapiens
acggtgaattgaagcgtgtcccagaacgcaagtgtgagctcatctgcggcacttatggagtcagtactgctggtcctctatgacaaggaggcaagagactcctactactactgggggctgaaaaataccagagctggcgagtgtgcatcatatcaaatgaggcctgtacgggggtctcagc

SEQ ID NO: 603940 - DNA, 188 bp, Homo sapiens
accaacattcaacagcacacgcaacacagcacacacatataacacagcacacagcacacacagtcacacacagcacacacgcatgcacagaacacagtaacacagcacacacacaaacacacaacacaacaacccccagcaggcgtaaccgcatccgcttactgatgtccgcttactgatgctccgct

SEQ ID NO: 603941 - DNA, 387 bp, Homo sapiens
  misc_feature (37)..(37): n is a, c, g, or t
  misc_feature (45)..(45): n is a, c, g, or t
  misc_feature (47)..(47): n is a, c, g, or t
  misc_feature (49)..(50): n is a, c, g, or t
  misc_feature (52)..(53): n is a, c, g, or t
  misc_feature (55)..(56): n is a, c, g, or t
  misc_feature (115)..(116): n is a, c, g, or t
  misc_feature (119)..(119): n is a, c, g, or t
  misc_feature (127)..(127): n is a, c, g, or t
  misc_feature (133)..(133): n is a, c, g, or t
  misc_feature (136)..(136): n is a, c, g, or t
  misc_feature (216)..(216): n is a, c, g, or t
  misc_feature (270)..(270): n is a, c, g, or t
  misc_feature (295)..(295): n is a, c, g, or t
  misc_feature (324)..(324): n is a, c, g, or t
  misc_feature (326)..(326): n is a, c, g, or t
  misc_feature (338)..(339): n is a, c, g, or t
ccaacctcaatgccgtgccattaaatccgaaaacagncaagaaangncnnannanngacctcgagactagtggggtatgtgcagggaatcatctcacatgctgttttctcctatnnggnttgagaancagggntgncactattctctttgattagaaaataaactcataaaactcataatgttgatataatcaagatgtaaccactataaatatgnagaagaggaagttttaaaagaccttaagctggcattgtgaaggaacaccatggnagactcttttgtaaatgtatttgtntttaatgaatgcagtataagggtggggangngtaatataattnngtaacaaatcctgttaatagggagatgtacagaatcgttttgtacttt

SEQ ID NO: 603942 - DNA, 207 bp, Homo sapiens
aaggaatccactatgcggcgtgctagctggatgtcttttggcataattgttacacgtttggcaagtaaggcctatctggttggcctttttgaggacaccaacctgtgtgctatccatgcaaacgtgtaaattatccaaagcaatccagctagcacgccgaaacgtggagagcgtgcttaaggattccacttttgatgggaaacattt

SEQ ID NO: 603943 - DNA, 212 bp, Homo sapiens
cccccccccccttttttttccccccaaaaaaaacccggggggggttcccccccccggttttttttttgggccgggggggggaaaccatttttccccgggaaaaactttttccctttgggcctttttgggggcccctttaaaacaatttttttaaaaaaaaagggggggggcgggccgggatttcccgggattttttccccccccgggcccca

SEQ ID NO: 603944 - DNA, 217 bp, Homo sapiens
agatcccctttccactcgagacacacggcatgattcggggcatggcagatggcagcttctaggctcagtcacaggcttccgtttgccatcgaggcacagcagcgccaagtctggcagcttcaaatccttagcccatgcctcattgttatttccatcagtgttctgcaagacagtgacatctttcacaaaatgcaacggtctcccagcattcctcagc

SEQ ID NO: 603945 - DNA, 903 bp, Homo sapiens
  misc_feature (63)..(63): n is a, c, g, or t
tgaaatcatgtgatttgcctgggaaaacttgttagatatagagctacttagtgccttctgagnccttgatattaacttggtatgtaatagtgcattaaatatatatatagttcatcttaacatggggaaatgcccaacattgagctcatataagtccttgaaacgaagcgtacatattcatttctaaatctatacagtgaactggcacaagatattttaaagagggaactttagagtatcccattgtattgttttccataagcctggactgtataaagaagtgggttgttcgaagggttattattgagcatgtgggggaaaaaaaaagcttagtttgctaatgtatctaaacttcagcagagcttttggtgatctcctacctgcagcctcaatgttgacaaagaagcaagactatagattcatgtctgaaggggatcatgtatggaatttttggatgaagttttgacctttagctctctactcttgattactattatgaatactcttttaaaagagtgatttttaaggcttaatatatgtttttccaggctgatgttcacatctttttttgcatgaaactatcagaatatagtgaacacttttcaaatattaaaggacttaaatgtgtacaaaggcatagaatagagagtggtaatactacccaaataaattacttcaaaactgaaagctaagtaatcatagttatattaagagatgttcctgaggagaatgtgcttccagtgagaccaggtaaagttacataaatggtctttcccgtaatgaacacaacgtggcctgttttacatgtccaaaacaggggcctcttacacacagtcgtactgcacggtcggtaagtcaccgagatcccccaacgttacacccacttccgttcacgccactgtg

SEQ ID NO: 603946 - DNA, 380 bp, Homo sapiens
tcgcaccaggtggagactgtctcaaaacaaaaacaaaagacaaaacaaaacaaacgatactaaatactcattgttttctcacttcccacgtgcgatgaagatattcgcattgttgctaggtgtggaaattgaggcttgactgatgttgtaagtgatctaagatgcacgagaacgacaagcagtacagctaggattcaaagcctcggtgggtttcattgcagtgcctgtgttatttctattacaccattgctgcctttgtccaccatgcctcacagccagagtaagaaagtttgaacacacaccagtgttaggtgctaaaagaaaatgagtttgttgattaagatgctgatttagagtaggtagtggaggagactggagag

SEQ ID NO: 603947 - DNA, 457 bp, Homo sapiens
aaaacctcccaatattttgtcatcaaaaggtggttaagcaggcgtcggagggcccctcaagggcatcttgggtacactgagcacaaggtggtttcctttgatttcaaagcgacacccacttctccccctttgacgctggggctggcattgccctcaacgaccactttgtcaagctcattttctggtatgacaacgaatttggctacagcaacagggtggtggacctcatggcccacatggcctccaaggagtaaaacccctggacccccagccccagcaagagcccaaaaggaaaaaaaagaccctccctgctggggagtccctgccccactcagtccccccccccactgaatttcccctcctcccagtttccatgtaaacccctttaaaaggggaggggcctagggaaccgcccccttttccatgtaccatccaataaaagtacccctgtgttcca

SEQ ID NO: 603948 - DNA, 1021 bp, Homo sapiens
ggcatcacggctgttgccatggctcagcgcggtgaggagggagccgtgtgacgtcggcatcacagctgactcagagtgctagcacgcgggcgccacagggccaaggagtactggcgtccatggactccgtggggacccctgtcaggagctggtgacatctcgttccccgttccacgcctgctccctgcgtcgtacatccgccagtcgaggcagtgtccgtcgtcgccttcttccattgtgacttccacagagagggatgcctgcccttcctttgcctagaagaagcggctcaagtcgcttcaaaatgccgcaggaaaggcgcgtcatcgctggagcgctcttgaggctcgtgagcaacgtggtggtagcgattgagagcctcgcgaggtctaccgagcctcgggcgaactagagacgtggttgtcaattgccctacgaaaagagcacagggagctagtgtccatccatgagcgtctccacagaaagcaccgcgaaccgatagaggcacgttcgtagaacagggtgccgtaggtcacctacagggaaacaagtaaccgtcatggtaggcttctagaacggaaccagggcgacatcgctcgtcagactcattcgtcaacagaagcctctgcgggaaaggagaatttgagacgcgaacacgcgttaggcaaaatgccatcactcatatagcgtttttcgcatatgcgcgaaatagttcccgagccggaattggtaaccggagctcccagttggttccccaaatccgaaaggcgtatacaatagtgggccctctaagcttgggcaatccgtaatccagtatggaagctagctttggccatggaacaacatggcactccttaagcacctagttcgtacgaaatggagttcgaaaaggcgtacccgcccaagggagaacgcgtaacacttttcggcaaacaaaaatgcgcgtggagacgctcggcgccatcctaaggactgtggcagggattggatccccaaacccgtacacattaaaggcccacaa

SEQ ID NO: 603949 - DNA, 773 bp, Homo sapiens
  misc_feature (429)..(429): n is a, c, g, or t
  misc_feature (538)..(538): n is a, c, g, or t
  misc_feature (600)..(600): n is a, c, g, or t
  misc_feature (610)..(610): n is a, c, g, or t
  misc_feature (618)..(618): n is a, c, g, or t
  misc_feature (623)..(623): n is a, c, g, or t
  misc_feature (702)..(702): n is a, c, g, or t
gagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacaagcctcccactggttatactactccaacgtgccccccaggcatacagccagcctgttccaggggtatggcacttggtgcttatgataccaccactgctacagtcaccaccacccaggcctcctatgcagctcagtctgcatatggcactcagacctgctnatcacagcctatgggcagcagccagcaggcactgacacctacaagaccgcaggatggaaacaagcccactgagactagtcaacctcaatctagcacagggggtgtacanaccagcccagcctaggatatggacagagtaactacagttatccccaggtacctgggagctancccatgcagncagatcanctganctccatcctaacctcctaccagctattcctctacacagccgactagttatgatcagagcagttactctcagcagaacanctatggccagcgaacagctatggcagcagagtagctatggtgaaaggcagtatggcagagctcccgtagta

SEQ ID NO: 603950 - DNA, 752 bp, Homo sapiens
  misc_feature (579)..(579): n is a, c, g, or t
gagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacaagcctcccactggttatactactccaacgtgccccccaggcatacagccagcctgttccaggggtatggcacttggtgcttatgataccaccacatgcgtacgatgtcagcacagctcacgcctaggtcgctcactagtgcgagcctcacgtcttgcgattagtggcgacttcaagccctgtcgttaatcctagcactaatggcgcaagtccagaccgaggacagctcacctggcaaccctaacaaggacccgcagggagtggacatagcaagcccgacgtgatgacctagctcaaaccttctaatcgtnaggacagggtgggtttacaaaccaagcccaagcctagggactagtggacacgacgtaatctatccagttagtcgcccaaggtagcctgtggaagcatacccccagtgcaagccagatcgagctgctaccttccagtcgctaacccatctcgtagccaggctattccctcttac

SEQ ID NO: 603951 - DNA, 825 bp, Homo sapiens
gtcaacaagctctctcgcccgccgcgcttttggtttttttttttgggtgtgtctctagagaggctgggcgacacaattttgttcgtctgttgtgttgtttctcctcacagctgatgagatagttttggttggtggacgactcttttctcttctgtggaggcgcccccacagatagttttttgtgtgtgagattcgtctctccgcgcggagtctcgcttattcttttggtcctcatgaagacccgcgcgcacatatattttttttgtagagagaagtaaatatatagaagagaactgtgtggccccaaaaccgttttttttataataaatcgcctctctctccctctcctcccctcccacacaaacacaccccgcacagcggtgatgtatgtgttacacaactcagagtagtctctctctcttttctctcatcacacaacacacgctgctgctgtggtgtgagaagttataattctctctgtggtgttttctctctctttttgttttggagaaagaaaatatgtagggagatgtgttttgtgggggtgtatttatgaggagaggtgtttaacaaaagctcgaacaacgacgcaatttgggggggtggcgcacctgtaggatgatttttaagaagagtttatgggcgcacgagaatatggtttggatataatatttagtaaagtggttcttctcccccctcttctcacccacggagcgaggaaaaaactatagaggggggttcccacgaggtttttccgggtttttccccccccctttttttggaaaaaactgtgtttagggggaaggtaaacatttttttttgtta

SEQ ID NO: 603952 - DNA, 119 bp, Homo sapiens
tacctcggaccgttgacgtggctggcacatgtgtgtatatggattgtggaagtgagtgcatatgtacctgtgtatgtacatgtatgtgcggagtgcgcacgttgatgcggtgtggtaga

SEQ ID NO: 603953 - DNA, 219 bp, Homo sapiens
tcatatcttattctccgagctcaagaaatcactgcttgcttctttagcatggtcaggtaccatcttgatcttgtcctctaaatccccaggagaagagttgtttagcgactcctggatgcccatgagggagcggctccagagcttgccttccctcctctgttttcacaatggtccagcgataggcacggttctctgacaatccttcttggcactgtatat

SEQ ID NO: 603954 - DNA, 713 bp, Homo sapiens
  misc_feature (659)..(659): n is a, c, g, or t
gccccactgacagcaagggcagaccacagcaagccccaaccctgagaagcagagagggaccgcacgcgcagcgggagccagcgagggacagacaagaacagcgaatacctataacggtggggggacagcgccccgccgagcgcgtcagcgacagaaccccccccgggaggagacaggcgccaacgcccagacgggacagcagggagaagaaagggaaccacagcccgaagcccagccggagcagggacgcacgcagggccgggaaggagggcggcggggggcccctgaaaccacggaggagccgcccgggccgcggaggaagggcgggcgacggaaggagcgcgggggggacccacaagccggacggcgaggcggccggcccggccaaggagccccgaaccacgcaacccacggaggaaccgagcgcagggggagccccacgagggaccgggcacgggaggcacgcccgccggccgctcaacggcggaagccgcgccgaggcgcccgcggggggagcaggggcggaggacgccgcgaaggaccacagagaaggacgggagggggaccacgggaccacccgataccgcccgcccccccccgcaaagcaggggagagcggcaggagacagcggcgagcccacctcgcaggggcggcgaganggaaagggggcacgccagccacacccccccaccacccccccctcccacccaccc

SEQ ID NO: 603955 - DNA, 159 bp, Homo sapiens
ttgctccgcccttttttgctgtacgcccgtctttgtctcccaaagtgctgtgcttaacgtcatgagcgagtgcgcctaggctgccagggttacttcaagaggagatattgcctcttgacagtcgcgccctttctggtgcagccagagacacatgcagaa

SEQ ID NO: 603956 - DNA, 244 bp, Homo sapiens
aacgggtgatgcggttgctactcgtgagcgagctgcgcgaagtgtagtaatcgccgacagggctcgtgtacacgtcctcctccatcgagcccgatttgtgccgcttgctcccactgaaggaggtgctgggcagcgttcttctgaggccagcgctcgctgagttcaggtcgcatgccacgtgcccctgcagctcccccagggagaagctgagtcctgttccagccaccacggatgcacgtaacac

SEQ ID NO: 603957 - DNA, 416 bp, Homo sapiens
tgatagaactcgagcgtcggtacccctcgtataaggcctaagagtaccgctaagattcatccaagtgttttcactgggtcgtgagccgccgctccatgttcccatctctcagctgctccctcggccctgtgtgagatctgttctccctaagagggggctcagatggtgcggcctgagtgtgcggccggcggcatatgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttactctcgataagggccaaaaatcaagtggggcgatgctggcgctgagtacgtcgtg

SEQ ID NO: 603958 - DNA, 231 bp, Homo sapiens
tgtatagtaccgcttactacttcctacagctaagttctatctattcctgctgtaattgtaatgtgtttgaaatttaaatcatgtaggtatttattttaccttgagattagatgacatcatagtaggctgagtataggttgactctgtacaattcaaaagagtgaacgcatggttaatatccttttctcacactaatggtgggacttggcgttggtcccgggtaacaccaca

SEQ ID NO: 603959 - DNA, 258 bp, Homo sapiens
ctcctacttatttctgggttaattttggtggctagaaaaaatttcgtgggaaagactaatgcacaacatatttttaccacatcaactaccggtcccatcatgatgcaggatgttgcaggaatcactgatgtgcaccttgtacaggttgatgtaatgcttacttcttggtttgcaggtcaaaaacaagctagaagtgaggagtggtatcaatatacattttaaggccgagtgcaatgactcacgcctgtaatctcaaca

SEQ ID NO: 603960 - DNA, 420 bp, Homo sapiens
agagtcatcaaagggccaacgaaaaggtaaaaaagaaaccaaaacaaaccaaaacaaaaaaagaaaataagaaaacaaaatagataacatagttcatagtctgaagaagatcaaatctgatcatccttaatttagtgtaagaggtgtttgaaattgttgggtaatttaattacagcacgccagaaacgtagggcactccagtgggcttgatccacctgtcgccaccgatgaatgttccggcagtgaacttctgggcgtgatccatagtgatctgcttgatgccgcgccatttcactctctgggcctggtcggcgccgacacccttgttggcaatctcggcgtagaagcaagtgttgagagcgaagtcacccatccacggcatccacccctcggcctggatgaagtcgccgatgtcgacgc

SEQ ID NO: 603961 - DNA, 277 bp, Homo sapiens
ctatacgacggtgtgcttatctcttcataattttgggtcttctttctggagaggagtctccctctgtagcccaggctggagtgcagtggcatgatctcggttcaccgcaacctccgcttctctggttcaagtgattctcctgcctcagcctcctaagtggctgggactacaggcacgcgccaccacccctggatagtttttgtatttttagtagagacggggtttcactgtgatggctaggatggtctcaatctcctgacatcgtcatccgtccact

SEQ ID NO: 603962 - DNA, 1986 bp, Homo sapiens
gggtgacaagctgctgcggcatttgtccccgcgacagcaccgctgccgccgtctctaagtgtctgccctgggtcccacctgcctgccaccatgcctcggggaatgcctgcatgctgctggcctccctggccatgccatgcctgcccatgcctgctgcccatctgcccacacctgaacctaagcaccacatctgacctacagtgaagaatgaacaagaacaacagatcaccagatacagagagagaaagacctgacagagcatcacttgggactcaagaattgtgcagacaacaacacgtacactagccatagaggagtaccacccagttagtcaccctcagacgatgaagccaggaccacccgaacaactaggagcaagactgacgacatgacaccagtcaagaccaaatacaagccaagggaggagagacgacaccaggagacgccccgacacacacaggcaccatcgcctaggaccccagcgaaagaggaaacagcagaaagagaagaacccgcagacgaacacgcgcgaagcacacacagcagaagaaacaaagaggaagcaaagacagcagagagacagaagaagacagagaaaaacgacaggagaagaaaccaccagagaagcagcagtgagaaacgagaagcacgacgacgacagaagacgacaacagaagacgcgacgcaggacagcagggcaggcaccacgcagagcacgagacacacaagccagccgaacgacgaagagcagacacgacaacaagcagccaaagaacgagagacagcgccaagcagcgcccgagaagccaagacagaaagagcagagagaaacagaagaggacaccgaacatagcaacgaccagaaccgacaggaccaagcagaacagacgagacacgacaagcagaggagagacgcacagcccggacggagcaaaggcgacaagaacacaagcgacgcaggagagagccgggcacgagaagacaggaagcaacaaagcgaggaagcagcagagagaggcgacacgcaggaggcaggagaaagagcaagaggagagagacgaggaagcacgcaggagaagaagagcgacagaagtagagaagagagagaaagcgaacaagaagacgaacgaacacgcaagacgagaaggagccgcgaggagggcaagcaaggagacgacaggaacgaagggagaggcagagcagagcacaaccagaagagacaacgaagaaggagaacaagcgcagcaaccggcagccagaagagcaggagcaaagaaacgaccgcagaacgacagcagagcacagcgcgcagagacagcgacgagcacagatagagacgcgagcgagagcacgacagcagcgagcacggcacagcagagcgacagggcgcgagcgagctggtagtaggacgcacagacgagacagacgcaacagcaacagacacagagaacacagaggcagcaggagcagcacaagaacgaccacgagcaagaagaacacaggacgagagagagacagagggagtagcacaaccaggacaccagcaacagagaccacacatcagcaacacacctcagcaccgagaagagcagacaagcgcagaaacgcagaagcaaagagacagaaaggcaagagcagtcacgaaagtagagagagaacagatacacagagagacggagcagcagagaacagaacaagagagacagaaaagtaagagaaagatagctagatgaagaagagcgagagcagagccagaacccagctagtaaggcacgtatcaaagctaagacatcgggcagcgcgcgtaagagtagtgcgagagcagcagagagccagaacagacggtagcagcacagccgagagactacaggacaggagcagcgaccgttagtacaccagaccacgacgagagctagcatcagtgctaggagcctgcgtgtagctagaaagaaagcgagagagaaagtacagaacagagacgagtag

SEQ ID NO: 603963 - DNA, 626 bp, Homo sapiens
gcttttaagccacgtaggaacttctggggggggataggtggaccctgacatcctgtggccttgcccaagggctctgctggtctttctgagtcacagctgcgaggtgatgggggctggggcccccaggccgtcagccctcccacgagggacagcttgagcccccttgccttggctgggagggttcggtagaagcagccgaagggctcctgacagtggccatgggacccctgggtcccccaggcctgcagatgtttctatgaggggcaagagctcctggtacatccatgttgtgggctctgctcccaaacccccttggtggccacgcccccaagaagccccctgtggggggggtggtcatcctattgccctgcgcaacccccttgggcattctgggcctttccttgttgcgcgccctcccagcacaaaattcacgccccaggaaagggccccccgtgggccccttgggcttactcgttttctttattaaagagcaaccttcaaggccaggcaactttgcaaggttcttccccaattcttcccttgcgttagggggcttaaaggcaatacaaccccggctgtttccccaccggttggttggtctcggatcgaataggggtttggggcaa

SEQ ID NO: 603964 - DNA, 988 bp, Homo sapiens
  misc_feature (15)..(15): n is a, c, g, or t
  misc_feature (76)..(76): n is a, c, g, or t
  misc_feature (128)..(128): n is a, c, g, or t
  misc_feature (143)..(143): n is a, c, g, or t
  misc_feature (145)..(146): n is a, c, g, or t
  misc_feature (148)..(148): n is a, c, g, or t
  misc_feature (150)..(151): n is a, c, g, or t
  misc_feature (252)..(252): n is a, c, g, or t
  misc_feature (327)..(327): n is a, c, g, or t
  misc_feature (380)..(380): n is a, c, g, or t
  misc_feature (388)..(388): n is a, c, g, or t
  misc_feature (392)..(392): n is a, c, g, or t
  misc_feature (397)..(397): n is a, c, g, or t
  misc_feature (409)..(409): n is a, c, g, or t
  misc_feature (412)..(412): n is a, c, g, or t
  misc_feature (417)..(417): n is a, c, g, or t
  misc_feature (495)..(495): n is a, c, g, or t
  misc_feature (512)..(512): n is a, c, g, or t
  misc_feature (531)..(531): n is a, c, g, or t
  misc_feature (559)..(559): n is a, c, g, or t
  misc_feature (570)..(570): n is a, c, g, or t
  misc_feature (602)..(602): n is a, c, g, or t
  misc_feature (625)..(625): n is a, c, g, or t
  misc_feature (651)..(651): n is a, c, g, or t
  misc_feature (670)..(670): n is a, c, g, or t
  misc_feature (674)..(674): n is a, c, g, or t
  misc_feature (781)..(781): n is a, c, g, or t
  misc_feature (822)..(822): n is a, c, g, or t
  misc_feature (825)..(825): n is a, c, g, or t
  misc_feature (827)..(827): n is a, c, g, or t
  misc_feature (860)..(860): n is a, c, g, or t
  misc_feature (863)..(863): n is a, c, g, or t
  misc_feature (880)..(880): n is a, c, g, or t
  misc_feature (951)..(951): n is a, c, g, or t
tggggagcagagcgnggatcggggtttgctccgggggccggcgggcgattggggccaggcggggaaaaggggggangggggccgccctccgggggggtcggggccgccgccgccgtcgtcgcggcggngactgaggccgagangnngngnngggggcgggggagctgccgccgccgccccccagaggcgccggagcccggaatcccgctcggagccagccagccgtcccgagctaccagcaggttttcattngataacagatcctgcaaaagttccaggtgcccacactggaaacttggagatcctgcttcccagaccacagctgtngcggaactctggggtggagcagagaagttttcttgtatttcatgctggcccanggcacganggangaatnggggttctccancangcctngaaagaattgaacgacactgacatgaataaaaagactcagattgtcatattgatggagttggactggaaagaaaaganggccccttggggccccnggggaagaacttgaagatncgagaggggccggggccttccccttggnagggggttcangcacgttccaagcagttgataggcaaaagctngaagaagttccaaggcatgacangccaatgaatggcccgatttagaggnaagccttccacccccaaanggtncaacaaagcaggggtcgggagttgaggagatactcacgagagttgaaagttgaggagaccaattgcaccaaaaaaagaccgaaaacttgagcaggaactccctcggnccacagtctccctccagatctggatagcttggacgggcggnctntnaatgatgatggcagcagcgaccctagggatatngancaggacaaccgaagcangtcccccagtatctacagccctggaagtgtggagaatgactctgactcatcttctgggcctgtcccagggnccagcccgcccctaccacccacctccactcttttctc

SEQ ID NO: 603965 - DNA, 400 bp, Homo sapiens
  misc_feature (294)..(294): n is a, c, g, or t
  misc_feature (311)..(311): n is a, c, g, or t
  misc_feature (317)..(317): n is a, c, g, or t
accttgagctcctggtctcaagtgatcctctagagtagccagaaccacaggcgtgagccacagcgcctggccaggaagcttacagattattaatgaaactttgttaagaaccctttaccttactgacaaccagaaaagtaatttcactggtttgggaataaatggacacttaagaaatgaagcaacctcttcaagtaattttttttcaaagaccaaactattgaattagtgctttttgaagagcataaaagagcagtcatcaagtgtgacattaaaaactttcagctgggtgcngttgcacatgcctgtantcccancactgggaggttgagacgggaggattgcttgagcccaggagtttgagaccagcctgggagacatagtgagaacctgtctctac

SEQ ID NO: 603966 - DNA, 343 bp, Homo sapiens
gggattccgtcccaaaaaaaaccccccctcggccgtgtgcaggaagccccatgttgttttgccgagatcagccctgggaggatccccttttccagctcagatcatcccgtgtggccaaaaggctgcggaccccactgacctgcttctcgaggtggttgatgttttaaacaggaagctccccggagttcagccctgggggcatttcctcatgtatgtaaacccccagactgaatgtgaaaggtgttggccccgggccttaagtttgagcagatccctttggaatgttcggggtgtcctgtttggatttggtgccctaaaaacccggaataaaggtccgtgccca

SEQ ID NO: 603967 - DNA, 233 bp, Homo sapiens
aaggaagacactatttctcaaacgtgtttcaaaaatgatggctgggctgggcacggtggctcacacctgtaatcccagcacttggggaggctgaggtgggcggatcacctgaggtcaggagttcaagaccaacctgaccaacatggtgaaactccgtctctactgaaaatgcaaaaattagcagggatggtggcatgtgcctgtaatcccagctactcgggaggctgaggcag

SEQ ID NO: 603968 - DNA, 122 bp, Homo sapiens
tggagggtgtgagatctaaaacaagagggattcctttataggaacgaggtctagaaccagaggaagttagtgacttctagaaccaaaagaatctggtagtcttatgcacttatagagccagc

SEQ ID NO: 603969 - DNA, 124 bp, Homo sapiens
gccggtccgacagcatgaatgagataagaaacaccatctatggtttaaaagataacagaatgaaaataagaaaccacccatctataggtttaaaagataacagaatgaaaataaagaaaccacc

SEQ ID NO: 603970 - DNA, 209 bp, Homo sapiens
tccatccatacaacgttatcttacttattgcattttgcacattcatggcaaatgaatcgatgagctgaaaaaatggaagaagggaactcgagatgttggtatgcagaccttgattatcagactacagcatctgaattatcatgctagatctttaaatatgctaatcagtcctgattactttgtactactaacacatcaatccagaccag

SEQ ID NO: 603971 - DNA, 354 bp, Homo sapiens
  misc_feature (95)..(95): n is a, c, g, or t
  misc_feature (97)..(97): n is a, c, g, or t
  misc_feature (127)..(127): n is a, c, g, or t
tgaaaaaaaaagcccccccccttggtggtttttttttgaaaacactttcccctggagtggggggtgaaccccttaaaaaattggggggcccccangntcccaaattggggaaaaatggagggccccnaatttggttggggggaaaatttttttaacaagccccccttgggagacagtaaaaaaaaaaggtaacccggggggtattttccccaaacccgggggggaattccctgggtccccaaaccagggaaagaatgtgggggttcccttcccctttttaaaaaggggtcccaaaaaaccccttaaagttttttgattggaccctttccttcaaaaaaaaaaattggggcccca

SEQ ID NO: 603972 - DNA, 538 bp, Homo sapiens
tgtcacaaaggagacgcgatcacgcatgattgcaaacatgcgtcgatatgcatgaatgttgagtatgcgcccaagtccggtattcactctagtgcattacaagtgtgcggtaaaaggggcgtagagggcttctgtcatgagtggcacacataggacaactcacatttctcttcatgcagaataaacatcaagagatttaggaagcgtaatatagggtagttggacagctggtgatcactggtgccagaacccttactccttgtctaaatcagaggttgcagctctggtcatgttatattagatgattccgcactctaaacctccgtagtagatcctgccccacctcagggctatgtggtaggatatatgctgtttccacattatgcgactgcttgctatcttactggtttaaatggttgtaggtgaccataacacaatggcaagcatcctgtgtatacaagtacagaaaagatacagtaaaaatcactataacagaccaaaagtggggcgaggtgcacgggatcacacctgttattcc

SEQ ID NO: 603973 - DNA, 339 bp, Homo sapiens
ctgccaatgatatatatttaggctttattcaagagttactgacaggcctgactttaaaattaggctttttaaattaaaggccaaaactaaaaaagtttgcaaatatgacattactaaaagaatgattgccttaataatttaaactctaaaatgtccgccctgtggagttaaggtttttatacacagaatgtgtatgatccatgtcttttaaactaaacatctgaaaaacctcggatggtgggtaaatctgccaatgaaaatgaacatcagtttcagccttctaaagtatgaaaaccggccattaattaatcctgagacagaatataatctgcccttgag

SEQ ID NO: 603974 - DNA, 162 bp, Homo sapiens
tggaaagggagttccactctggtaccccagcctggagggcaagggcgcaatctgggttaaccacaaccttggcctgcggggttaaggcgattctccggcctaagcctccaaggaagctggcgcaccaccaccccaagctaattttggaccattttaagaaaa

SEQ ID NO: 603975 - DNA, 168 bp, Homo sapiens
  misc_feature (46)..(46): n is a, c, g, or t
  misc_feature (73)..(73): n is a, c, g, or t
cccgcagctgaagcacatcccgcagcccggcgcgatctccgatcgncgcagttgccctctggcgccatgtcgnagaacggagcgcccgggatgcaggaggagagcctgcagggtcctgggtagaactgcacttcagcaataatgggaacgggggcagcgtttccagcc

SEQ ID NO: 603976 - DNA, 321 bp, Homo sapiens
aaaacactctatctatccattcaagatgtgaaagtactatcaaatgataacagcagagactatttcaggcagttgccaattctgagacagaaaggggactgtgaggcaagaaaataaagcacaaattctttttttattctgttgcccaggctggagtgcagtggcatgatctcgcaatctctgcctcccgggttcaagcgattctcccacctcagcctcttgagtagctggggctacaggaatgttccaccacgcttggctaattttggtattttgggtagagacaaggtttcaccatgttggccagtttggtctcgtacg

SEQ ID NO: 603977 - DNA, 426 bp, Homo sapiens
tactcaaactatagctctgtgatactatttgggctaggcaattgtcatgacgaaagtactatcacgattatacattggctagggtagaagcatatcacttgtcttaatgatgctatatgttttaatctagttgattcataacttcttcttgtctgtgtagactctgacagttacagtggagatacattatatcatagttgcttgtaaggtcattaggatctcttcagacctggggtacacatattagaaatacacagaggagctttttaaaaagtaccagtgcttagtccccaatctggattgtttgggctatacctccttcagtatttttgtggttcgataattatcttttaagttgagaataaacaggtaaatttagaggggggatagctttttcattgttctagtttccaaatatttactttt

SEQ ID NO: 603978 - DNA, 261 bp, Homo sapiens
ttgcctcccaggtttgtcacctgtcttgtccctgcgaacttgccgaatggtgctatgactacggtggccttctcacaagacgtcccggtcctcggacgctcgtgtagaccagctccccgcccttggcatccttatccgtgagtggcagaaggcacaggcccgtatcggggtcctccacgcagcgctccagtagctgcaggtacgcttaggttcccgtgcgtgttggggtcaaagaatcccttggtgtcgtcgctcggcggt

SEQ ID NO: 603979 - DNA, 246 bp, Homo sapiens
tatgaacgatctatatactctaaaaataagactagctaaaacttcttaagtgtagacagccttcaccaatggaggctgcaaatgcttggtcagacgaagtaactctagagccagacaccacagagctaaggctgctagattaaaccactaccacatagctgctaactactctctatattcacacagcgttaatcaaaacaagttcaataccatcttttcacatgtgcctcggtgcaataggaataa

SEQ ID NO: 603980 - DNA, 150 bp, Homo sapiens
  misc_feature (108)..(109): n is a, c, g, or t
atcaataacctacctagtaccagcacgccatgggtcatttacacagaggaaggcacaaggctactatcacaagcctagtgggaccaaggtgaatgtaggcaagctagnnggcaggagaaaccctggggaaggctacctaggttgtctcac

SEQ ID NO: 603981 - DNA, 1116 bp, Homo sapiens
ggcttcttcccaactgtccgtcctccggccccaggtcaccgacagcacgcgcgctgcttcaccgtcgtgcgcgagtcccacgtcaggtcgtccctcaggcgccttcagccagcaacaggcagcacgcaggacagtgcgacagcgaaagcgtgagaagacatccagcgaggtgcagccagtccacggtgcagggccagggcctcattcttccgagcaggccctgctccgggccatggggcctaggctcgacattatcttcttgtaccttgtcgtgcatgcgatgcgtaattcggctttcttccttcacgtaggaacctgcgagctagaaacctgcggtaacagcactgcgacagggcatggaccccacgggctgtgcttacccgggtgacctggtggggccactctgtgaccggtagctacaaagcgtctcatggagtcgcgctaagcttcctcacacaggtacaaggctacagcaagtgcctctccgttgcccgcccctacgtatcgagcgaaacgcagttgggcccgccagttgagccatgactatcccgataggtcggtcgccttgatagtgtaggtgcggtcgccccttttcggcgaatggcttggcgtgcctccccgcccgtgggtgtgggtagaaatcccatgttgccccaatacatgcttggaacgggtggggccatttggtacccttccccctttgtccaccgttttacccttcggagcctgggtccccccctttgggtcctaccgcccaaggccttccccccgggagagacgttaactgaatggccctagggatgggggtccccccccccaatttccttgtagcaagcttggaaccatacaaacagtcccaaaattgtgcctattggtcccaacagcgttaattttgtccccaaagactggtttgagaacaaggaaacccttccctaaggtacgttcctttgaccttcctggtccacctatttggggaagcgaaccccaggtggaagcgccacctgaaatggggggcaatcccacgtgaacccccgagggtccttttggggaaaggccaaacgccctttggacactacggcccagtgccattggccgtccgcgaaaaaccccgaatgc

SEQ ID NO: 603982 - DNA, 584 bp, Homo sapiens
  misc_feature (79)..(79): n is a, c, g, or t
  misc_feature (90)..(90): n is a, c, g, or t
  misc_feature (92)..(92): n is a, c, g, or t
  misc_feature (98)..(98): n is a, c, g, or t
  misc_feature (105)..(105): n is a, c, g, or t
  misc_feature (112)..(112): n is a, c, g, or t
  misc_feature (119)..(119): n is a, c, g, or t
  misc_feature (132)..(132): n is a, c, g, or t
  misc_feature (137)..(137): n is a, c, g, or t
  misc_feature (147)..(148): n is a, c, g, or t
  misc_feature (158)..(158): n is a, c, g, or t
  misc_feature (161)..(161): n is a, c, g, or t
  misc_feature (223)..(223): n is a, c, g, or t
  misc_feature (270)..(270): n is a, c, g, or t
  misc_feature (298)..(298): n is a, c, g, or t
  misc_feature (308)..(308): n is a, c, g, or t
  misc_feature (331)..(331): n is a, c, g, or t
  misc_feature (501)..(501): n is a, c, g, or t
  misc_feature (577)..(577): n is a, c, g, or t
  misc_feature (579)..(579): n is a, c, g, or t
  misc_feature (581)..(581): n is a, c, g, or t
atggccaaccttaggtgcaggaagataatgagtgacccacccatgggctttatcctggaacaaatgcaaaaggaccccngggcactcagngnacattnaagaatnctgtaanagcacanaagatccagaagntgagnatgtgggttnnattgcaattnggnaatgatttgttcatccccccttcccttcgccctcatgtggaaaaagagctgggaccccggcnaacagcacggagcggaagggaaagcaggggaaaaaaggcctcatctntttatatttatacataaccccggggaanacacaaaaanttgtacctgcgctgtttgtgccnccgctgcctttgggccctcccagcacaggaatggttttttcaccgctgcccccgagttccatgtttttttcccctgccccaagttgctgtttcggctgctttcccaaagttggttttttttttatttggggcagtgggcatgttatggggaggggagggggtttttccancctcaggtcccagctgtttcacgttgtttattttgggtccccttttccaataaaacaagccagttgggggtggttntntntta

SEQ ID NO: 603983 - DNA, 380 bp, Homo sapiens
  misc_feature (58)..(58): n is a, c, g, or t
  misc_feature (61)..(61): n is a, c, g, or t
  misc_feature (183)..(183): n is a, c, g, or t
  misc_feature (222)..(222): n is a, c, g, or t
  misc_feature (316)..(316): n is a, c, g, or t
taaagtcaccccgagaaatggtgactgccagtggccgtattgggtcctgggggacaanggngagcggagtggctgcctccaccctactccagacatcacagtccctgacctaggggtcgccaatgccgactcagctctgtctggccacacgatagccctggggtgacatccacaaccaccctncaccaagggtcagtgggttttaacctgtcatattgagtnggcttctaaaagatgcagatttcctgggtattcccttaaaaggtttaattttttaggtctggagagatcgcagaaattctgatgcaggggtctnagaaacatacttagggagataatccaagagaattggacctgctttttcagttttgctgacaagt

SEQ ID NO: 603984 - DNA, 124 bp, Homo sapiens
caatcgagctcggtcccgaagctcgctgtcgctgggattacaggcatgagccaccacgcccggcttatttttttattttttgaaacagagtctccatcactcaggctggagtgcacacgatccc

SEQ ID NO: 603985 - DNA, 225 bp, Homo sapiens
  misc_feature (11)..(11): n is a, c, g, or t
gatgatgcttncctgcacggctgacagataggaaatgcggggtagagagatgttgagcggtgtcctccgttgcggctggtcgttgctgattcttgcaaaggaggtgggggcggatggcggtgatggcctcctggttttggtggtctctgctgaggaccatcatcttggttaccactatcacccgggggtctcgttaggcgtccttcacgaggagctctctggggt

SEQ ID NO: 603986 - DNA, 213 bp, Homo sapiens
gggatcaaaaaaaaagggctggaaaagggggaatggcccccctctccaaaaaccaaatattgtttgtggtggttgggggtggggggggggtttttccttttccttccttttattttttttgaatgggggaggctatttattggactgagagtggggtctggatatattccctttgttttcctccccttttgaaaataaacctaaaactgttta

SEQ ID NO: 603987 - DNA, 106 bp, Homo sapiens
cgtcacgcttcttcacgatcggctttcgattcagcgtgtttgttgcctttcttagccggacgcgccgctttcgcattacgtccacggccgtgaccgccattcaact

SEQ ID NO: 603988 - DNA, 695 bp, Homo sapiens
ctgctgatgaacagagcagaaacagcactaactcagtcctaacagatggcaatatgtgagcatgtctgataaaaatagaaaatagcagttctaaagaaacttagtgatttccgagataagactgaaaagcaattcagaaatgtatcaaagaaatttaacaaagaaattgaaaaaaataaaaaaacggaaatcaaatcttgcaactaaaaaatgaaatttctaaacagaattcattataggctctcaatggcagaatgggtccaatagaagaaagaatccatgagctccaaaataagttatttgaaaacacaaagtcagaggggaaaaatgagaacacagaatgaaaaggagcaaagatcatctacaagatgtagaacattacctcaatagaccaaatttaagaatcattgatgttgaggaaagagttgaataaagagacaggcgtacacagattatttttaaaaatattaataactttccagttcttctttggaaagaaaactttccaaaacttgagaaagatatacatttccaggtacaggaaggtcagagaacaacaaacagagttgacccaaatatgattaccccaagtcatataataaactctcaaaggtcacggaaaaagagaggatcctgaaagcagtaagagaaaataaaccaatggcatttacaggagctctaattcatctggcaac

SEQ ID NO: 603989 - DNA, 419 bp, Homo sapiens
ggcacagtgactcattcctgtaatcccagcacgaggctgaggcaggcaaatcacgaggtcaggagatcgagaccatcctggctaacatggtgaaaccccatctctactaaaaatataaacaattagccaggcatggtggcaggtgcctgtagtcccagttacttcggaggctgagcttgaatggtgtgactccgttaggcgactctgctagtggccaggaccaccgccattgcattccagcctgggccccagagcgagactatgtcttatatctctcatcctcccctcacaccacatgtcggccgcctcgccccagacgcctcttagctctggcatgtttacgctgctccaccatatcccggccatcttgctctatatccctctaagcgcgggcttcaccttttggcgcgctctttccg

SEQ ID NO: 603990 - DNA, 1361 bp, Homo sapiens
agcatagctgttccacttaaggcccctcccgcgcccagcgcaggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggacagtggaaagaggttcacaagcaggtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtctctgatgtcatatcatttcactgtctaggctacaacaggattctaggtgcgggttgtgcctgttgtccttttatctgatctgtgattaaggagtaatattttaggtggctgggaaaacatcaactcctgagttaggataagatggttgtaaatcccagcttttccgtgctggtgggttaaccttgtgtggctcactggtgggttgaatgtcctgccccct

SEQ ID NO: 603991 - DNA, 1675 bp, Homo sapiens
agcatagctgttccacttaaggcccctcccgcgcccagcgcaggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggacagtggaaagaggttcacaagcaggtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggtagctgcaaggttttaagagtcttcgtgatgtcatatacatttcacgtgtctaggcgtacaacaggtattctagcgtggcaggtagatgcatgcttgtcctgtatttgagtctgagtctgtgattaaagcaagtcagagtatttctacacgatggacctggggaatataacagtcaactcgctgaagttacgaacagtacatgaactggttggtagaaatccacagctatatcctgatgctggactggtattaagtcttgtgtagtcttcaactggttagctgtgaaatagtgctggcacctctgacgcatccacggccaatgtctgtagcgtactgcatttcgccccttgtaggccaggtggatgtgtaccgtgtgttatatgacttcctggctccttgagtgaagatgccgtagtccagcatgtttcccggtgagtcagatcctgggatccagcgtatagtccaaatctgtcttgtgcatagtcttccaaggagctatttgggaacaatcagggggcctcctttttgtgaggtctcttcaaagtgccatt

SEQ ID NO: 603992 - DNA, 191 bp, Homo sapiens
gggcagcggtggcggagcaccctgaagcctggtgacgccccacggttcaagaagctaaagagccgacgaaggctcgaagcgacccagtggcatgccccacgctgagcagcacaggctgccccaccgtgggctccccgatctctctctggatcaccgagacctcgcaggaaggtcatcaggggcgccagcca

SEQ ID NO: 603993 - DNA, 129 bp, Homo sapiens
tgctagctcattcaggaagtcattgtcactcaggactttgtgagtcaccccagtaagccacggcctcatagaattaaagtggccgaggaaatgtgtcttagccaagatcatccagtgaatggggcagaa

SEQ ID NO: 603994 - DNA, 1230 bp, Homo sapiens
agcatagctgttccacttaaggcccctcccgcgcccagcgcaggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggacagtggaaagaggttcacaagcaggtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggaagctgcaattttaaagtctctgatgtcatatcatttcactgtctaggctacaacaggattctaggtgcgggttgtgcctgttgtccttttatctgatctgtgattaaggagtaatattttaggtggctgggaaaacatcaactcctgagttaggataagatggttgtaaatcccagcttttccgtgctggtgggttaaccttgtgtggctcactggtgggttgaatgtcctgccccct

SEQ ID NO: 603995 - DNA, 787 bp, Homo sapiens
  misc_feature (346)..(346): n is a, c, g, or t
acgaagaaaaattgtatcagcatacacatacgatgtgttgtccgtcgtggtgtattcagcatgcttagttacagagctttatctgctcgtacaatttctggggaaaatttgatcctctgtatccgtggcaatccactattcgacgggtgatgtcctctacaccactggctgccccccgcctcccgcgcgcgtttacgttcccccacctgtgtgcagcgttgtaatcatctcgggcacagggttatcagcctctcgggcacaatcgtgttaaggctctcgtctgccccggctcttttggagaatagtctgggtggaggctcaattttaagcgtccaatgctcgcagnttgttgccgacccaggcgggggctcaaaagggggtcgcccggcggatcatctcataacataggcgggccaattgatgtagtaaaaatcgccctcgaagttaggtgtttaccccccccttccgtcaacacacacattctactagaccccctctctcttttagcagaactcacctattggctgacgacacacaatttatcaacagtccgcaacatctgcgcttcgaacctaactatgcccctttagtctacgcactatctcggattatattatcgggacacctctgctctcctctgaccccctcctgtggagtacgcccccatattgtacacccaatcacccacctattcacttctccggcgacgactaatagtctgtatatttgctccccgaaccattttttcccaacctattaacatcaatggaaaaaaaaccaacataaa

SEQ ID NO: 603996 - DNA, 1315 bp, Homo sapiens
cgtgacgcgtgggtcgccacgcgtctaggccaggcgcacccggatgaccggctcactgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggacagtggaaagaggttcacaagcaggtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtctctgatgtcatatcatttcactgtctaggctacaacaggattctaggtgcgggttgtgcctgttgtccttttatctgatctgtgattaaggagtaatattttaggtggctgggaaaacatcaactcctgagttaggataagatggttgtaaatcccagcttttccgtgctggtgggttaaccttgtgtggctcactggtgggttgaatgtcctgccccct

SEQ ID NO: 603997 - DNA, 405 bp, Homo sapiens
ctttataagtagagataattcactcgcagcgtctctgtacactctaacttattagacagcaagcaatatataatactgaaaaagtattcagaaatggaaaattacatcatataggtaatcgaacttgtgtacagcctagaatgtaactgttttgaaagtgcagaacaattctttggattattaaataaggtatacagtatgcatggtatctcaaaatttagctttaaaatctaaaagtctataaagaatcagatgcataaggcatatgttaagttcacttgggaggctaaaaattttccagtgaaaacaaaatgaaaacctttaagagaatgtagagtttatataaacacaaagtatgcgcttgaagatctgtgactaccaatcaacataggtggggtaccgagc

SEQ ID NO: 603998 - DNA, 1532 bp, Homo sapiens
agcatagctgttccacttaaggcccctcccgcgcccagcgcaggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatggggaacatggagattccagttggctggtatggagtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggtagctgcaaggttttaagagtcttcgtgatgtcatatacatttcacgtgtctaggcgtacaacaggtattctagcgtggcaggtagatgcatgcttgtcctgtatttgagtctgagtctgtgattaaagcaagtcagagtatttctacacgatggacctggggaatataacagtcaactcgctgaagttacgaacagtacatgaactggttggtagaaatccacagctatatcctgatgctggactggtattaagtcttgtgtagtcttcaactggttagctgtgaaatagtgctggcacctctgacgcatccacggccaatgtctgtagcgtactgcatttcgccccttgtaggccaggtggatgtgtaccgtgtgttatatgacttcctggctccttgagtgaagatgccgtagtccagcatgtttcccggtgagtcagatcctgggatccagcgtatagtccaaatctgtcttgtgcatagtcttccaaggagctatttgggaacaatcagggggcctcctttttgtgaggtctcttcaaagtgccatt

SEQ ID NO: 603999 - DNA, 1556 bp, Homo sapiens
agcatagctgttccacttaaggcccctcccgcgcccagcgcaggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggacagtggaaagaggttcacaagcaggtggttgagagtgcttatgaggtgatcaactcaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggtagctgcaaggttttaagagtcttcgtgatgtcatatacatttcacgtgtctaggcgtacaacaggtattctagcgtggcaggtagatgcatgcttgtcctgtatttgagtctgagtctgtgattaaagcaagtcagagtatttctacacgatggacctggggaatataacagtcaactcgctgaagttacgaacagtacatgaactggttggtagaaatccacagctatatcctgatgctggactggtattaagtcttgtgtagtcttcaactggttagctgtgaaatagtgctggcacctctgacgcatccacggccaatgtctgtagcgtactgcatttcgccccttgtaggccaggtggatgtgtaccgtgtgttatatgacttcctggctccttgagtgaagatgccgtagtccagcatgtttcccggtgagtcagatcctgggatccagcgtatagtccaaatctgtcttgtgcatagtcttccaaggagctatttgggaacaatcagggggcctcctttttgtgaggtctcttcaaagtgccatt

SEQ ID NO: 604000 - DNA, 117 bp, Homo sapiens
gcagctgatgctgtgggtgatgctagaggatcccggggtcattttggctgtcaccagcgacgttgccgcgacgaacatctgtacagacacattcttgacattgaagcccacattgtc

SEQ ID NO: 604001 - DNA, 326 bp, Homo sapiens
gcactctgcctggttcagctgatttgtgttcaaaggaggcaggactgggtgcggtggctcaggcctgtaatccgagcactttgggaggctgaggagggcaaatcatgaggtcaggagatcgagaccatcctggctaacgtggtgaaaccccgtctctactaaaaataaaaaaaattagccaggtgtggtggcgggtgcctgtggtcccagctactcgggagactgaggcaggagaatcgcttaaacccaggaggcagaggttgcagtgagccgagattgtgccactgcactccagcctgggggacagagcaagactgtctcaatta

SEQ ID NO: 604002 - DNA, 165 bp, Homo sapiens
  misc_feature (58)..(58): n is a, c, g, or t
gagagggagcctcgttttttcgcccaggctggagggcagggggggggtttggggtcantgcaacccccgtttccgggggtggggggatttttttgccccggccccccgggggggtgggattacaggggggggcccctaagcccaggtcatttttgtttttttaga

SEQ ID NO: 604003 - DNA, 347 bp, Homo sapiens
cgacaaaacttcatcagcatcttttcgcgtttcacttaagcttctgaaaagcccttcttggtcagaatgactgaaacaaagtgatggccttttcaaagttacataatatattttcagcacatcccctgactaacactatgaaaagtgcatccattctagagtcagacaggcctaagttacaattctggatttactcatcactttctgtatgtttttaaatgagctatgcaacttctcttcagtaaaccaagaataaatatacttatgatatgaagttaagattatccgaaaagggaaaactcagccctcatttgaactaaaatcagcttaaaaggcaaattgtaagt

SEQ ID NO: 604004 - DNA, 137 bp, Homo sapiens
atccccggcctccttggttgccacactccatccttctacagataaacaactggagaaaaggagtacttatagcacaggaagacatgtgagcctggtaaaaacagactctacacagaatcagcaatccaagtgtgacg

SEQ ID NO: 604005 - DNA, 1838 bp, Homo sapiens
  misc_feature (70)..(70): n is a, c, g, or t
agcttggattggtcgtagtagcgtgctgcagtatgcatggcgcgttggttgatcagaacagcacgcccgntgtggagtgacctcgcttatatgactgtgcagcgtgagcccccaccatgtgcgtgtaccacgaaatatgcccgtgcgtttgttgtattcgctgcggccctccgtatatcttatgtaccgggttctctctatatgagtattcagagagctccgtgggtgggccagcaatgtatcgtgccatccaggggtgtttgatccccagcgacgcaccactggcgccgggggtggggccaacgatgagatctactagcgccccgctctgtttgctgaagattggtcggcgccccatcataaactaggggggggtcgtctctctaatgatgaagtaaataatgtgtgggttgtagagcgcagacggtgttgtttggtaaagagaacaagatagttgggttgtaagagtataatggtggaaaaaaaccacccgcgcgtgctgaatggtgtgccgcaaaatgattgtgacgagggaaatgttggtgtgggcaaataaggaacggccttgtgtggtgtccaatcccccgggggggctcgcactacaaggggggtacaccccccaggaaaaggttgggtcgactatcgttcgggataggggtgtcttaccacaagaggggtgttcagctggtgttggttttgttgaagacagatgggtgagagggtggccgctgttgccttcggaaaagttgttggcgccgccggcaaaaagttggtatttgggagaagattggtggcccaccagtgtgctatggagacagaaagattggtgtccaacagagccgttgtagatttgttttccttgggagaaagagaaaattgtgttgtctccacagcgcgggtataatataaatacctgggtcgccgcccgggagggctgtataaaacgtcgttgtcagcaacatgcgtgggaccacattggggagattgtcttgtgtgaaaacaccccccggggtgcgacccagcagaatgaagggtggtggtcccccaataggggttccccacaaaaatataatagggcgcacgacacaccacattggtgagtttgggatgagacttctctacacggtggtgagagtgtgcccagagagacattacaccccatagggtgttgactactatggcggtgtctcggtctgtggttttgttgtgtgttttgggtggtttttagctgtagataatgagacgcgcccacgcctatatcacgagatatatcgcggatagagacccctctcttttatagagctgctcgagagcgcgcccctaccacgagtgttcccgcccgcgacatatcccgcgcgatgagagaagatataggtagtaggggaatatatcactagggagacccgcgtgagagagagggccacgagacacacaatagtgacacttgtaaatagaaagatgggtctcacatataaagtgtggaatatctcccgaaccagccacttgtggaaaagaacacatatagagaaaagagcggttgtcccacatatgttatattgatctcctctgtctccatagagatagttcttgtgctttagaaaaagattaaaatagctgaagaaagaccccagatttggaaatggggaagagcttcactggagactttcatggtggaagagccacgttagatttctgggaaagacccatcggggaacgcagaacacgggtggctcaaagattgtgacggaactgtatgggatatggaccccccgtcccagaaatctgttttaaggtcagacgtccaatagtggccaaattaaaagggctaatttgttgat

SEQ ID NO: 604006 - DNA, 115 bp, Homo sapiens
cgcaatgaaaaacactaagagaaaagaagggaacaaagaatatataagagaatgagaaaacttttaacaactgacaggaacaaagcctatcatattaattataactctgaactta

SEQ ID NO: 604007 - DNA, 971 bp, Homo sapiens
  misc_feature (754)..(754): n is a, c, g, or t
gtcttttgttcctctcgcgtgtcgttgctgcttgtggtctctgttcacttagtgttttgtatgacttctggtcccttgggtggcgctagttgcccttgctccgaacacgggggtttctctgttcgaaacccaagccttgtttggaggggccttccttctggtaaccaccgccggatttgccttcgggtccacactgtgttgtgaggacacgggaagcccacacaccccgttttctgggcgggttgcccactgtcactggctgcccagtgttgaggcgcacctgccccacccctggggtgggaccccggccccgcctcccttcctttgggggccgcgtgtgttcccgccgtcacacgttcgaacacccgggtggggggtcccacggtgaccgcacatataggcgggcccccgcctgtgccccctaaagcgacggccgtgtcaacccacggattgttgccgaccccaggtggtaataacaacgtaggggcgtccttcttataagagaagcccaaacatgagggtgcaacacgggcggctacgcggaccacccccgcgccgagagacccctgccagagggcgtcctctttggcggcacccacaacccccgagagggcgagttctccggcctcccccacgcgaaaccacccgctttcggccgtgtcacgccaagcccctcctctgcgccgttctcaagtaattccctaagcgcaccccttaatggcttttcacgaatgttatcaccacccgaaggggntggcttccatatcattccacgagaggccgcccttttactaatgctcttgtagcagataaatgcgtggcacagagcactactggggggctccctagaatgactgtcaaaccccccaaagctttggcccccacagggacagttctaatgccaagctggtatgaacgcggtacggcaaataacaggtttaaaaaaaaagtccccctcttccaaaaaaaca

SEQ ID NO: 604008 - DNA, 210 bp, Homo sapiens
  misc_feature (26)..(27): n is a, c, g, or t
  misc_feature (118)..(118): n is a, c, g, or t
ttaccgcagtattccaaccacatccnntaccagctgtgtttacctctgtgattagacagcataataaatgcacctgtgatatgccgagttgatttgattaaatgcctgattatatatncatgttaaaagttattttgtcaaacaatgaaaagtgtcctatgtcccatgaaactgcaaatgcctttactggcgtggcctaataagcggtaa

SEQ ID NO: 604009 - DNA, 535 bp, Homo sapiens
ggaaggtcctggactggatttcttcaagccaatctcacacccctatgggaggaggtcatcgatagcaggaagaaggatggctagggactccagtcatagtataacgcttcaggctactgcaaatccaaacacaggtttggtggaagatttggacaggacaggacgtctttcactgacaacgcagcagagtaattctcagcagcttctctacatcacatgcaaggcttggcagaagctagagcacatccagacgaagttctcatcggacatcacgcacataggaatgatgtcacaggtggaagaaaagacccaaatcatactgaaggcctcaagtcatttactggcaaggtatagctctcattacccacacacgaaggaaagcaggatcttcatcccagtgacctcagctaagagtgggtcctttggagttactgcagtttacggtgggagattccaaatcttaatgtcagtcgtaccttatcaggagaccaagacaaagttccatcccagtggggggtcccataccactcatgga

SEQ ID NO: 604010 - DNA, 134 bp, Homo sapiens
tgtgtgctgggtgactctacaggatctttgtcatcccccttcgtgtgccatccctcttcgtgtgtcatcccccttcgttgcaggtaccctcagcggccactgagtcctgttgcctccatcttctctctgacaca

SEQ ID NO: 604011 - DNA, 696 bp, Homo sapiens
agcggaggtctcacggccgcgagctaggtggtctgggaacccacgtgggcgtgggatttccggacttgctcgtgctggtccggcacgcctggacgcgcccacccgtggcctaggtcgccactggggaacgctgctgccgcgcgcgtacaaacatcaacggaggcagccagacacggcgaggcaccactggacccttcgaaacgggccaccacacgcagaagcacgtccacccgcgatgacaagaccctgggagacatgggagcgcaccaaggagcacaaccgctttgcacacgggcagactggcaatgcaaaaggcaatcgggcgtcctccgcgtgtcataaggcagagtggcacacgcacacgcacacaacacgaaaacgaacaccgacgggaccgccgaagacacaccaatggctaccgcaaaggcaaaacgcggcacgaacagggcaacagccacctacctggcaacccgagacgcaccagggcacggagagcgcacaccaggcttggcccctcgggccatggaaaacacacaacacccggccaacagacacacccacggcaccacgcggcacgccacaccgcagccacacgcatgggccccaaacgccgggcaagccccgagcgcaacgcgaactaacccttaaccaaaggggacagagggcccacgagcaagccattgccccccaccgcct

SEQ ID NO: 604012 - DNA, 230 bp, Homo sapiens
tgttgggattacaggtgtgagccatagcacctggccaatttttgtattttttaatagagacggggtttcaccatgttagccaggatggtctcgatcttctgacctcgagatccacccgacttggcctctcaaagtgctgggattacaggcataagccaccgagcccggcctgtaaatcttttaaaaacaccgttgatagacagaacaccgtcgaaggggtaccgagctcg

SEQ ID NO: 604013 - DNA, 270 bp, Homo sapiens
agtctcctccagcgtcccacggggtccactggtccgaggaatcatgacgccggtgctcagtctggagagcccctaccctctgtccccttaccggtgtctggtggccctgggaggtggctgtgatgtgcctctctgggcagctttctctgctcagtaaattcaagatgatctcagagttgtcatgtggcttgaaggacaggcatggcagtacaggggcctgatgatgtcgcctccccccacagagagagcgtccgtcccgaaactgagaca

SEQ ID NO: 604014 - DNA, 391 bp, Homo sapiens
gtctcctccctcctgcttgcgccttccctttgcaccagcccgagtctaggtctgggccaagcacattacaagtgggaccggtggagcacccctgggctcccgggcaggggagttctgaggctcctgctctcccatccacatgtctgtactggcctaatgccaggctctgagttctgtgaccaaagccaggtgggttccctttccttccctcccctgtggccacagctctggagtgggatggttggttgcccctcacctcagagctcccccaaaggccagtaatagatccccggcatcagtaaataatctgctttggactagtaagagatacattttgtacacgtaaaatacaaccagttacaaacaaaataaaatctgtagagtggaaaaa

SEQ ID NO: 604015 - DNA, 223 bp, Homo sapiens
taatcgagccgcccgcttcgtgaactcctgctgattccttctcaggcgcgacactgagttgggtctaccccgatgctacgattgctaccgggctttaccctggcggcagtaccctcgttgccaactaccggtctttgccggagcgagaggtgcccatactgctgtcgccgacgcaaaaggccgtttaccaaagcatgatgcccactgaggtactggctcatct

SEQ ID NO: 604016 - DNA, 699 bp, Homo sapiens
  misc_feature (1)..(1): n is a, c, g, or t
  misc_feature (139)..(139): n is a, c, g, or t
naaggtactaaatggtgaagtccttggagttgcagtcagctctacaatacttgatccagtggcatgaaagatcgggcaggaaacgcgcagccatgtcttgtgccgttaacatgttcaaggctgatcgaacgaaagatgnctgtcctatgtacgcaatatggtaaagtgctaattcttggtgcagccagctatataatggtggccttcaagccatctaatgtttgcagcgccttcaagaagagcatagtgtaggatcctgtcatgtcagtcacgagccctcagaatgggcacatttctaatgcattcagcgagccctccagaacacgtcgaaagtgtatcgtccttgctttcagtcatagctgagaagagtgttaaccacccgggtaaagtttttatcatgggcttggcatggattgtagtaggagttcttgatgcttatggctattacagggaatttcccatcaagtgtagtccagcagcttaggggtccatagccattctgggcttggtgggcacacctgtgtgtacagctttcgagcatctgggtagagttaacagtggcttgggcagtgcacccaaatgatgcccttaaaaaattataggggttaagtcactctcattcaatttaaatggcttacaggcatgtacagttgcattctttcataaatataacataatctttcctggcagaagcctcat

SEQ ID NO: 604017 - DNA, 113 bp, Homo sapiens
ggaatccggctggtgcagcctatcctctgcagctgacctctgttgtcctccccttgtgctggctgagagccccagctgacattgaaatacagttgttggctccggctcccctc

SEQ ID NO: 604018 - DNA, 158 bp, Homo sapiens
  misc_feature (25)..(25): n is a, c, g, or t
ccctggtttcagggctttcccattngaactttttcccattttagggatttactttaaagttttttcccatgtcccaaaggctagggggttggaggtgggggctttggaaaaacagcccccctttcctcgggggcccataaataaaacatgccgggtta

SEQ ID NO: 604019 - DNA, 393 bp, Homo sapiens
tgaaatccctttttattttttaaagatttttttttttaattttggagggtggggggcaatttttaaaatatgccttaaaaggccgggggcggtggctcccgcctgtaatcccagccctttggggggccaaggtggggggtttgccttaggtcaggggttcaagacccccctggctaacatggtgaaacccccttttttcttaaaatacaaaattagcccgggatgttgggccatgcctgttatccccaattcttgggaggcttaggcaggaaaattgctttaaccccgggggtgggggtttcagtgagctgagtttgggccctttttttttgaatatgccttttttgttgttttgaatttgcctttaaataaagtgttccccccccctgccca

SEQ ID NO: 604020 - DNA, 387 bp, Homo sapiens
  misc_feature (41)..(41): n is a, c, g, or t
  misc_feature (330)..(330): n is a, c, g, or t
  misc_feature (349)..(349): n is a, c, g, or t
ctcgcgtgcgtccgtatccgggagcagccactaggtaactntagaggccactgcaattaatcggcttgaacagccaggagcggaaacccgagagtcagttcaaccacagccacccgcgtgtgcccgcggaaagccgatggcctactctcgtccggcagcgcactggtttcctgggttaccggcctcagcgctcctcccgctttcttttccgggaggcgacaatctgacgctctcagcgcgtgacgcagcacgcttttgatataaaatgcagaccgcgcggccgtagcttcctcttctgcttttcggggccgacttcgcaaagattggcgncgcagaaagacaaggaagncccaaggaggtcaaaccttggaggttttaattttggac

SEQ ID NO: 604021 - DNA, 213 bp, Homo sapiens
ctaaatcattttactttcctggaaaattgcaaggttaacgactaaactgggcccatttgggccaggggcttacaggtggtaacagtgattataaatgtgtaaatttagccaaagggctccctattttgacggtcattgttggctctttgccccgtcaggattgaaagcagattgtattttgctaggaataaattgccctgttgtgtggtttta

SEQ ID NO: 604022 - DNA, 224 bp, Homo sapiens
aatttccgcctgggtacgtgccacgcactgcaccgggtggcccacgagatggaacaggtgcgtgaacaggccgcgctgatcatctctcttgagagctgggaaaccgctggcgcagtgccagtcgcgcagtggacgctcggccagttgaccatgttcacctgtgtacgccgagtgaagctgcgccgcatttacgagccggattgtgtgaaagcctgcgtacctgg

SEQ ID NO: 604023 - DNA, 104 bp, Homo sapiens
agccagttctcatcatgtatgtggctggctttttggagggttacctcactgccccacacatcaattaccactacacaaacctctacccacagctgatcatgaaa

SEQ ID NO: 604024 - DNA, 940 bp, Homo sapiens
cccacgcgtccgcttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaaacattagtcaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaggtgtaggtggtttaaaagagaaacacttggtctagtccataatattttaatagggcttccctggctgcggggaaaacttaggccagtaagcattctcttggtttaaagccctacaagacatttggaaatatttcatggttcatgccaaaattctaagtactgttttcttagcaagtgtaacataatcgggaccatgggtacagtaaaacattcttgggatgatatcaaagccttattagcactgccctgaataataggtcatttggcctcactcattgccaaagtagccattttctaagtgagggagttttagactgggctcatggcctggtttcgttagattgtaggccaggacggatactaattggcacctagggttcatattgcaccccacagtaatctggggctatacggttattggtacataaagcaaaaaaaaaaagaaagagaaaaaaaaaaaagaagaagaagaaaaaacaaggagacaaaaggacaaaatgacagagcaaaataaagccgggggataagaaggcgaaacgaacacacagcaatagtgacgccaacaaagactatacctggtcac

SEQ ID NO: 604025 - DNA, 372 bp, Homo sapiens
tcccagccccccctgccaaagtcccaggttttcaagccccgcttacttggtgggttgggggggaattctttcctctgtcccccccagtttccccattggggggacctgaaggggtggcttccccccctttttttcagaattactttgccttagttttcccccaaagggaaggctgggactttttactctggcccccctgatagttatttaattctgtttctcccaggggttccccatttaactgaatttagatgggggcgggggggtaaggaaaccccccccctctccttcccccttgggccccctttatcaattgcctgttttgttttgtttgtttttttcctttccctaataaaatggggtttttttcca

SEQ ID NO: 604026 - DNA, 287 bp, Homo sapiens
  misc_feature (189)..(189): n is a, c, g, or t
cttttttttaaaaccggggggggggggaaattcccccgggggggtcccccaagggccccgggcccccctttttgggtttttttgtcccaaacccggccccccccctgggggggggggggttccccgggcatgggcccccccctttttaaaacgggggggcaccccaggggcccccccttcctttttttnaacccaaaagggtttttgggcggggggggggggggccccctttttggggtttttggttggggttcaaaaggccgaaaaaacccccgaaaaattgttta

SEQ ID NO: 604027 - DNA, 146 bp, Homo sapiens
  misc_feature (139)..(139): n is a, c, g, or t
gtgtcaagataacctcttatgttaacacaaatattcaataaggctgggtgcggcagacaattcttcataacaaaaacagtcactttaggaggccgaggtgggagtctgagaccagcctgggcaacatagcgaaaccccntctctac

SEQ ID NO: 604028 - DNA, 731 bp, Homo sapiens
cactgaatgcatctaagcaagatggacctatgccaaaaccacacagtgtttcacttaatgataccgaaacaaggaaactaatggaagagtgtggaagacttcagggagaaatgatgaagctatcagaggaaaatcggcacctgagagatgaaggtttaaggctcagaaaggtagcacattcggatgaacctggatcaacctcaactgcatccttcggggataatgtcgccagtcctcttccttcacttctggtgtagttgcagccattttcattggattctttctagggaaattcatcttgtggagtgaagcatgcagagtgctgttctttttttttttttctctctgtgaccagaaaaagattggttggcctacaatttcatggggggtgtggcccgcggtgaccattttttggggtgtacagcgtatataggcttggccttggatgatctctggcggttgggaaaaccaatagagacaactcggttccggtgctgaccgggttggtgttatggccagatcatcatctagcagatgtccgtcgcactctcgcgtccttgtgaaattcataactaagactgtcttttctgggggggtcacttacgagttcagaatggttccagagtttggcactgtatttaataatccttcacttattctgtgcgttaccttttgcatatgatctattacatgctacccatatcaggaaggcaaagtatcctgggaaaggg

SEQ ID NO: 604029 - DNA, 461 bp, Homo sapiens
ccggggggggggaggagaggggggaccgcccctttttgtttgttttttgggtggtgcccccccccgcccccccccccggggggggggtttttttgggggggggttttttttgttgtgttcccccccccccccccggagaggtgggggcgattgtgttttttccccctccccccccgggggggggggggtggggggaggtaccccccccctccccggaaagaattttgtggggcgaaggtggtggggaggggcccccccaccccccttttttttggggggccccaggggagggcccccctttcccttccaaaataggggggtggggggggccccctttttttttttccccccttttcaagggggggggttttttgtggcccccctttttaaaaaaccccttttttttttttatttgggccgttttttcccccaaaaaagggtggggccttttttggggggga

SEQ ID NO: 604030 - DNA, 162 bp, Homo sapiens
ggggggggggtctggtgcaaccaattaccttcagaagtcacataatcagttaaataaagttctcctgtgtgcaatctaagtttcacatgatttatcacatgatctcagtatataaaacacctgttctgaaaggccccagagtgtacaacaccaggtcgacgc

SEQ ID NO: 604031 - DNA, 135 bp, Homo sapiens
cctcacgaccacaccatgatgaagtggatgtgtactgtttcttcttcagcatcaccaaggtgatcacgatcacgtgtcgcgtattacaacaccgcccaccacatgcctcgtgcaccaccactgcctcgatgcagt

SEQ ID NO: 604032 - DNA, 244 bp, Homo sapiens
gaccactacgcatgctcagctattgagacactgtcaagattacgttattccatccatagtgcattattgtcactttttttctgtcatgtatgtagatacttctatatcatattcgtcctttttttctaaatagaatttctataaagatggatttgacacactcaccatttaaatcatttccagtatagatatagtgtttgggctgacaattatgtcacaatgggactgtctttatacggtttgt

SEQ ID NO: 604033 - DNA, 304 bp, Homo sapiens
aggcccaaggtgggggcggtggccaggacaacgggctggagggtttgggcaaccacacccaaaacatgtacatggagtttaagggcggcgacggctacctggctccggaaaaagggtattttattgaaggttgccccggagtaaaaaggttgtcctttccatttgttgggtttggaggggttcctgcccagccccttggtgtaatcccctcccccaaccttggccacttgagtttgtcctccaagggtaggtgtttcatttgttttggccccttggatttaaaaaaaaaattaatttcctgtta

SEQ ID NO: 604034 - DNA, 1021 bp, Homo sapiens
tggaaataacggcaatttatccatggcacataccactgtatttatgcaaatcaacgtttgggaaaatttagacacagaagggaactagaacagttttcccccgtgcagagaatgaaaagcttttgggcctcttaagtcttgtgataaaaggcgtacataattctgggtgtctacgtgtacagaatacgtgccgcttagcgtggatttcccaatttcgtgagttaacacttcgtgcaattccaaacggggtttcaacccttccacctttacgaggccgtgctttacgggcacttaaacacattaatccaagaaatttcttacacttaattttattacattttaaattgtgggtggcattatttttaaccgatgtgttactattaagaattcttttctaagaaagcatttacattaattaaagtggattacgtggtaaaaagaatcgtgatatagtttaaagagttaacagagcctttaacgagatagaatacttaccaaaaacttcgagccgtggatcagaactgtgggtgtgttgaagccgtgttaagtggggctagtggggccaccgaggcctttcccagaggggtttagcctttcagagggagggcaggggaaagagggggggtcttaaaagagaaccacaagaaccaattaacaaaaaattcagaataatttagaacagcgagattacgcggtaaacaggttctactctctctccgaggtgaacaagaagagaataaggcttccaatggccaattccatattcagaagtgatttccaccggtggcttgtcctggtgccaatactcggggggccccatggtggggtgggggcaggggaaagaccccccaaggggagccaaatcaggggccaaggggcgtggaagattgagaatatacggtctcaaaattggaggtgattctgattgtttttgcgatttagatattgtatttttaaacacaatattgggggttaaaagtgtagagagggggatatttggggacggtggtttgatagaaaa

SEQ ID NO: 604035 - DNA, 341 bp, Homo sapiens
agagctggggctgtctgtggggtgagtaggggccagaaagcatagccagcgggacaggagtcctttgaagagacaccattgttgccaaggccacagcggtgcaggtcacaccagccagttacagggatcagagacccaaccccagaatcacattcctcatgacccatgcgttcagaagagcctctgaactccaaggggcaaagcggacagctggcagccctttccctggccagcagaggtggcagttctggtaaaactaagagtggggaggaacatgaacttgctttactgattcccttccattaataaaacagaggaccctacacggggcgcttcataaa

SEQ ID NO: 604036 - DNA, 629 bp, Homo sapiens
  misc_feature (153)..(154): n is a, c, g, or t
  misc_feature (201)..(202): n is a, c, g, or t
  misc_feature (238)..(238): n is a, c, g, or t
  misc_feature (253)..(253): n is a, c, g, or t
  misc_feature (291)..(291): n is a, c, g, or t
  misc_feature (326)..(326): n is a, c, g, or t
agcggcagaaattctagagctgaaaaatgcaactggcatactattgaagaatgcatcagaactttttatggcataactttttatggcagaaatgatctagcagaagaaagaattagtgagcttgaagacaggctatttgaaaatatacgtcanngagaatgacaaaacgcaaaaaaggataagaaaaggcatttccctacnnaggatatagaaaacctcagtctcaaaaagggcaacnatctaagagttatcntggccttaacacgaagaggtagcacgcaagagacaggngttagacaacgtttattcaacaggaagaataacanaagagcttccaacacctagagatagatatcaatatccaagtacaagaaggttatagagcagcaaagcagattgaacccaaacaaaagtacctcaaagcatttaataaacttccaaaggtcaaggataaaaacatggtctgtaataacagaaaggatcctaaaagcagcaagagaaaagaaacaacacacaattaagctccaatatgtctgggagaagacttttcagtgaaaaccttacaggccaggagagaatggtacgacatactgcaagtgctgagggaaaaatcctttcatgctagaata

SEQ ID NO: 604037 - DNA, 156 bp, Homo sapiens
aatagcgaacggtgcaggcggggtcgggtgctgcggtgtcctcgcgcagccctccggctgagcacccccaccttgtgccagggggaccctgggccatgaggcgtggggtgcgcgcccgccaccaccatccgtgtctctgctgggaatggctccctg

SEQ ID NO: 604038 - DNA, 423 bp, Homo sapiens
  misc_feature (1)..(1): n is a, c, g, or t
  misc_feature (3)..(3): n is a, c, g, or t
  misc_feature (48)..(48): n is a, c, g, or t
  misc_feature (177)..(177): n is a, c, g, or t
  misc_feature (181)..(181): n is a, c, g, or t
  misc_feature (185)..(186): n is a, c, g, or t
  misc_feature (209)..(211): n is a, c, g, or t
  misc_feature (353)..(354): n is a, c, g, or t
ntngcccggaaggggggggggaaggggggggggttggggcaattcatnaaaaaggcttcgggggggcgggtgggcagatatagggagggttggggggggtggggcaccgccggggggcatggggatagaggtatgttactgggtggccaggggggttagggggggagggcctggggntccngggnncgttattggtcgtggggcgtttnnnaggccctgcacatgggggtttggctccttccaggactcctcccggggtcagggaggccaggtgggggtcagaccccaccggggcaaccttgcaggggacgacccgggggactgccttgggagtatcaagtcgggaggtaaannggatctcccctttcacccctcccacccattaatttcctcccaaaaaacaagtaaggttattttcaatcc

SEQ ID NO: 604039 - DNA, 199 bp, Homo sapiens
aaaaaaatttggagccccccaaatttgtttttgtttctcagggggggggttttccccaaaaaacatcagggggctctggggtcccaaatggggttttttttttaacagggggggggggggcccccttttcgggggggggggggggccccctcattttgggttgttgggggttttgaacctttaaattgggttttcccca

SEQ ID NO: 604040 - DNA, 536 bp, Homo sapiens
tagggaatgcgaccaggccgcggacacttacgagtactggctccaagacttccgcggcaaacccccagcagactatcatggcccatcagatctcatgtcatcccacaagtgcaagaacagtaaccttcttaatgattggtaatggaggttatattgtctgcctaatgcatatctctttttttttgttttattggagacagagtctgtgtcctgttgccaggctggcagtgcggtggtgcaatctcagctcactgcagtctccacctcctgggttcaagaggttcatcctgcctcagcctcctgagtagccggggagctacaagctaatgcgccaccaaaactccagtataatttttttttatttttttggagaaagagagtcttggcattgtgtccgccccaggcttagatgtgcaaggggcccaaatcttcgggcctcacggcgaacctctggtccccggggctcatgccaatccccgggttaaaccttccgagtagccccaggagtacggggactagggtgcccacaacaacca

SEQ ID NO: 604041 - DNA, 462 bp, Homo sapiens
  misc_feature (454)..(454): n is a, c, g, or t
aaaatttgcaaccttttactatttgatctcaaatttttaaaacttccaagggggctaccaccaccgtttacctaaatttgggacacttcccgagcattacctcctgacttaattttaaaccttcccccacccccacaccgaaaaataggcccaggaccctcaagctttgaggaaactgttaaaaaaattgatttgctcaggggaatccaactgagctttttactactataaaatctgtttcctcaaactgttttgaaaattaagtaacataaggggggtccggtacttagcacactgactgacttacagcaggttttcccagtaaagattacccattatgatggttatgaggcaaacaaagcctgcaattaaccagtacttttccaaggaaacttgtaaggtagcagggggttatactccctttgcaaaaaatggaggctgaaggcttaattgncttttcta

SEQ ID NO: 604042 - DNA, 299 bp, Homo sapiens
cggcacgaggtgtcctcactggaatagacacttactcctgatatgggtctgcctatcctgtatgcaatgcttctgccaagattaccatgcatgggctctccaaaggccttacccaccatcatggtattccacacagcattgcctctgaccaaggcactcactctacagctaaagaagtgtgccagtgggctcatgctcatggaattcactggactccagcctgggtgacagcgaaactccatctcaaaaaaaaaaaaggcattcagtattgcaacgggacagtccttggaggtggacca

SEQ ID NO: 604043 - DNA, 380 bp, Homo sapiens
cagcctggcaacacaatgaaaccgtgtatctaatataaatacaaaaattaatcaggcatgatggtgtgcacctagtagtcccagctagtcgggacgctgaggtgggaggatcgtttgagcccagtgagttcttgggctagtcagtgcgctatgccgatcgggtgtacgcactaagttcggccatcaatatggtgagctcccgggatgcgggtgtaccaccagtgttgcctaacggatggtgtgaaaacggaccaggtcggaaacggagcaggtctacaaactcccgttgctgatcagtaatgtgatcgtgcctgtaaatacgcgcactgcactccagcctgagcaaccatatgtgatgaccagactcgtgtctgcctcca

SEQ ID NO: 604044 - DNA, 207 bp, Homo sapiens
cagcattgggccgagaatcttgctcgctgccattgcgtctcttgcgcgtcgtttttctgtgggcttgagggtttcagcgaacctcaaagaattttgggtttcttacgggttaatcaggcagagaagtgaaaggtaaatttcctaaattcatattgttctgtgggtttctaactcgacaattaagggtccttctgttgggagggggcg

SEQ ID NO: 604045 - DNA, 393 bp, Homo sapiens
  misc_feature (4)..(4): n is a, c, g, or t
  misc_feature (259)..(259): n is a, c, g, or t
  misc_feature (296)..(296): n is a, c, g, or t
  misc_feature (357)..(357): n is a, c, g, or t
ccgncatcaaaaaaaaaaaaaaaaataaataaataaatacatagccaggcgtggtggcaggtacctgtaatcccagctactcgggaggtgaggcacgatcttggctcactgcaacctcgtctcccaggttcaagcaattctcctgcctcaggctcctaagtagctgggattacaggcgtgcaccaccacgcctggctgattcttgtatttttagtagagacggtctcaccatgttggccaggctgctctcgaacccctnacctcaaatgatctgtccaccttggcctcccaaagtnctgggattacaggcatgagccactgcgcctggccaaaaataaatttttttaaccgaagganggctggggtgcagtgggccaagccttgtagtcccag

SEQ ID NO: 604046 - DNA, 261 bp, Homo sapiens
tgagacggagtctcgctctgtcacccagactggagtgcagtggtgtgattttggctcactgcaacctctagctcccacgttcaagcgattctcctgcctcagcctctcaagtagctgggattacaggcatgcaccacgacgccctgacctggcagttgctaaaagtgtacagtcacatgcattcacaaagagagggttggaaattggaacttatgttcaaaaggaaagaagacattaaaaggttggaaaattagggactcg

SEQ ID NO: 604047 - DNA, 466 bp, Homo sapiens
  misc_feature (4)..(4): n is a, c, g, or t
  misc_feature (13)..(13): n is a, c, g, or t
  misc_feature (27)..(27): n is a, c, g, or t
  misc_feature (30)..(30): n is a, c, g, or t
  misc_feature (41)..(41): n is a, c, g, or t
  misc_feature (46)..(46): n is a, c, g, or t
  misc_feature (83)..(83): n is a, c, g, or t
  misc_feature (309)..(309): n is a, c, g, or t
  misc_feature (387)..(387): n is a, c, g, or t
  misc_feature (402)..(402): n is a, c, g, or t
aatnccgggtcgnctactactactaanttngcggccggtcngaccnttaaaagaaaaaattagtagggtatagtggcgcatcntgttagttctaactacttgggaggctgaagcaggaggatcacttgagcttgggaggttgaggttgcagtgagccgtgatcatgccactgcactcctagcctgggcgaccagagtgagaccctgtctcaaaagaataaaaagtaggtcgggcacggtggctcacgcctgtaatccaagcactttggcaggccgaggtgggcggatcacctgaggtcaggaattcaangaccaagcctggccaacaatggtgaaaccccgtctcttgcttgaaaaataccaaaaatttggctgggatgccgttggngaagtgcctggtagntcccaggctacttcaggaagggggttaaggcttggaaaagtcgctttggacctgggaaggttgg

SEQ ID NO: 604048 - DNA, 243 bp, Homo sapiens
gcatatttagtgttgtctctcttaaggaaaagcgtatttttaatctaatcattttataatgcacactgaatgactaggaaacctaaacaaattagatgatgtaattctatattaagggaccggaaaaaaaaaaaaggtaggtttcgggatttataacattttggaaaggaattagaaaccggggtcctcttagagatgaggttggatctaaacccatctcttttccttagtataagaaaccag

SEQ ID NO: 604049 - DNA, 964 bp, Homo sapiens
gctcgccttcccggcgagcggtttggcagggcggggcgcctcgcggaagatggtggcgcgctgcggcgtgtggctcccgtcgtcgggccaagtctcagcgctgctggaccggcccggcgtctcgttgtggctggaggcccactaaccacacggggtccctgagcaccgggcccgcaccgagtccggttcccggtatgcctcgacgcccgtaatgggcaacattgctccgcgaagggtggtcagtgccgtaggaggaggtgcccaggagaccagtgcccaagttgactcgggttccaggtgacgagtgaggagcagaccaggtgcaggccctgcaggcaacacgacacatgtgaagtgcacccatgccttcgtcagcacgcacgtgcaacgagggatcaagactatgaggtgcgggaatggtcagtggaggaatgaggacaacgtgggactaagcaagggaaaggacccgtgtgtgatgggaccgacgtgcgtgaaaggagaccatctgctggcagatctggagtcgtaccactattaaacagaatacgcctgaccaagtggaagagcccgcggcagggggttgcagtccttgcaaggaagccactggacggtccatggaggacgttaactgcattgtacccactgggccttttaaattccgcatgaatagatgtcaccgacgcgggagggcacgggggacaccgagctttaaagagggcggtacagacgacagaagattggcaacggagagggacagcagaaggggtggacccgtgacaaggggcaataccggggtggagacacggggccgcacggtggaaacccaaagtgccccccgtggagcactggggccatggccgtaggggagacaaaacagcggctccaagggcgaccttgggtctagttggcgcaaatgagctttagggggaaccccattggggaaacacccatcaaaagtgaggga

SEQ ID NO: 604050 - DNA, 211 bp, Homo sapiens
aagaagacaggataagaggagatacatcccagatttcagaggtgcagtaaaaatatccttctcaggtaaaaacagcccagtaagcggtcttcaaaaaggccacggtgtaaaacatgcaaatttccactataaaaggacaatgcagccaaggttacccaattactcacctaaaacaatagaatacttattatggggttttggtttttttttt

SEQ ID NO: 604051 - DNA, 403 bp, Homo sapiens
ctttatatttaccaacagatgaattttacatcatcagattaagataatagctctatactttaccctttaatgacttaagcaagattgagggtcaaaggaacttttttttttttttttttttttcaggcagcgctaacggcaggcaaaggggggaaatggtatgatggcctcaggatttggaagatacgccacgaaagcgacgtagggagggacaaggaggccaaggggatgaaggggaggagaagggtaaaggagaggcgggagagcagtggagaggggtgaaagtaaagatacgagagtatattaagagctccagagtcttgggttcagctctgtagtttctgtggctactgaagaggtggtcaggaacataggaaccccctgctgggctcctggtcacttc

SEQ ID NO: 604052 - DNA, 481 bp, Homo sapiens
atcagagttcccgacggcagtatagtcgagtctggaagttagaactcttagaattagaacacacaaacatcaagctgtcatacctacttatcctgaaccattactaccaaagggatgtagtttttaaatcaagcagatctgtggcaatgcaaaataaaatacaaatttgttagaacagtaaagtttgctttaatggctacagaaagaaggcggtaatattttcttttttaaacacatctagttctggcagcaagttatattatgcatttagagcaataggtgccctgaaagttattgttgctttttttgtttagttatattaacagtttgtgcgtatacattgattccaaaaccaaacacttttgacaaatatcatcctcaatgacccccattaattctctctccagaaggtgacaattttagtgaactcaagactctcactgataatggtatttaacaatgaaaccacatggaaaaccct

SEQ ID NO: 604053 - DNA, 1085 bp, Homo sapiens
  misc_feature (789)..(789): n is a, c, g, or t
agcgggcctgccaggcactcaggaggcgggggcgcagtggaggaggcggcgccatcgcgaagcggagcgcctcgtcccgcacgtacagccgttgctcagcccggcccgcagtctcaggctggacttgggcggcgatttgcgcagaggctccttcggccaggccccctgtccggaccggagccgtgcttgagaccccgggcagcggccagcgttgggaacgaggaggtggcaagcgggtccgggggaaggcctggaaggccaaggcgaggagaacccaaccgatggagacccgttacaacccttgaaagacgtccggctggtttaccagcgtttaagtcgacaacgacagcggctagactttgaccaggattccaaccaggaagtcatttacccagtgccgcagcccgttttagaagggaattaaccccttatttgttggcacatggtgcaacatttgcaccgtgcatatagcaacaggggccccccgaggaaatcttcccgaattcattacggatgcgccagcgaggttataatccaaaggggcgccggcgaattaggtcactcatggcccactccaagaagttattgcgccgatggaaaaagccatccaataagccagttcacaatttcctccccataatacgcgggcgtacaaatgggggtacaggaaattgtgtgagaacggtgtgaggcccaacggacaccaaattctgggatttgggcaggcccaattcatacaaagcgggccaaattcgaattcccccttggaaagacacgtgtgggggcganccacatgggccagttttcgcagggtggcgcaacgtttaactttcacacccggcggaacgcacgcgccaatttcacatttataagggccccagaattcccaattagtgacgggttttgataattttgccccagaaccgaagacaatacggggaacggcaacggggacgacaggccaagtcaacgagggtatatcccattcagtaagcgaatttttacacagcagttccccatttggaaggcgcaaccaacgggaagatgaaaggacgaccttatggctcaccaaagacacaaaacat

SEQ ID NO: 604054 - DNA, 813 bp, Homo sapiens
actggcctgggcaacacggggccacttcttgggagcttgggccacaatgggcttgaccggggagcgaaaggttccgtggaaccagattcgcccgcacgttatgtcccagccctggggccaacagtagccaagccaggagctccgtttcgaattaattaatagaaggctttccaggaccttttgatgcccccttgggaataatgggaactctctcccattggggaggagaggcgtcttttaagaaggaatagccctatttgagatccccgccgtagaccctttaggagttgaccctcgagcctgagaaggtaaggagagggtgtaggagaccccctgactctgagccttccaaccctgctcattcctctccacgggcagtcccgccccctctgatggccacatctggtgcccggtagtttctcgtaaagatctacactcacccttaccaccttgacatccccctagtaggtatttaccccagacacctggaagcatgtgtgtgaccccaagactcgttaatgagatgccactctatatgttatagcccaaatttagcgcaccatcccaatgttcatcagccggtgagtggtaaaaccagttgtgatatgttcattaccatagttgctactccagtaataacaaaggaatgagctcaccagataccagataaggaaacttggaggtgatatgttcataattttgtttgggtccaaggtttcagggatgtatacatgtgtccaaacatatccaaccgtattatttaaatacctgctgcttattgtatgtccattatatttccattaagctgttata

SEQ ID NO: 604055 - DNA, 365 bp, Homo sapiens
cctctatcatcactccccggagtccgcctcctgggttcaagtgattctcatgcctcggcctcctgaatagctgggactacagctgtgtgccaccatgcctggctaatttttgtacttttagtagagacagggtttctccatgttgcccaggctggtctcgaacgcctagactcaagcgatctgcccgcctcggcctgccaaggtgctggggttacaggcatgagccactgtgcctggccagcttttttacttcaggtgattttttacttcaggtaatatgtttttcacttctaccatttccacctgctgagaacgtctgtcttttcactcattcttggggtgtccactcttgccgcggggagtga

SEQ ID NO: 604056 - DNA, 884 bp, Homo sapiens
tctcgggctccatccaggacaagagggatccattcagaagttcgtgccctgacctcatagcaggcatccaacacggctgccaggatatcggggcccgcagcctgtctgtccttcggtccatgatgtgctcaggagagctcaagttggagaagcggaccatgtcggcccagattgtagggtggtgtccatggccgtgctagctcttacagtaaaagcggctgtacgtgaggacagctggtggaggccgaggtggtggaggggatgcaaccccgagtgtccgacttgtgggcacagcgcatccctccataactgagtggtccactagatttgcactacgggttctccagctccttgtccaggcagagaggaggggaggtcctgaggggactgatgcccctcactctggttatgcccatgctagagtcaggagctgctcccgggggcaggcgtgccctgggagcctcccctccgagcggcagacagcaggctctcaggccctgcgcttgctcaggtctttcttgctgcagctgtccagcctggccccacccagggcaggcggcctcctggttctcctgtagggcacctccctgccctagcctcccaggaaatggtgctctcctggcctgctctggccttcccgggcgtgcccctcagcatgtgggacttctgagttcctgacctaggccaaggggggggtctctgccccttcccggcctggctaccttgggtctgtctcaggcgtcccgtcctggcatggtagaaatgcctgtatggcgcgctgcatctgaatacacgtcctaggacatctcctctctagtgagaagtacttgacctggcagggtcggtaatcggaatccaaaaaacggttggggaaaaagcgactc

SEQ ID NO: 604057 - DNA, 476 bp, Homo sapiens
  misc_feature (395)..(395): n is a, c, g, or t
cccctggggcgggccccaggagactgaaagtgtgggggtggctgctgctgccgccgccgccgcggcgccgccgctgcgccgctgtaagctggcaggcctgggccgggcctgggcttgagcccgagcttgagcctgggctggagcttgagcctgggccagggcccactgctgccgcagccgcagcagcctgcacctgtcgctgaagatcaggcgggttgcgttcgcgcacatgtttcataaggtatgttcctgaagagcacgcccgactgcagatagcgcaggtgtacaccttggcatgcttcactgtgtgcgtagacaggtgcacctctagtgaggctgcatccgtgtacgcccgatgacagttgtggcacttgaagggtttatctttgttgtgntgccgtctgtgggactgcagattggagagttgtgtgaaggctttctcacagcctgggtgtgcacatttgtatggtctatca

SEQ ID NO: 604058 - DNA, 774 bp, Homo sapiens
  misc_feature (176)..(176): n is a, c, g, or t
  misc_feature (178)..(178): n is a, c, g, or t
  misc_feature (230)..(230): n is a, c, g, or t
caggccgtgggtgcggagggcggcgccgcgggccgggggccgatgggtcctggcggacgcgaggcgccggcgcggggctcgcctggactcgggtgtgcggggctgtgagggggcgaggcgggcgctgcggcccgcccgggatgggccagccctggcctggcggggctgagccgaangnagggcggcgcgcgggccaggcctgccgggcgggcggccgggggttgaggtanaagtgggcgcggaggaaggggccgagccaaggcggaaggggagcggcgaggggggcggaggctgggccgcgtggggcgaacggagcggcgcgcctgtccggagctcggcggtggcgccggagaaaggctgcagcggtggagagcgggcgggcccggacaagcgtcggagggtggggacagaggcgccggggggccccccaatggaaccgggtgtgtgggcgcccaagaaagatcctcgggcagcctccaacggagaaactcggaggggcaacgggagttgctcctaggtcgaaaccaagctgtgaaaaaaggagaaaccaaaaatggaaaaagcgattatccttatgaccagaatggacaatctaccggcagcaacggagggatgcaatttggggcgataccagcaaccaggcttttggaaggccggaaagaacgattcgcggatgcccttgaaagggcttgttgcacattgccttctgagagcaatgatccatgaactggacaccaagacatcatggatgcgtgcaaacataacataccacct

SEQ ID NO: 604059 - DNA, 349 bp, Homo sapiens
ggcctcaaaaggacagtatccgtaatggactggagtggcccagatctttttacagaagaaagaatacggtaatttggccacgcgcagtggctcatacctgtaatctcagcactttgggaggccgaggtgggcggctcatgaggtcaagggatcaagaccatcctggccaacatggtgaaaccccatctcgactaaaaaatatacaaaaattagctgggcatggtggcacacgcctgtagtcccagctattcaggaggctgaggcaggagaattgcttgaacttgggaggcagaggttgcagtgagtggagatgatgctgttgttgcactccatcctgggcaacaagagg

SEQ ID NO: 604060 - DNA, 378 bp, Homo sapiens
gcctactttgctcttccaggacttacccaagaaggtctttttagggtgaatggtaacgtgaaggtggtggaacaacttcgactgaagttcgagagtggagtgcccgtggagctcgggaaggacggtgatgtctctcagcagccagtctgttgaagctgtttctgagggagctgcctgacagtctgatcacctcagcgttgcagcctcgattcattcaactctttcagggttagtacaataaatccttttaggagttaaaacaactttactaggctgcacgtggcccacacctatacccaacactttgggagctgggtagaaagattcttaaccggagttgaaaccccgtgggcaaccaagcaagacccccatctctac

SEQ ID NO: 604061 - DNA, 276 bp, Homo sapiens
caggctgctcgtggaggctgaggggggagaatcgcttgaacccgggaggcggaggttgcagtgagctgagatcgtgccaccgcactcccccagcctgggcaacagtgtgaaactctgtctcaaaaaaaaaaaaaaaaaattccagtatttggttaaagtttccatagggcttccgggaattctagttctcctttaggagggatgcctttggatctcatatttttggtttaaagaattgattgtgtggcaagagttctggttggacaaggggaaaca

SEQ ID NO: 604062 - DNA, 476 bp, Homo sapiens
agcggctttagtgatgtaagcccggatggttacttgcgcatatgatttgatagaatggttacgctcaaatacgcgccgcctacatacactagcatctggttgtgcttggacagtagatcctgatagctcgcactcggcaagagttgacagcatggcgagtgggcatatgaagagagatctgccaagagatcaacagataactcatcttttgtgaacagtgtatacacgtacgatcagctaatgcccacaaaggatacgtcttgtcagatatccaccgttggacaaaactgtcgtcaaataatgtgaatgtcttcatgagatcctgctcttaaaccgcaaggcccgacgggaggccaatgtcaagtttgaagagagatacaatgacaggcaacgaacaagtggttctatccagaaactgcggttttagcatgctttgtctgtgactcattaacaacattataacggaacacaacaca

SEQ ID NO: 604063 - DNA, 326 bp, Homo sapiens
tctcccctgttggttctttcctatgtgaacccaaaagtatctaagacagagctcaatcaacttagaaagtttattttgccaaagttaaggatacagcgttaacatacagcctcaggcggtcctgaggacatgcacccaaggtggtcggggtacaggtttttattatttttgtttgtttgtttgttttttgagacagggtctcactctgtcacccaggctggagtgcagtggtgcgatctcgactcactgcagcctctgcctcccgggttcaagcagttctcctgcctcagcctcccaagtagctggaattacgggtgtgctttcac

SEQ ID NO: 604064 - DNA, 179 bp, Homo sapiens
tagcgccacaatgtcatagtgccacaaggcatagcgcacacaaggacatagcgccaccaaggccatagcgcgcacaaggcaggtggcgccaccaaggccatagcgccagcaaggccatatctgcccacaagagacatatcgcacacaaaagacatagagcccaccaaggccatagacga

SEQ ID NO: 604065 - DNA, 581 bp, Homo sapiens
cgatcatggccatcattgatctctgtggcttacaaatcattgtataatggaagtagtgggtgttatacacaaagtcttgctctgtcacacaggctagagcgcagtcgtgtgatcgctactcattgcaacctccacctagcaggttctaccaattccactgcctcagcttctcgagtagctgggattacaggcacgcgccgccacacacagttaattgttgtagttttagtatagagtaggtttcaccattttggtcagactggtctgcaactcctgacctcgagtgatctgtccacatcggtctcccaaattgctgggattacaggcgtgagccaccggacccagctcagactgttaacagagttttaatagcctcaaacatggttctataggatcccagacaatacatatcagattttaaccattatgttatctacatgttctctgtgactcaagtttgacattagcatttgcaccccaaatgagttcccctacatatataatttgttcatgttgacacaaagaacacaaagcgagtatagatcccgcagtaagttgtcacaactcttaataagattaac

SEQ ID NO: 604066 - DNA, 313 bp, Homo sapiens
ggttttttcccagcagatcgggggaccggatgttggcattttgggattcaggtccacaaaggttcaggcctggccccagctggccctttaggttgtttggtgttttgggcccgggggtgcccgtgtttttgccggcactcagggagttgttttcccttgggactccatgcaactttccgtttcggattccagggcagggcaaggcgggttgtttccgtccaaccaattttctcacttgttttgtgttctgtcatccttgttttttttttaaaaatacactcccctccccccccgccacacccctttcagttca

SEQ ID NO: 604067 - DNA, 629 bp, Homo sapiens
tcatgtccatgcctacagataagtgtattgttctccaacgggacttctctgaagtcatgggcgcccgtgactgggaggaagctgtgaagatgcctgtgggcatgcatccccgtgcgcgctctgggcaacgtcgctggcctgtgatgcatgtgaacacagctatctgggggatttgagccagccctgtggcctcgacctgttgctcaacttgctcactgttgctgtgccggggatggtggccacctcactggacctgctctccgtgacgctggcctctggtgctcccgctgtttctccttcctgtctgtggcctggtggcttcgtgtcagatgtggatatccagagcgagcgcttcagggccttgggcagtgcccgcattcacacttgggacacggttgctgggcctcgccacactgcaacacctaccgcggacgggccctctcccttaccatccccacgcaacatgtgtgaaacctgtgcccattctgtcccaagcacatggccacatgagcgcaggcccttcgttgccaaagtacccggcagctggccccataaaccccaaagacaccacgccacaccgaccacacgggaccacacgtccacaccacctatgcaatcgcaacaagtag

SEQ ID NO: 604068 - DNA, 794 bp, Homo sapiens
gctaaacctagccccaaacccactccgacttactaccagacaaccttagccaaaccatttacccgaaatcaagtataggcgatagaacattgaaacctggcgcaatagatcatagtaccgcaagggaaagcatgcaaaaattatagccaagcataatatagcaaggcactaacccctataccttctgcatcaatgacattaactagaaatcaactttgcaaggagagccaaagctaagaccccctgaaagccagacagagctcacctcaagaacagctaaccagagcacaccctgtctatgtagcaaaatagtgcggaagatttataggtagaggctgacaacactaccgagcctggtgatagctggtttgtccacagatcagcaatcttcagttcaactttcaaatttgcccacagaaccctctaaatccccttgtcaatttaactgttagtccaaagaggaacagctcttctggacactaggaaaaaagcttgtcgagagagtaaaacattaacacccatagtaggcctaaaagcagccaccaattacgaaagcgttcaagcttcaacaaccactacctacaaaatcccaaacatatactgaactcctcacaccaatttggaccaatctatcacctatagaatgaactaactgttagtcttaagttacattggaacacattctcctccgcataaagcttggtacaattcaaacactgacatgggcaatacacagccaatatctacaatcaacaacaagtcattattacctcactggcaaccaaaacaggctg

SEQ ID NO: 604069 - DNA, 628 bp, Homo sapiens
ttatggccgggtgggtggagaaattaatttagacgttggtttgcaataaaaagaattcattttaaaaaaaaaaaaaaaaaaaaaaaaaaaaaaaaaaaaaaaaaaaaaaaaaaaaaaaaaaaccataaaaaccacctagccccaaccaactttaaactcaaccaacctaatccatcgcgcccgcatttcaaccaaattggcccaattcccccaaaagggacccgattaccaatcaacggcccgccgtttaacaacgccggcactggaaaaccccgggcgtacccaacttaaaccgcttggaagcaaatccccttttccccagctgccgcaaaaccaaaaagccccgacccaaccgcctttcccaaaattggcccaccctaaaggccaaaggaaaatggaaaccgcaaatatttggtaaaaatccgcgtcaaattttggaaaacacacccaatttttaaccccaaagccccaaatgggaaaaaccccttaaaatccaagaaatcccccgaaataggcttgaccgtcgccccactccgccccagcgccccccttctcaaacccgcgccctcaaccgtcaaacgggtaaacaaccgcttaaacaggcgccctacagccaccctaatccacc

SEQ ID NO: 604070 - DNA, 491 bp, Homo sapiens
gtatgttttaacaacaagaagagagttagacccacagagacaaccctcactcgcgcgggggtttgtttttattcttgttgttttttttttcacaacagaaccactcgtaccgcagcacagagtgaatcacaaactgcgagagacggagtggtagcaccccccaccgtcgaggagcagaccccccctccgatctagctcactcctcccgcacgctgtcactactcactctacactcgctcagctgtccacactctcttgctgtgctgcccccgcgcgtgacggggagagcgcgtgtctatgagtgtgtctctctctcctcccaactgctcccggttttttctcgtgatattgttggctacccttcttcttccctccccctttttctttgtttctccttggcggtgttattttttttcccccccccgggtggggttttttttcccccccccccttgcctgttttttttttaaaaaaaattttttgggggggga

SEQ ID NO: 604071 - DNA, 414 bp, Homo sapiens
ccgaggcccagaggtcgcgcgacacaggcagctatgacctagctgctagcctctaccgctggcagcgcagggagtaggctgtgctgcagcggcggacacactaccactatggcggaggagcaacatcccggcgacatgcctacactgagcactaacctagggcggtataccgctcggagtccgagcctcatggagccatggtggggccgacacagggggcagcgcctgcagctggaagcggagcccataccgactgcggaaccgaccttgcaggcaccgaaaggcgcagagcccagtcggcaggggcaaatagtgacgccagtatgaacgatgcggatgaaagccattcatcggcccaggacactctgcatcagctacggcacacagggatgtgcagacagtttataggcgccc

SEQ ID NO: 604072 - DNA, 452 bp, Homo sapiens
tatctgaacttagggtcgccacatcataggatcctgcttactcacgcttgtcatacgggtctctctggcagtaatgaactttaacactctcatgggcatctcccacccacctgagcacaggctagcgtgcttacattttttacttattgagacagggtctctctagtcgcccaggtctggcaatgcagtaggtgcaggtcatggactcagctgctagcctcaagcctcccagtgctcaaagtgattcctcccacactcagtcctcccgtagcagctggagactataggcacacagcaccatgcctgactaatttctgtatatttagtgaacatgggttttaccatgttggccaggctggtctcaatttcctgagctcagatgatccgcctgcttcggtctcccaaagtgctgggattacaggcgtgagccaccgcgcctggtgagccctctt

SEQ ID NO: 604073 - DNA, 563 bp, Homo sapiens
  misc_feature (38)..(38): n is a, c, g, or t
  misc_feature (56)..(56): n is a, c, g, or t
acccggcctgtccgctgctactgggtaagggccccagncctggagactggagaagnagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactc

SEQ ID NO: 604074 - DNA, 407 bp, Homo sapiens
agaattgctggcgttttttgctgcacactggatggcttctgccacaagtgtctcagcagatcatatcttgctgtccagacctgcctgcttggcgtcgtggagtgagatccggtcaccggtgaggaccatctccatcgccagagtcttctcacaagcacgggtgagtctgtgggtgccgccagcacctggtatggttcctattaagatctgcggctgtgcgaactgggcgttctcatcggcatagatgatatcacacgtcatggctagctcagagccaccgccaaaggcatagccattgacagcagcgatgagtggcttcttgacctgggtgaggtggtcccagtgcttcaagaccgtgctggagtatcagtcctgcaaactcaggttctgcatttcgttgacatcag

SEQ ID NO: 604075 - DNA, 866 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttgga

SEQ ID NO: 604076 - DNA, 923 bp, Homo sapiens
tatgaggccaccatcattctgacaccaaaatctggcagaaatacaacaacaaaaaagaacagttcaggccaatatccctgaagaacactgatgcaaaaatcctcattaaaacactggcaaacagaatctagcacccatcaaaaagcttatccaacaacatcaaattggattcatcccaagggattcaaagttggttcaacatatgcaaatcagtatatgtaattcaacacattaattgaatgtaagacaaaaaccacattattatctcaatagatgcagaaaagacttttgatacaattcaatatcccttcatgctaaaaattctcaataaactagatatcgaaggaatgtacctcaaaataagattcatatatgataaacccatagctagtatcacactgaatgggcaaaagctggaaatattccctttgaaaaccagcacaagacaaggatgccctctgtcacccctcttttttaacataatatgggaggttctggccaggacaatcactcaagagaaagaaataaagggtattccaataggaagagcaggaaatcatttccctggcggttgcatttcgccggtggcaaatcctatatctagaaaaaccccaaggtttctcatgctcaaaggttcttaaggcgataagcaacttcacaaaaatcttcaggctccaaaactacatgtgcccaaatgctcgcctttcttatatacccacattaaggcaagcagttaagccccatattgattgaggccccttccaattcctaagagaataatactttcggagaaacctacacggagaaaggagaactccagggaaaaaaagcctcgtcggaggctaaggcgccaccgggagaaaacggcccatgaggagagacacgaaaggatctccacaaaaaataacaggttggttgcaaca

SEQ ID NO: 604077 - DNA, 898 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttggataaaagtcttatcctggcgggctgctgggccc

SEQ ID NO: 604078 - DNA, 388 bp, Homo sapiens
  misc_feature (210)..(210): n is a, c, g, or t
  misc_feature (299)..(299): n is a, c, g, or t
gaaaccaatgattgtgaaatacagttctatcaaaatttttaaaaacaacgtttgtaatttggcaacacacatgcttctttattaaggcattaattagggagttctcgcagtgggtctaagcactatcataatgttgaagcagtggtgagcataaattatgctattttgagagatctgcaacagtggtaatgtgataggaggaaagtatcntgtgattaaattggtgacagtcacaggttttgctaatactaatgtggtcttgttgacaacatgcataactggaaggaaaatgtcaaacngtcagcttgagaacaagaaaagctgtcgtttttttcttgggctatctcagttctttgggctccttgcagggtcttccactgacctcagg

SEQ ID NO: 604079 - DNA, 862 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactc

SEQ ID NO: 604080 - DNA, 219 bp, Homo sapiens
  misc_feature (16)..(16): n is a, c, g, or t
  misc_feature (24)..(24): n is a, c, g, or t
  misc_feature (26)..(26): n is a, c, g, or t
  misc_feature (67)..(67): n is a, c, g, or t
  misc_feature (181)..(181): n is a, c, g, or t
  misc_feature (184)..(184): n is a, c, g, or t
  misc_feature (195)..(195): n is a, c, g, or t
aaggtaagtcagaagnggaggagnangcgcgaaggcggttgggtcatccgagatcattaaaaagggntgaccgtaacaataggtacgagaatagtaaaatgtgaataagaagatacaaacaaatttccttttgaaggtacttttaagaaaaaaagcaggggcttggaagtttgggttcttnttncctcccctgtngcaaattctcatggtttgggttgg

SEQ ID NO: 604081 - DNA, 1067 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctggaagcaaaacgaagacccgcaaccaaagagaaaacccgccgggggcacattgcggggcggggacacaacaggcctcaagcggcccggtccagcgtccggccccctttcttgcacaggggaacgcgggccccagggcgtaaccgacccggcacgagcgccaacgcgccacccccaacgcggggactgcacccgcgcgccacccc

SEQ ID NO: 604082 - DNA, 113 bp, Homo sapiens
ttgcagctctctctactgttggcagtactcatgctgcacttgcagacagccatgttcaggctgatattccatagccactgtctggtgccctgcgctttcgatcactcagaatt

SEQ ID NO: 604083 - DNA, 985 bp, Homo sapiens
  misc_feature (802)..(802): n is a, c, g, or t
gcagcccagtggctatggattctattttctatgggactgtctacgccaggcttaattttctctttgctcagataacttctgactaagagtcgacgggtaggcattatacaatgggtttaaaataacgtattctcaagaccttcatttttcagccatataaatttgtaaggaatcaggtgtttaacaggtacgtgaaaccatttggctagatattgggtccttagtttttttatttattaagtttaacaaatcttaaagtttttagatagaggataaggctaaaggattgtcacagagagtataaaatattggcgagacaagctattttgaacaaacaatgtgggaatagcaattgtttaacttggaatgtgtaaaatacacaaattggatggtcttgggtgtaaactctttggggaaaggcatattagacaaagacgtctaagcagcattcttaaaagtgttgtgtggtggacaaatttgttataatattgtcgagagacgagctttgggtgtggggagagaggttaaaaacatgtgggttgcgtgacactttgtgaccatatacgggggctcaaaaatgagggtgtagacaaactacggttaacagacgaagaaaacggctcccaaagggcagagacggcgcacaaagcactgggaggtccgtacaacagaggtgtgggccaagccgtcccccgaggacacaataacggggcggggaacataagagaggggaaccccagcagattcttgggggacgacataacgttcatgacccaagcctgttctctaaccccgcctaatnagaaactttccatatgatgagtgccccgcgtgagacgatacgcctttttaaagaggctcaccttttaaagactccccctgttgtgggggtcgtttgacacacgcacagtgtgtatatcaccaacttcttgtggcaacggcgggacaaggtgattagaaatagttggaggtggtaatagttcta

SEQ ID NO: 604084 - DNA, 1022 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttgga

SEQ ID NO: 604085 - DNA, 863 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactc

SEQ ID NO: 604086 - DNA, 1022 bp, Homo sapiens
  misc_feature (762)..(762): n is a, c, g, or t
  misc_feature (768)..(768): n is a, c, g, or t
  misc_feature (772)..(772): n is a, c, g, or t
  misc_feature (823)..(823): n is a, c, g, or t
  misc_feature (828)..(828): n is a, c, g, or t
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctagggcccaagccccccaaattnagggtnttgnttctccccgggtcctgcagccccaacggggggggtttgcttttaaaaaacnggggncccagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttgga

SEQ ID NO: 604087 - DNA, 912 bp, Homo sapiens
  misc_feature (336)..(336): n is a, c, g, or t
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtcccttactcagtagcaggcggacacgccatggtcaagacacnttaactgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctaggaccaaagcacccaagattcagcgtcttgttactccacgtgtcctgcagcacaaacggcggggtattgctctgaagaagcagcgtaccaagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttgga

SEQ ID NO: 604088 - DNA, 143 bp, Homo sapiens
atggtggtgcacacctgcagttctagcaattcaataggctgaggtgggaggatcacctgagtctatgaggttcaggctgtagtgaactatgagcatgccactgcacttcatggtgggcatacagagccagaccttttctcata

SEQ ID NO: 604089 - DNA, 867 bp, Homo sapiens
  misc_feature (607)..(607): n is a, c, g, or t
  misc_feature (613)..(613): n is a, c, g, or t
  misc_feature (617)..(617): n is a, c, g, or t
  misc_feature (668)..(668): n is a, c, g, or t
  misc_feature (673)..(673): n is a, c, g, or t
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaattaaagaaggtaagaaacctagggcccaagccccccaaattnagggtnttgnttctccccgggtcctgcagccccaacggggggggtttgcttttaaaaaacnggggncccagaaaaataaagaagaggctgcagaatatgcttaacttttggcccagagaatgaaggagggtaaggagaagcgcccggaaccaattgcgaagagacgcagactttcctctttgcgaggttttacttttaagtttggatcccggcagaaataagattttttggggaaccaataaataaggtccggctttgga

SEQ ID NO: 604090 - DNA, 804 bp, Homo sapiens
cagatcacagccccttggcccgaaacagtgaggaacgtctccagcaaggcctgcaggccccacggaggagtcaccccccagtagcgcctctagcgtacccccagaaccacctagctgggcacgagagcacagacaaacgcaccgacgccagaaccagaaaaaacagacaagacgagaagaaaagagagaaagcacactacacaccacatcgacaagcgaaacacaagaaagcaaacaagaggacagcgcacccacaccccagaccgcacgagaggaacacacggagggaagacagcgcaagcgacccaccagcacagaggagagacgagagagaagaccgcgcagggcaggggacaacacaccgacgccagaacggagggacgagaagagcgcagcgacaaaaagcagaagcagctagcacgacgaaccgcgcgagagcactacccacccacgaacgcgaccgagaggagaccgccccgccagcaacacggagggagagaccagcaacagacccgcccccacgccccccgggaggagaaacagcacaaagcgacaacaagagagcacgcacaggacgcgacgcgacgaccgaaacacaacacaccaccacacaacaggagcagacaagaagagaggaggaagacggacaccacccacggagagaaagcgcagacacaagaggcgggacggaacacccccgcccaaccacgcagacacaaaacgagaaagcgaacgcacgagaagcagaacaaacacggaacatgagaaccacccccccacggagcgacgagcaaaaggacacac

SEQ ID NO: 604091 - DNA, 195 bp, Homo sapiens
  misc_feature (44)..(44): n is a, c, g, or t
  misc_feature (47)..(47): n is a, c, g, or t
  misc_feature (66)..(66): n is a, c, g, or t
  misc_feature (71)..(71): n is a, c, g, or t
ccagccttgggaactttaaattccttttgcgagaggcggagaantcnttccccaaatcttttgggnacttntctctctttacccacctccgcccctgcgaggagttgagggccagttcggccccgcgcgcgtcttcccgttcggcgtgtgcttggccggggaaacgggagggcccggcgatcgcgcggcggtcgc

SEQ ID NO: 604092 - DNA, 765 bp, Homo sapiens
  misc_feature (416)..(416): n is a, c, g, or t
  misc_feature (423)..(423): n is a, c, g, or t
  misc_feature (434)..(434): n is a, c, g, or t
  misc_feature (445)..(445): n is a, c, g, or t
  misc_feature (448)..(448): n is a, c, g, or t
  misc_feature (457)..(457): n is a, c, g, or t
  misc_feature (459)..(459): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (476)..(477): n is a, c, g, or t
  misc_feature (487)..(488): n is a, c, g, or t
  misc_feature (491)..(492): n is a, c, g, or t
  misc_feature (498)..(498): n is a, c, g, or t
  misc_feature (512)..(512): n is a, c, g, or t
  misc_feature (519)..(519): n is a, c, g, or t
  misc_feature (521)..(521): n is a, c, g, or t
  misc_feature (527)..(527): n is a, c, g, or t
  misc_feature (531)..(532): n is a, c, g, or t
  misc_feature (535)..(535): n is a, c, g, or t
  misc_feature (564)..(564): n is a, c, g, or t
ccacgccctgcccccccccgccacgccttagccccccgacaccagcccggcatacggcagcgcccaggagcggtggcccggcgccctcacatcgcggcgcctcccggcggggacaaagacaggtcatcgccacgaaggttttgggaaccagtaaaatggttcacatgtaaggaacggatatggtttcatccaccggagatgacaccccaggagagatgtatttgtacacccagactgcccataaagaagattacccccggaagtacccttcgccagtgtaggagatggagagactgtggagtttgatgttgttgaaggagaaaagggtgcggaggccagccaaatgttaccaggtcctggtggtgttcccagttcaaggccagtaaatatgccagccagacccgttacccttatanacgctanccacgtcgtangggtcctccangcnattaccagnanattanccagantngtgnnagtggggaannganngagggntcggagagtgctcncgaaggncnggcccnacanngcnggccctaccgcaggcgagggttcccaccnttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaaga

SEQ ID NO: 604093 - DNA, 541 bp, Homo sapiens
  misc_feature (192)..(192): n is a, c, g, or t
  misc_feature (199)..(199): n is a, c, g, or t
  misc_feature (210)..(210): n is a, c, g, or t
  misc_feature (221)..(221): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (240)..(240): n is a, c, g, or t
  misc_feature (246)..(246): n is a, c, g, or t
  misc_feature (248)..(248): n is a, c, g, or t
  misc_feature (252)..(253): n is a, c, g, or t
  misc_feature (263)..(264): n is a, c, g, or t
  misc_feature (267)..(268): n is a, c, g, or t
  misc_feature (274)..(274): n is a, c, g, or t
  misc_feature (288)..(288): n is a, c, g, or t
  misc_feature (295)..(295): n is a, c, g, or t
  misc_feature (297)..(297): n is a, c, g, or t
  misc_feature (303)..(303): n is a, c, g, or t
  misc_feature (307)..(308): n is a, c, g, or t
  misc_feature (311)..(311): n is a, c, g, or t
  misc_feature (340)..(340): n is a, c, g, or t
cgattatgctgcagagggcatatcaagaatcgtcgcagtgctgtagctccgccgtgtctgaaatctggagacatggtgacgtgcgtggttgcttaacgggaagctgggcggagcggtatatcttgtaccaggtccagtgtggtgtctgtatctcaggaccgcaatgatgcacttgtaccgtaaacttaatanacgctanccacgtcgtangggtcctccangcnattaccagnanattanccagantngtgnnagtggggaannganngagggntcggagagtgctcncgaaggncnggcccnacanngcnggccctaccgcaggcgagggttcccaccnttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaaga

SEQ ID NO: 604094 - DNA, 287 bp, Homo sapiens
cttgttatggtgatctccaggtatttgcctggattttgaaatcatgtaaacattatccacgtgtctgtggctgtggctgtggttgggccctggcaggtggaagaccatctcccagaaatctgaattcacctgccattgacgcagattaccctggccctacagcctgcttgctccgcctataccacagagcacagcctggacattatggtgggtgtgtgcggtacggtccacatctgggtcctccatcgggaactttccatgcttctttctccatctgatgtctatgg

SEQ ID NO: 604095 - DNA, 436 bp, Homo sapiens
  misc_feature (235)..(235): n is a, c, g, or t
atgtaacgggtcctggtgagtgctccagtccaacgcacgtgaatatgcagcggaccggtaccatgtatagaggcgatccacgttgtacgggtgctcacatacaattaaccagcataatgatacagaaatatatgagtagctggggaatccgtactagaagtcgtacgcgtgagtgcttgcgagagtgcaggccgaacgacgccggaccaagcggaggacgtaggggttcccaccnttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaaga

SEQ ID NO: 604096 - DNA, 335 bp, Homo sapiens
tctctttttgccctcgggaaaaagcaaaaaatcaatgtttgggggcctgggtaaagctcagggggtaagaacatctttttgtttaggttttctttcggctctttattgaagccaacccctccccaaaaagaaaaataaaagttttcagagaaactaattttttttggcaagagtattacttaaaatttgggcctcctaaagtttccctagttagaactgggacccctgggctaattgtcagcttacaaatcattgtaaagagactgtttattttgtcccaaactgatttcaaaagtactccattgaaaataacccggggacggttttttttcata

SEQ ID NO: 604097 - DNA, 350 bp, Homo sapiens
cgcagttcagaaaaaagagtctggagaatcgtccacggtgcgggaagcatctcggtttcttctgctttagtctctcaggaaggctgtcgccgtgcgtgcattaaatagttatgtacatcgcagagagtcccaggcatggtcaggtgcgggaggggctgtcatttcaccatgggccgagtaccatcatcgtcaccgcacttgtttagctttgtactttatcacttcctgccatgtactttggccacgcgtaacctttacttgtaaataacctcatcctctgtcttctgcttcattggataactattcccggcttgagggctagtatgtacccgcctactgcgtagggccac

SEQ ID NO: 604098 - DNA, 387 bp, Homo sapiens
agatgattccccaaagtacaattaccatttggactccagtggtagctatgtatttgagaacacagtggctacggctgatggctctgcgcagggagaagtatgttcgtgtacgaggtgtccatcaggccacgagtgtggatctggtgctggacatcgaacctgtatctatgctgaacgcaaggcaggccatatctattacgaaggctacctggtgaaggtgtgatgacagcagtgatgattaaacagagtttactgtgaagaatgctcaggtccgaggagggtatgtgctacacattggaaccatctacggtgacctgaaatgtgggggatcaggtctggctgtatattgataagccccgacgaagacccatcatgagcaaccacaca

SEQ ID NO: 604099 - DNA, 314 bp, Homo sapiens
ccccaaaaccccaacaaaaggggcctttcccccaggggttttttttgggaggtgggccccccgcggggggggccaacttgggttttggggggggcaagcccccccgaaaccccggggggggtcccttcccccccccccccccccttttttaagggggggggggggcccctgggggccccctttttcccccccccaggggggggggggggccccttggggggggggggcccccccccccccccccccccccaaaagttttttttttttttttttttgggggttttttttttttttttaccttaacccctttccca

SEQ ID NO: 604100 - DNA, 219 bp, Homo sapiens
ccttgtgatccacccgcctcggcctcccaaagtgctaggattacaggcgtaagccactgcgcccggccacgtcttcctttttttagctttgctttgagaaatcggttcttatcttggattccattacaatgggcctcctgccctttgggtttttcaagtgggtcccttaattttccctttcccattcccaattataaagattccctaagaaacttggcc

SEQ ID NO: 604101 - DNA, 118 bp, Homo sapiens
gttagttgcacggtcctattcctgacatgctagagtgattgttgtttcgagtgctagggcattttaccgtggaaaatgtagaggctcaggttaatggctggtagtattttttattctg

SEQ ID NO: 604102 - DNA, 1053 bp, Homo sapiens
cagcactttgggaagctgaggcaggaggatggatcacttgagcccaggagttcgagacgagcctgggcaacatgatgagaccctcatctctacaaggcataaaaacattggctgggcatggtggtgcactcctgtggtcctagctactcaggaggctgaggtgggaggatttattgaggccaagagtttgagaccagcttgggtaatattatgggactcctctctatagaaaataaaattaaaggctgggtgtggtggctcacacctgtaattccagcactttgggaggccaaggcgggtggatcacctgaggtcaggagctggagaccagcctgaccaacatggtgaaaccctgtctctactaaaatacaaaattaaccaggcgtggtggcgggtgcctgtagtcccagctactcgggaggctgaggcaggagaatcgcttgaacccgggaggcagaggttgcagtgagctgagaccgcgccattgcactccagcctgggcgacaagagtgaaacttcgtctcaaaaaaaaaaaagggaacactttaaaaacttagctgcttgtgcttgcgtgtgcacctgtagtacgagctactacagaggctgaggctgaggtgagagaatcacttgagcccaggattccagaccagcctgggcaagatagcagattccatccctattttcccacttaagtcaaaaggccacgtgtggtggcccatgcctgttatcccagccttggggaggcccagtgggcggacctggacctggggcgctcgagacctccgggctaccggtgaactccggctttaaggggggttatcacaaattttccgggggattggttgaacgcacatggggccagcgcctgtatggtactgccaaaaatgtttgataccttgtgagcagggttgcgaaaccgcaatattttgtagtcacccagggggaggaagaactgtctgttaggaaaacaaaacagagggcgcgcaaaatgtgagcgagacgtgctatcgctcgttagtcgactgcaacaatagtaacggagctagcagcgga

SEQ ID NO: 604103 - DNA, 249 bp, Homo sapiens
gacgcttcaacggaactttgagcagatcgaccacgttggggcaagcatacaaagatagcctacgagcgggacctggagactagagcatacatcggcgacacctactgccacttccagaagatgcttgtggtcctgctccaggggaaccagggcaggaggaataacgtaatggggcgtggaccttggtacaacgaggacggtccaggacctaatacgaaggcaggggcaagggtaccgaagctacgaatt

SEQ ID NO: 604104 - DNA, 110 bp, Homo sapiens
  misc_feature (100)..(100): n is a, c, g, or t
  misc_feature (107)..(107): n is a, c, g, or t
ccagaagatacatacaaagtaattctcaatgtaaagctattcagctcttccaggttgaatgccctgtaacccctattttttgtcttccagtgtgcttcantgttggntat

SEQ ID NO: 604105 - DNA, 386 bp, Homo sapiens
  misc_feature (293)..(293): n is a, c, g, or t
  misc_feature (329)..(329): n is a, c, g, or t
  misc_feature (345)..(345): n is a, c, g, or t
  misc_feature (374)..(374): n is a, c, g, or t
gaaaaatgcaagttagctccctgctaccttggcgttgtcagtcctccacatagcactcttcagctcaaattgcattttataaaatccccagcaagcctttgtctcctggcagtcaactcgtctcttactgacctgcccattgctcccttgcaatgtattttcctactttctctaataaatctgcctttcttgacctaaactgtcatgggtaaattcttcttactcctatggtcaccagccacaggacagtcggccacaaggccatggacaagtcttgcggatttcatgggtcnttttttttatttttggaaggatattttccccagtgntttggggggggacagnagggatggccccacaatttttagggggcntaggtcacaagg

SEQ ID NO: 604106 - DNA, 258 bp, Homo sapiens
ctggaggacactatgcttggcggacatctagtgcttggcagcatcagttacacaggcaggaagaacaaaaaacaaaagctggccctctgactctatgcagatccaagttctttgcaggtactctacatgtccagaagtgagacacagtattggcagcattatcttagagaataccggtaacattcttaactgattaatgtaaccatgccatggaatattatatgtctgtcaaaatgtaggtagactgggcactagtgt

SEQ ID NO: 604107 - DNA, 211 bp, Homo sapiens
cccactcaaagctcactccccgcaaatccctaagccccgctacgttggtgatagcataacaaaatatatgtacattctcatcattagattgattgttgctgtccttgcacaactggtttaggaaaaatgaattattctgtcatttctgaagaatccacatcctgtctcttataaagtcagaacagaagggggcaaaaggttgtggtgagca

SEQ ID NO: 604108 - DNA, 1247 bp, Homo sapiens
  misc_feature (580)..(580): n is a, c, g, or t
  misc_feature (701)..(701): n is a, c, g, or t
  misc_feature (711)..(711): n is a, c, g, or t
taaaagtagttagcattttaatggaaactccctccagtgtgggcttcaaggccaccagggacacagggcccccccaaaactcttaatcttctcctcagtctcttctgggtggaaagaattgtgggctcttcacgagatgagacagggctggtcttggggcgacgctttcacctttctcccaaacacatctttggtgatgtacacgccacggtatcggcaccacccacatatcacatatggatatggggagcaaagccccccagagttctggtgtttaaacgcacagcatattacacaccccctgtgtgttctggtgtccctctgtggcaccaaatgtcgccaacaatatgtgtggtcgcaggtgtgtggcacaaagtgtgagggacagaaaggctcctggggtgtcactctctctataagaggtggggtacaaatgggctctcacaataacgacgagatctgtttccgcaaagagtaagcgcacctgcgggggtgagggactatatgtgggtgcgagaaaagggtgcgaggaacaccccgggcggagcggagatgagactgccgccaagcatcaactaancaccaaaggagtattcaacaacacgtggcggggcacgaggccagaggagagatgagataatacacgagggatgagctatggggcgcataaatagcgaccgaagaggcaccgtgattgagangccacagatnagggggggagatactcccaaccagtggtgggggggccgcccccattaaatgtaggtatcaccagcgagggaggagtgagcattacacacccataccaagaggtacatgaggaggaatgcggcggcacatgtgatggagagggacaaacaaagaaagtggcacaagagcacaaaatatccactcttcagacaaacaaaaatttgcaggagagaccccacccaacaatatttcgttggaaggaaggtagtataaccccaacagcagaagggaagaataccccgactccgaaagaacagcgcaacaaagtaagcacagaataagcgagtccccctctgttggtggggatccgcgggtcagacaaagaagcgacggacaaacataaaagagaccgcccgtgaggtagaccgaagggggctacactgggtgaacaagagcgagacacacaaaaacggagtgggaccacaggtgaacggagaaaatatcgccagggagctaattgaaaaagcgcccaggaggatgagccacacgggtgacag

SEQ ID NO: 604109 - DNA, 759 bp, Homo sapiens
gaggcatgaggcgtccggggcaggggcttctgctgagggggcacgcggagcttgaggaaagcgcatataagttggtctctctttgaaagatagagatgaatacaagtagttaagagaaatatagtcaataggttactacagatatcgcttagccgttaagttctgtaggcgtagtgttccaatgagcttgagatgtgaacgagaaaatatgaagacttagaagagtattcatgaggaaggaaaagatacaagaggttactgaaagcgatgacggaggttgagatgaagcttctggcatggagtaggaagatgtttgtaatcagagaatcgagagaaaggagttaacagagcctcgcgaattagctatcaatagaggggcaagcggttatacgacttaaataatgaaggtgatcttaaatagcttgaaaagtttagttttagaacgtttgtaagtggtgattagattaatttgaaggcgatgtgttacaaaatgagattatatcggagaggtgattaataggaccttgactatccatgaccgcagggagaaatgcggtcatttgaaaagcctagttaacgctatattactagaggcagatcgaagatggtgagataaagtgggtgagttgggaggatcgatgacacttttggagaaaggatcaggaaagttggaagtgggaaacagcgggcaatgacggaagtgcgggaaaggcgagacccgagaattggaggaaggatagggaaatttcgagggataaa

SEQ ID NO: 604110 - DNA, 368 bp, Homo sapiens
  misc_feature (23)..(23): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (127)..(127): n is a, c, g, or t
  misc_feature (130)..(131): n is a, c, g, or t
  misc_feature (155)..(155): n is a, c, g, or t
  misc_feature (161)..(161): n is a, c, g, or t
  misc_feature (167)..(167): n is a, c, g, or t
  misc_feature (189)..(189): n is a, c, g, or t
  misc_feature (195)..(195): n is a, c, g, or t
  misc_feature (198)..(199): n is a, c, g, or t
  misc_feature (203)..(203): n is a, c, g, or t
  misc_feature (213)..(213): n is a, c, g, or t
  misc_feature (217)..(218): n is a, c, g, or t
  misc_feature (221)..(221): n is a, c, g, or t
  misc_feature (236)..(237): n is a, c, g, or t
  misc_feature (258)..(258): n is a, c, g, or t
  misc_feature (261)..(261): n is a, c, g, or t
  misc_feature (297)..(297): n is a, c, g, or t
  misc_feature (359)..(359): n is a, c, g, or t
cgaggggggcgtaccccgttggngtgggggagtggggggggggggggggggcctcggggggggggggggggggggggtgtcgttggggcggcggggttttctcngngggggggngggggggggcccnccnnggcctcgggggtgggggcgggggntgcccnctcggngtccggggggggggtggcggcntttctnccnnccgnggcggccgcnccgnngcncgctccgggttgccnncgtccttttgtgggtgggggngcngcggggctcggggggcgggggttcgcttgtgtgggntggtggtctgcttttccggcggcggctgtgctcccggctcctccgtctcgggttccgccggntgcgctggg

SEQ ID NO: 604111 - DNA, 163 bp, Homo sapiens
atgcataccagctcaatgggtcacttggaacaaactttgctttgactattacgagcagaaacaaaacggaagcacaaacaccttctttttttgacatgtatctggagataggtagggaagacactacttggttttaaaactgactcctagctgtcatgaggac

SEQ ID NO: 604112 - DNA, 128 bp, Homo sapiens
gtatttttttttccacctggaatcctttggccagtgggtgcagccataagtttgtccagccaggggcatacgccaggtgcctgccgagctgtccatctggcccaggcaagaggcaaaggataacttcc

SEQ ID NO: 604113 - DNA, 446 bp, Homo sapiens
cgctttatcataggaggtggaagaattgcttgagctcaggaaggctgcagtgagctgtgactgtgccacatgctctccagcctgggaccctgtctgaaaaaataaaatataaaaaataaaagaaaacatgaaatacctgaaaaataattcaaactactgatattaaagaagctcagtgagatccaagagaacacagacaaacacaaggacataagaaaaacaattcatgatctgaatgagaaatttagcaaagagatatcattttaaaaaatcaaacagaaatcctgcatctgaagagttctatgaatgaaataaaaaatacaattgagagcttcagaaacagactagatcggggtgtccaatcttttggcttccctaagccacactggaagaattgtcttgggccacacataaaatacagtaacactaatgacagctgatgagct

SEQ ID NO: 604114 - DNA, 245 bp, Homo sapiens
cgaggaccccaataaattgttggtcattgataaattcacgaaacataaaacaggccaactcgaatatgcgccatctaaaggatctcctcttaagcgtggattttatgctataggaacatcaatgtataagtaagtcgattacaggtgtattagaaaaaatgaatttcataaatagtaattttttaattaatttttttaattttagagcactcatcaatgaccaacattattggggatcctcggaa

SEQ ID NO: 604115 - DNA, 519 bp, Homo sapiens
  misc_feature (212)..(212): n is a, c, g, or t
  misc_feature (323)..(323): n is a, c, g, or t
  misc_feature (352)..(352): n is a, c, g, or t
  misc_feature (371)..(371): n is a, c, g, or t
  misc_feature (387)..(387): n is a, c, g, or t
  misc_feature (399)..(399): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (457)..(457): n is a, c, g, or t
  misc_feature (475)..(475): n is a, c, g, or t
accagaaaaaattaccaaactcagtaaatattatttggcattaatacaaaattccaaaggtgaggggaaggtgcattttttttttaatgcaccaggtttaaagttcaaaggataaaaggcaaatagttgttttcatcaagagcagctgtacatttcacataattttttcaaaaggaaaggctattaacaacagtgattatttaatgctgcangtttacagcaaagacaaaactaaatagcaaattcacaaggcaatacttccacagaactatcatcccatgtctcatgcaatgcctaaaaagtgctcttaattggatatacangtataattaacgttaaaaaagaagaaatntaaatttgacacgcagatncattaaaggctgagtngtaatgagtggntttaatatttgccttgncnanaggagaatatgttggcatcaagcactttgaatccttncccaggtcacttccaggngatatcttcattgtgcaacaggcccacttgagaggcccacaccc

SEQ ID NO: 604116 - DNA, 161 bp, Homo sapiens
tagtgctgctcagggattgtctcaagtttacaatagagctgggatggatactgcagacctagagcaagcatgtggaggtcatgtgctttgtgcccaagcgctgcaacgagtatgatgacgctggggagattgcggggatttgaggggaaaagaccctgtgt

SEQ ID NO: 604117 - DNA, 605 bp, Homo sapiens
  misc_feature (60)..(60): n is a, c, g, or t
  misc_feature (311)..(311): n is a, c, g, or t
  misc_feature (546)..(546): n is a, c, g, or t
  misc_feature (562)..(562): n is a, c, g, or t
  misc_feature (578)..(578): n is a, c, g, or t
aagtaggctaggtacgagctggggtgaatcggccgaggcaaggctccagacccgcacgcngcgcgcacagagctctcagcgccgtcccagccacagcctcccgcgcctcgttcaagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtcctttgaccgcntgatgacagaaactggacaccaacagtgatggtcagctagatttctcagaatttcttaatctgattggtggcctagctatggcttgccatgactccttcctcaaggctgtccctttcccagaagcggacctgaggacccctgtggccctggccttcaaacccacccccgtttccttccagcctttctgtcatcatctccacagcccacccattcccctgagcacactaaaccaanctcatgcaggccccanctgccaatagtaatanagcaatgtgcacttttttaaaactgtg

SEQ ID NO: 604118 - DNA, 182 bp, Homo sapiens
ccgtcagggcgaccgctggagcttcgactttgaccgtctggatcgttggagtcgcatcgctcgacgtcacggtatcacccacctcgagttctcccatctgttctgccagggggaagtcgaccgtccggctgacgtctacgatgccgacggcaaccacctcttcggttcccatctgcctactg

SEQ ID NO: 604119 - DNA, 259 bp, Homo sapiens
tcagcccccgcaagacgacgttgtgtcatgccctacgttggtattatcacatctacgtcttacgaaacggaataggcctagcctgccaggcagtgaagaaagctttgggcaaatattgtcctgccgatttgtaagacactacaggaattggagctaccggttgtacagatgattatcacatttacctctttggatctcattatcaggaggaaagtgaagaatgctgataggctcagggaagaacgtcttgcgggtgctg

SEQ ID NO: 604120 - DNA, 204 bp, Homo sapiens
gttgtatctgttctcacgccaagtaattggttgggcaatgaagtcaaggatgtgcagcgacctggctatcgacgcgatgttgatggctgtttggcgacgcaagcctcagcagcaagttatgattcactcagatcaaggcagtcagttcagtagctcggattggcaaagctttttgaaggccaacaatgtaatcggcagcatgag

SEQ ID NO: 604121 - DNA, 1161 bp, Homo sapiens
cgcagaggtgagagtcgcgcccgggagtccggcgcctgcgccaggatggagttacgtagaaatgccttgggcacctccgaagagttctacaaccatggtgcgcttccggatcgggggcaagcggaaggtgatgcgccgaagaatggaccaggacgtcgcttcagcagcagtctgaaaacttgctatcgaagtatctcaatcagagcagtcgcagtgtatcgcagctgttatccaggcgctggatggggaaatgcgcaacgcaggtgtgcatattttatctggttctccgagctctggacacactggaaggatgacagtgaccagtcagtgtggaaggagaaggtcccgcgtgtatacagcaactttgcactctgttcctttaccaagccagactggcggttcatggagagcaaggagaaggatcgccaggtgctggaggacttcccaacgagtctccctgtgagtttagaaatctggctgagaaataccaaagagtgattgccgacatttgccggagaatgggcatagggatggcagagtttgcggataagcatgtgagctctgaacaggagtgggacaagtactggcactatgtcgctgggctggtcggaactcggcctttccggtctgttctcagactcagagtcgaagacccttagtgggcgacgatacagagcgtgcaactctatggggctgttgctgcagaaaacaaagatgatcgtgactatgtggaagagcatgagggggcagagagttctggactgcagaggttggaccaagtatgttaagaagtaggggaataggtaaggcccgcagaatatggacatgggccgtgcacgtgccgcaaggaacgagagccaaggccctgaacgcaatccaagaggtactaacgagacacttcgcgaacgtggagcccgcccgggtacactgcgtcgatatcacagcgcgaagtccaggtgaactggagcgcctggtgcacaacccgcaggagtaaaagggcgataacaaactatgaagcgaaaacaccgatcgagagacgtcagaccgaggcaagaactattacactaggaggataaacaccaagccgaaaacagagagtacgacgacgactgttagataccacatgactcgggcccgccagcctactaacactatcgtgcg

SEQ ID NO: 604122 - DNA, 149 bp, Homo sapiens
cgtcagccgcacggtgcggcggccgcccgggtagacgtagaagtacgcgcgggcggggaagcgggcgccgcgcggggcgcggaagccgtaagtcgcgcggaacgagcggccgaggtcccgggagcggatctggtgccaggagatcagcg

SEQ ID NO: 604123 - DNA, 250 bp, Homo sapiens
tagatatgagcatggttttgttgatattttaagtaagccttgagtgaaggatttgggtagagttgtgttgtgattggatctgagtttgttactaatttgagtaatccttaagtgaaggctttgggaaaagttgtgttgtgattcgagctaagttgtgttgctgatctagttaagccttgagtgaaggattttgggtagagtagtgttgtgatatgagctgaatttgttgttgatttgagtaagccttaaa

SEQ ID NO: 604124 - DNA, 311 bp, Homo sapiens
agttgatcctcaactcaatttcaagtggagcttgatgctgataagacagggcccttttgtcctattctacctcgcgccggagttgctgcacagctctattgcttttcctgacatcttggcgcgtcttctatcatgacagttggatgaagtgttccatgacacgctgatcaaagacatgctgcagccagatgagaatctccattagtctccacaacttagaagacaccattgtcaatggcagagaagagacacatcgaagtgtccgccacccagaacacacaccaggacgttatgctacccctacctctcga

SEQ ID NO: 604125 - DNA, 655 bp, Homo sapiens
aggctatttagctagggagtgatggagcccagatgcgaatccagactgtaagctccttcagtgctggagcagtgtcattcatccatttgttcatttacggatcaaatatttaatgcataactaccacatgcatgatgctttgctaagcccttggggaggcaaagatgaagacatattccttgctttcaagcaggtgctgacagctgagccattccacgcaccttcggagcaaagaactgccggaaaccagggccaagttcagagcctgaaatttttttcaaaggctacaaggagaaacctggggggcctgatcacacattacataagccgtatgtgagcagaggatgccactgatgctaggaacccagtgcctgtcggaattgcgcaaggtttacgcagaagcacttaagtgttgcaacatgaccccacatctttaccaaaaatgtgaaacattcacgcagcacacactttaaaaacactaaagcttgtctccgccaggtggctaaggctgcttgatggggctgacaggagaggagctttgcaggggggcctgacttactgtagctcttggcccagggagctgaacacgcagtactttgtaccccaatagccctgggcagcccaagcctctgataaaatgtacttttctgtgtga

SEQ ID NO: 604126 - DNA, 721 bp, Homo sapiens
gttcccttatcctcggccgtttgttttggattgtaaccggaaccttttctcccggatccactatgccatgttccccaagctagatttacctccattaagggaccaaactggagctccccccgttgcggccgctctaaactagtgattccccgggctgcaggatttcggcacaagccttgtggaccaagaggcccgttacgcaggatatgtcgtagcacctctgaatgatgggtttgaaactgcgcccctctctccaggcacaagcactcaactatctgaactgatagctcttacaagagccctcaactttagcaagggaaaagtaactaacattggcactgactccaagtatgctttcttagtccttcatgctcatgctgccatctggaaggaaaggcacttctttacagctaatgggctctctataaaataccatcaggggccgggctcggtggctcacgcctgtaatcctagccctttgggaggccgaggcgggcggatcacgaggtcaggggatcgagaccccggttaaaccccgtcttttctaaaaattcaaaaaattagccgggcgcagtggcgggcgcctgtagtcccagctacttgggaggctgaggcaggagaatggcgtgaacccggaaggcggagcttgcagtgagtggagatcgcgccccagcacttccgcctgggcgacaaaacgagactccgtctcaaataaaaaaaa

SEQ ID NO: 604127 - DNA, 210 bp, Homo sapiens
tgctgggattatggttgtgggccaccatgtccagttggaaaatgcttcctaattgtcatacaactggacacttcagtggacatcaccatgccatgcctcctcttatgggtcggaattatgtctctcacaaaagacgtctgagtcctaactacccagcccctgtgactgtgaccttatttggagagagggtctttgcaggcgaggctagga

SEQ ID NO: 604128 - DNA, 465 bp, Homo sapiens
  misc_feature (20)..(20): n is a, c, g, or t
  misc_feature (133)..(133): n is a, c, g, or t
  misc_feature (168)..(169): n is a, c, g, or t
  misc_feature (194)..(194): n is a, c, g, or t
  misc_feature (201)..(201): n is a, c, g, or t
  misc_feature (362)..(362): n is a, c, g, or t
  misc_feature (376)..(376): n is a, c, g, or t
  misc_feature (454)..(454): n is a, c, g, or t
  misc_feature (456)..(456): n is a, c, g, or t
gtgggggggggtggccaccngtcacagggggtcacttcagggtcttcacgaaatcttccccctttttgatggaggcattcagctcggggatggcatccgagatcatcttctcatcaaaagaggagactttgcngatgcccaggttattcatggatgcactttttcccnngcagcagcggtgtggagaagtaggnacattangtttactgtgacttaacgaaggaacattccacaacaccttcctttccattcattgcatccacaagggggaagacaaagggggggcggggatacgcgatggagagggtgggagagcctgctccggctttagcttgaccacctccgtgccggcctcctggatnggcccagtgagtgntgtaagctggtcctggggaaagtccaccttgggggtggactgagagatcagggggatgatggtcttcccaggatgggnancaatgagag

SEQ ID NO: 604129 - DNA, 272 bp, Homo sapiens
cacgaggcttcaggacacatttcattgctaaccacgatggcagagcatcatcacgcatttcattcaggtggaaggtgtctgctgctgtacaaggctggaagagccattgctttcccaacgttacctgtttggcaatatttccctcaggggaagagccagaagcattgtcagggtcttcagatccaggcttctttgagaccccagcaatgagctttagtattcagcttgtccacgtcatgcacacgttagctcttgcagtcaaggaaactcta

SEQ ID NO: 604130 - DNA, 228 bp, Homo sapiens
tgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacataactctgcaacagaaccgttttgtattttgatatcactaaactatagctaaa

SEQ ID NO: 604131 - DNA, 231 bp, Homo sapiens
caggccctggaaataaaatccccttttttccctttaaaaaaggggacgattaaaaggcatccaattaaaggtgtttcctaggcaacaggaaataacttgggggtcagacccctccaaaaagggaaaaagagatccccctgataagggcttttaaacagtgaggactttttttgggggcaaaataacagcctccccccaggaagtgggcccccgccccagtcccccccccca

SEQ ID NO: 604132 - DNA, 124 bp, Homo sapiens
acctccaacgagatgtccttccactagtggactggtggaaacagagctccaattaaccttctcccaggtggcgtacaggttcatctgcaccggggcgggggtgcggcctggccccgggccaccg

SEQ ID NO: 604133 - DNA, 174 bp, Homo sapiens
aaaccccccttttttttttccggggggggggggggtttaaggttttttgggggtttttttttcaaacccccccggggcccccccccccccccttttgtttttttaaaaccccccccctttttttggggtatttttggggccccggccccccaaggtttttttttttttttccca

SEQ ID NO: 604134 - DNA, 333 bp, Homo sapiens
ggcaaagagccatccttgtatttaagaagtaactttggccaggtgtgatggctcacgccgtaaccccagcactttgggagaccaaggagggtggatcacgaggtcaggagatcaagaccatcctggctaactctgtgcaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcatgggcaacagagcgagactccatctcaaaaaacaacagtcgac

SEQ ID NO: 604135 - DNA, 372 bp, Homo sapiens
  misc_feature (181)..(181): n is a, c, g, or t
cctaggtgcctgtcatctatatgatctcagtattttaaaaatcagcttccagcccatatggtggctcatgcttgtaataccagcagttgaagaggctgaaatgagaggattctttgcacccaggagttcaagagcaacctgggcaacgcagcaagacccagtctctatcaaaagttaaaanaaaaaggtcggcatggtgatgtgcacctgttgtcctagctatttgggaggccaaggtggaaggattgcttgagcttgggaggttgaggctgcagtgagcagtgattgcaccactgcactccagcctgggcaacaaagcaagaccctatctcaaaaaatatatataataaaaataaaaatcagctctcattg

SEQ ID NO: 604136 - DNA, 486 bp, Homo sapiens
gagcccgccgagtcttaaatgacattaggatcaatacgtgcggcactagaagattcatccaaacccgacactacgctgaacgcacacggccgaggatactgatagcaactaggcacaagcttatcgggtagtggctcaacattggaatacgtgagcaatgcttttaggatcgccaccggaaataaccaacgtataaggagctcggaaccaacctccgcattgtcgaaaccaagcagatctttttcaacctgacgccgcatcatgaagtccaacggcgccacgtgttttattacttccatagcttgatccggcatgaccaggtgaatcaatagcacacccaacccctgcattagcccggtcgtaaatgcctcatcacgatcatgattggtttgcgcggcaaggtgagaagccatgaatgcggtatgcagtcccattttccagtaggccggcatatcgatacccagcgttgctggaatcgctttcaca

SEQ ID NO: 604137 - DNA, 137 bp, Homo sapiens
ctgtggcgtttttcccctccatttttacatgttctcatggtgtcacatatccagcataaagaggttgtgcagctattccacattcgaccatcctgcagcggtgcctgatcagtctgtcataggcgtcatccatatct

SEQ ID NO: 604138 - DNA, 102 bp, Homo sapiens
  misc_feature (2)..(2): n is a, c, g, or t
antcagtgacatgacctacccagggtagggactctgacacactcatcttcatgctgcctggggtacttttgggtgggtgctattgaaacttctaaaactagg

SEQ ID NO: 604139 - DNA, 513 bp, Homo sapiens
gattatcttgtgatcatagcacctgctgtcggcacactcccgtgagtcctgtggtcagggtttcaggataggaggtggaggtttgggttaacgtgggaaaatgttcttgctttgacacaaggaagtactgagtggctgcaccgagaaaggacttggctagtaaggtttaggatgtcattcgcgcatagccgagcagcctgctagcaggtgacacactccgtgggggaggctcttctccccttctttctctagtctgggtggtgaacgggctgacactgctgtcactggttcttaggacctaaggtggtcctcataaactcctgggggaagctgggagcaacttcctgggaagctaatttatttgtctaaagggtggtgtgggcatcaccacccttgtttgatctgccttggatttcctcttggagcttatgtgcagatagaggttgtacttggtaagatttctaatgtgttctatgggtttcaattctgaaaaaaaaataaaagattttaata

SEQ ID NO: 604140 - DNA, 418 bp, Homo sapiens
gatggttggaggtcctatagaacaaaggagacctaaaccctactgaggccaaattcaccaggcatctgttcaagtggcaagattgaaactggggcatgcctatggtggggacttccaggagggggaaagtgagagactgaagctggataaggaggtcggggtggacctggaggagtggggctggagggagctggcttctctgctggcggtgcctctgggatttatttcttttcttttttttttttttttttttggaaaaagattcccagggtgccgccaaggcggaagtgcaggggcacaaggtgggcccagggcacccccggtctcgggggatcaaagaagatctcgggcctctatgtcaggttcggaaacgggcattagaggcaggaaagggacacaaaaaaggtaccagtcaaaa

SEQ ID NO: 604141 - DNA, 170 bp, Homo sapiens
gggaggcttccggaaccctacgcccacccgacgcgttcgcccgtccgttttcatttttatttttattttggtttttttgttgttgttctcttcttttgtcttttttttttctttagagacggggtctagctatgttggccaggctggtctcgagtccccgggctcaagcg

SEQ ID NO: 604142 - DNA, 985 bp, Homo sapiens
ctcgtgtttacgcgtgtatcccgtccaagattatcggccctggaacggaactgtccaatcccaaaccgcctcttttcttggaaccccttcccaatatgctaataacacacccgcgtgatacccggatttcctcatgcgccttctcctggtacctttcttatacaccgtaatggtcccctccggggaacctgcgatttaatcaacacttctcgaacgccacacatggtaaaagcctacgtctaatggagccccagttaagggtcctaagtttaacgtcaacaatcctacttagcactcaacgtcttcgtacatcactcaggcatgtgcttgcttaacccgtgttccccgggaattttgccccgatgaatgcttacccaacgggtccttcgtgcttccctctggatgaactactcgtaatccccttgctgccaattcacccctcttaaatcccttctcgggtgacccctatactcttacagatggtcaggctttcaagtgccctttttgtctgcgcaacccaagtgcccacgtcagcgcgctagttgacgtgctgcggccttgttctgggcgcgaagtttctgtggagtgtgttcttgtggggcctccccggacaatacctctcctgcctgcgtggtcagatgcaggttgtaaggggccttgctgagtggcgcaaggccgagcgttcacagcagggggagaaacccttcacatccccaggcccttcaggaactggggctttgcactgcagccacatggccccatcccagttggggaagcacaggtgagctctgacaccattgggcctgggcctctgcccctcccaacccagccgtcgtctccctcgacagcgctcctgctgtcttccccactgcagtcaccaccacccgaaatgccacgtggtcactgtgcactgccactgttagtgtgccttctgcggggcaggccttcctggttttgtaaactgcctgtaggccagatgcctaca

SEQ ID NO: 604143 - DNA, 692 bp, Homo sapiens
  misc_feature (692)..(692): n is a, c, g, or t
gcacgaggagagagagagagagagagagagagagagagagagagagagagagagagagagagagagagagagagagagagatcgagtgaaccgtttcggtatctgaagttgctgattaagcctgatctagatgacatcctctcatacgcaccgttacttcgttgctgatcccatgggggataagccagtggggagcctggctggtattggtgaagtcctgtgcaatatgctggttgggtgttttgacaatgcctatgttgtccttggcctttttctggtgctcattatcgatgaagacctctttcggtagtggctgactgacacttttggcgccaatgcctttctttctctggactgcttcttatgccttcgatagtggtgcgacgccttcttgtgatgctctctgtgatgctttcattccctaccccttattcatactttgcagccgagtagggactcctcctctgtcctctactatttaactgattgctcttgtcttactctcctcctacgttctcccgtgtctattgggttttttgccttgtccctttcgatctttttttggattctcgttcttccttgcctccccgttcttttttcctttgctcgttcctttgttctttttcctgtttccttttggttcctcgtcccttttctttctccctctctgctttccttccctttggttcccn

SEQ ID NO: 604144 - DNA, 446 bp, Homo sapiens
tggggtgattcagatgttaagacaagagatgtccagccatacagaatgcgatggttctgcctgccagagaacaggggatgcaggcatggctcggcaggtggatgtcagattctgtctccctcccaactacttatatcctccagagagacacatagctgaggcgtacctgttacgactctggtcatatcttgcgtggggctgcaaaggaaaggggtaccctcaggttaattgctgcagtcctgtgtatgctgaattctgctgtgaagaaggagagacgcttccatcttggatattgcctaaatactttgtctttccttcggtaacaacagtgcacagattgtacggcaggaatgtgtttgtattcactcctgctgtaatcctgtatactaaagtggtccttagggaatgtgctgatgtgcgcgataaacgtatgaagagttgttggt

SEQ ID NO: 604145 - DNA, 407 bp, Homo sapiens
taaggcagagccagcagatccgtgtcacccatgtgccattaagacaaggggcaacgctacaactggcaagagaagaaatgggactattattgcgtgtggaacaggccttaattagttacgttacagctaagaatgtcatgtcttgggtctcgagttgtcatttttagcaccgttaatgtattcacttaaatctatgttagcaccttgtctccaggcagaacaacaaaccatccaaacattttaaacattgggggaaacacgaaggggagggttaaagacagaatccggtactgtggaaggagtggatttagatcacaagatccttgtcgatatccttctgcttgatgccgaagcagccggcccactcatccagggcgatgtactcgtcattgcaacacggtctctca

SEQ ID NO: 604146 - DNA, 186 bp, Homo sapiens
atctcactgcaacgctctagcttagccaatatgaccagccgagaaagaatgctgcgcgtgggccaagataggcaccggcaaaatcagcgaaggttttgaagctccaagtatggaacagtcaacatattcggccccatggtcacggcattgaaccgaaagttaggaacgaaaacaaggaaccggatt

SEQ ID NO: 604147 - DNA, 229 bp, Homo sapiens
cagaatctatggagcttggattcattaatgcaaacagtacctaataagacccacaggtcctaaactaccacacctgcattacaaattccggtatgggtgctgacctcgttgccagaacccaacctccgagcagtacatgctaagacttcaccagtcaaagcgaactactatactcaattgatccaataacttgaccaacggaacaagttaccctggggataaaccgcga

SEQ ID NO: 604148 - DNA, 587 bp, Homo sapiens
tagtgattttaactcttagcgtccacacgcgctcatcccaacttccccgacgtgccccactcccggggggaaataaccctgccttgaagagtaaatagcaaccaagtgctcagttctatggaaagtatgaatatttatttcaggctttcgatcccaatcgatttcaaaaaacaaagtctgatttctctcctcagagcagctgaggcctccatgttacgatggtttcatggagatggaaggagcacatttcatcaggcttagcacaaagtccctgatgcccaccatgtcccagccttaggaaaggaaagaaacagaattcaccaccatggggctgaacgaatgcacacacactaatgtaaatgagcagctaaaccttggcaaattggtttttttgtaaagttagtaacgtgggtttttttccattttctttagctacccagtatatgcagcacttgtgaactcccaacaggttcccagctttaaacacattaaacatcttgaaagactattgaattcttcaagaatctaaaaacagaccaaaggtgttttgctgtgaacattctgtagagacgaagtgaggcgggagt

SEQ ID NO: 604149 - DNA, 1649 bp, Homo sapiens
cgaggcgctcgtcgatggcattctctgagcatacacgaggatagcgtcgatgtggctcgtcgttccgattcgtgggcaggagagggctcatgtggggctctgtgctagtgtccgtgggctctccgcgcagcgtatgtgcatgataaagagaaggttcgtgctcgacgtagagactgcacgtacccgtgcactctctcgccagttaacaggggattcgtcgaatgaaatggactcagggcagacacacagatgaagagttctcttcactcaattctccaccctaacctgtactcaatagggttcctagggttgcgatctgcgtgtagttgacagaataggcaagcacacgtaatcaaaactacaatctcctcctgataatatggcagcttcagaggtgtgtagggatccctgtgtccaagtgccgtggaatgggcatcttgtgaaagggaattgagaggagcagtgtcgattttgctccagcacgccatggaggtggagaccatgtgcacgtgttaggggacggccacgtagcgcgcacactgtaatgcgctcccctggggacacctcacgacggcgtggccgctctttcctcctcttaacctcgtgcaccggtgaattccacacgcgaaatgtgaatccacacacgttgtgagggggcaccctttgaacgggagcaaaacacgttctacaagggtggcagaagggaatttatacgcaggtgggagatggccttgtgcgaaacagggccgccttattgttggcgccacagaaatttcttctgtggcaatttttcttacatcccaaacgaggtaataaccttgagttgggggcggcccaattccttacggcaaagaaacattagtggacctcctggattatagacccttcccagttgagggggtatagagaaggagagagcacctggtctctgtggcatctagacataagagtaaactagatcaatagacagaggaggcggggacatagctatacgaggaatggccatattccccattgagaagtggccccatctaggggagcccgcgcgccaaaaaggggaccaccagagcaattacatatgggagcaaagcccccccagacaggggaaggggtaccccagagagggacaggccacaccgggcagaaggcacacgaaccgatatgcgcataggtcgtccataggacccacaagggggaggtggtaaccaatatgcaattggacggcgaggaaagcacgagagaaagaggaggaggccaccaagagaagccagttggcactatccgtatggacggatgagaaaagggggacaacgtccacaagggagggcaccaagtggaggcaagaaaagcccctgggggaggccccccgtttttgggaacatgcaccagaggacgagacctatagaggccccgggaccacggaccaaacggtgatagggggcccacaaactcagtaggtacccccgcactggttatagtagcacggaacgagaggcactatgagcaacaacaaacggcacacaaacggaaaaaagagagcatacgatacaacgagatacggggagaaaactacaacgacaggggaacaacagagaggaggaacagatatgagcgacaagtggagctaaagaaggagcaggaactatcag

SEQ ID NO: 604150 - DNA, 261 bp, Homo sapiens
gttttctaaaactcatcaaactgtacatttaaaactgatgattttaagtaaattgtgcttcactgaatttgttaaaatagcaaccaaataattcactacactaacaaaaataatgagaattatgtttctcaataaatgcagaaaaaggatttgataaaagtaaacacctataaatgacacaatcttagcagattaggaataaaagagaacctccttaacctgataaagaggttatttcaaaaagaaggagaaggagagaag

SEQ ID NO: 604151 - DNA, 288 bp, Homo sapiens
ggggctgaccctgctacctgggcgtatggtcactttaagaagtatgacaatgtggcatatcgcacactacgtgtgatacaccagaaagctagattaacactctgtaccaaaaaaaaaaaaggccacacacacaacttagggaaagagatggtttccgagtcaattttcccatttatgtggctgaaaataaatttggccacttcccatggcttactcttcacgcaaaatttaggtcaaattaagggcggggcgcagtgggctcatggcctattaatcccaggcgcattg

SEQ ID NO: 604152 - DNA, 506 bp, Homo sapiens
atactactactaaattcgcagcaaggtcgacacaaataatattaaagtaataaatgaactttttaagatgaagcagttccccatgaaaaagttaatgcagcatctccatcagaaatccactcttctagagatatgaaaatcatcttaacacccaccctacatacacagacacacacacacacacacacacacacacacacacacacacaaacacacacacacattcaccctaaggatacaatggaatactgaaaagagatcacttccatgaaaatttaattaaaagacacacaaaaaaacaaaaagcctgtccaacctatgagaatcattactctactaggaacgtcaatgtttgtgtagatgagaccatctcatgctctgaggctccagggatactgttactaatttatgcacttgggagaaggcttagaatagaggatgtagcacattttgcaatcccatatattgtatggccagctatgccaatgtggagcaattggttcttt

SEQ ID NO: 604153 - DNA, 934 bp, Homo sapiens
gacaccgagcgaagaaacatcgcagaagtctctcttctcgcctgcccgtcatgtctacggtccgagtctcctcgcgaggctggagcagacttggacgctaagctcgacattgagcgaggttcgaggctgttcgagagacgagacttgaatagagcacccttgaggagccgtgttgctgcggccatggaggataccgctcacggacatgttgtgcctgaatcgaggagcatacgcagagatagccacagacgactgcgcagcggggctgcgggttgtagtgtcagcatcatgcaccctaggtggcggcgcgtagggaatgctgtctagtgcaataatgcggacggcgcgagcacgagagggtgggactcgcgatacgcatgtctgatgggaaaccacagatccgagcttgtcgtgctcacgagtaaccagttcctacccatacagccatagtagtccaccttaaatgtgtcgctccatccctctcatgcccgagtggccttcaaagcacggcatacgtgtaatgacacaatctacacgtacagggacgctgttactcttgttgccctcaggggtggtggaagggtcagactttgaccccgatggagtttgtacacacttcttgttccatgcgtaagaccggacgggcaccgtgtgacgaaccgccaggctgcgccgtctgggggggctagaagcgtaacaaccgacctggaggaagcgaatgtgggttccccctcgctaagttgagtggccctctgtgtcgcgatgacacgaaaagacgcggagagagcgcttagcctgccgtgatagaggtatgagagacacccccaaagcagttgttcgactaagcgctagattgagaagaaatcgcggccccgtgggtattccaacatattacccaagccgtaaggaaagtatcgtggctcaatagggggcc

SEQ ID NO: 604154 - DNA, 117 bp, Homo sapiens
acatttaagaataatccgagaatgcattcaaaaactcttctcagtgcatcgccaggctcatgagggctagaagcactgctgattgctttctctactagtaactccatagcccagctt

SEQ ID NO: 604155 - DNA, 612 bp, Homo sapiens
  misc_feature (114)..(114): n is a, c, g, or t
gcattaaaagaaaaacatgccgtgaaaatgccgcacgttaaatttcaatattaaagcaagttctagtgtattgtgttggagttccttggtaatcaacatacgttgttcacatcntacacctgtacttcaataggtatgactttcgtcaacgaggaggcgaattgtgagggtagaccagtgttacagttggacctttgttccttcttaatgcatgctgggaagtactaacgctaaaaaagtgattttgtgaccgcatattatgttcagaaaataactaatatgtgatacctttttcatagatacctggtatataggggtccagggggatcggaggggaaaaacttatgttacaaggagattactaagctacaaggtttaaaggtaattaaggatggaaccccattgaaaatgcaataacagtccattccacgtcgaaaaggagaatcatggttgaattgatgtgaggctttggaaacttgagtggcacttttgcgaaaaaatttgtccgaggagggaaccttggggtggatttagacgagtttaggggtacaagaattgagattggaggctggacattgaggtcccgagtgagttaagaaccatatatttggc

SEQ ID NO: 604156 - DNA, 405 bp, Homo sapiens
tccctagtgccaggtttttcccctcacttggggggttctacataccccgcacagaggcccgggcccctggggagagggcagcatctcctgccttctgaggggtttcttgggcctcacgggtgataagaagggagaggagtggttctctcttcgtgccctcactagggccttagggcaacccaggagcaaactcccacacacgcctctccatctctcagccaaggagaagccacctgggtgacgttatagtctccaaccatatatagtaaggtggagaagagggtatgggcctggtcccaaccattacagggtgaaagaattataaacgagataaaggaagatacgagttgggatgaggccccaggaaaggagcagaatgcaccccatcagaagcaatatgcaggg

SEQ ID NO: 604157 - DNA, 354 bp, Homo sapiens
gcgtccgtgtaatatcatatctggagacagtcatgatcttgctagtgatttactatggttgggactccaaagttcagtgccaagaagctgccgcgaggtgagatcaagtgtgagcctatcgatcaggatggtcacctggcacgcatggcacaatctacctcactcttatcagagtctgagctactggcagtgctttcagctctgagttgaggcacctcgaagcttgtatctgtggtgaaggatcctacagtgctgtgggagtgctcacatttttcacaagagtaagtcccttaacaaagccttccagccatccaaggcctaaaggggggctttggcagacaaggtagagccgag

SEQ ID NO: 604158 - DNA, 255 bp, Homo sapiens
  misc_feature (155)..(155): n is a, c, g, or t
atcagcgcctcaaccccaacagggctacccttgctgcatcctggatcctgagtcctggccggtgctcctgcccacgatcactcggtctctcttcatcccattcctgcctcccctctctccatctggccacctctcccgtgcctttcaaaaccggngtctagggagttcccatcgtggcccagtggttaacgaatccgactaggaaccatggggtggcgggttcgattcccgcttttgtgttccggggatcctcta

SEQ ID NO: 604159 - DNA, 222 bp, Homo sapiens
tacggctttgccaatggcattatcgaagaattcacaaaaaacagtacctcatcatcccctaccatcataagccaccatcagcctccttaacctctacttctacctacgcctaactctactccacttcattcacatgctctctccttttttaaaaatcgtaaaaatacaaatgacagtttgaacatacaaaacccaccccatttctccccacagtcatcgccc

SEQ ID NO: 604160 - DNA, 180 bp, Homo sapiens
ccggtgctcatctcaatatttaacattttttgaaatttactctcttagcaattttgaatgtataataccctattattaactatattcaccactctatgcaatatatctcaaacatatacaaaaaaattcttcttgtgtaactgtagctttttgtacccattgatcacatggccactcaat

SEQ ID NO: 604161 - DNA, 267 bp, Homo sapiens
cccccagggcccatgccctgttggggggggtgtatatttacaaaaacaaaaccaccaaacccccccttgggatataaggtagcattcccaaattaaagactggggcttgttgaggggcaatcccctgactcccaaagttagttccagtgggttttattgtttttgtgactgaaggatttattcagactgtggacttttcttttgatgtaacaaaatgcttttattttaaatatttgtaaataaaggccctgtttttagattaaatta

SEQ ID NO: 604162 - DNA, 3109 bp, Homo sapiens
  misc_feature (3093)..(3093): n is a, c, g, or t
  misc_feature (3095)..(3095): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagtatccagcagcacgcccaggtgctggcctcccctgagcagagtcctctgcacacagctctccttccttaatgcccagagataagggtggcttgagctctggtgcacagaaccgcatcgtactgtcacgtgagctggacccaccttgctcctggtctgcggcagtctctcagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 604163 - DNA, 103 bp, Homo sapiens
cgagagatcggtctcgttcgagctgcttgagttccaggcggaatggccgcgttgcccgccgaatcagtctgatcttcatacggcggaacaagcggcgcatgat

SEQ ID NO: 604164 - DNA, 2825 bp, Homo sapiens
  misc_feature (2809)..(2809): n is a, c, g, or t
  misc_feature (2811)..(2811): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 604165 - DNA, 2893 bp, Homo sapiens
  misc_feature (2877)..(2877): n is a, c, g, or t
  misc_feature (2879)..(2879): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgcagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 604166 - DNA, 1154 bp, Homo sapiens
  misc_feature (1138)..(1138): n is a, c, g, or t
  misc_feature (1140)..(1140): n is a, c, g, or t
ataccgtgtgggcagagggttgcactgggaacctggggcccctaaccaaccctcacctccaccccgaccccctgccgtccctgtagcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 604167 - DNA, 1463 bp, Homo sapiens
tcagtgggcggacagaataacatttgaataataattgtgtttgagcccgaaatgaatgtagtaccccagagttactatcagtaagaacaggatacagaagagatctgatgctgtgatcttgcgttcatctgccacgatggttccattaaaagtagacctcaagtgttggaacgacagaaagtatgccacgggacagtcaacatatatgttgatgtatggacagtcatcgtcaatagcgtgtgcacaacgagtacatctgaggtgagtcaagacgtcgccagttacacctatgtggtagaggcgatgtactgtaaagttgtcgaagctaaagttttagcatgcagtgggtaataagaaaagtctaacaagcacctagtctgcatgactctcaagctgggtaaacaccacagtttggcaacggctactgtcggcactacatttatctttagaataattgcacgtgaatctgtgggtacggtacctggtgtgtgctctccctgtcacaatcgtgacactggtaaacttacagttccatgtagacttaaaagtcgacatggtgtatactggtttgaaagggaagtgcgttagtaaataactgttttgggggatagatcggggggcttgatatgacttaaaatcaagagttctagcatggtgtatgtttagaccattttaacaggataacttacggcttgcgaagttcgtggtaggagagtttagagaaaggaataaggttattgtcttaacaaggttgcgcagggggaataggtggggaaattataaatggtttgggcagtttgtttgttgaagaaaagttgactggcaaagactttgggattagtactggggggatatgggggttgggtggagaaaagggttgcaaactgggacaagggaagattccatagcgctggaatagtagcacgcggcgggcacaacgggtacactagaggccagatgcctggcaacaccgcaaagaccacaaaaccgtaaaggagcctaaaaccggggaatccgggaaacaagcacaaggggagagggcccacaccaggaagaaggcggagggaacatagaagaccaaaggggaggcgtagccccaaatggaatataaaccagtgttgatagaaggggacaccaaagagggacccgacggcaaaaaaaggagaaagagaggcgcaaaaggggggaacgagacacgggggggaaccacccccgggaagaaaaaacgcccgggagggccaaaaacacctgtgacgagaacaaaaggggcgacacagcccaaacatctgcggggaaagaatccagtcgagcagatcctaaaaaatgaagacaacaagactaagtaacaacaatacgaagagaccaacaaacgaaaacgacacaaaggaatgatatgagagagatacgaccaagtgtagacgaaaagcacgacagagacgacacactcaacggacaacagcgcc

SEQ ID NO: 604168 - DNA, 100 bp, Homo sapiens
gttgtttagctttggaaagttactgttaaatgccttgcttgtatgatcgtccctggtcacccgtactttggattttgcaccatcatgtttcagtgaagat

SEQ ID NO: 604169 - DNA, 322 bp, Homo sapiens
  misc_feature (111)..(111): n is a, c, g, or t
tagtgatgagtttgctaatacaatgcctgtcaggccacctacggtgaaaagaaagatgaatcctagcggctcagagtcactgcagtcatgagtcatttcatattagcttcncgtgggagtgctgtgcgagttcagtccataattactcttgaccgccgtgtttgtggacgatgcggatgtattactgtgtaagcgcgacggtgcaatttatgctccgtcgctgtctcacgttcttacttccgtacttgtccacatcctggtcggtcgtagcttaatctacgactaaaaccccctcacggcaacgcccaactgtggatacttc

SEQ ID NO: 604170 - DNA, 608 bp, Homo sapiens
ccttactattgaatgggatactatatgccttccgcgggcatctgtggtatgatacgtgcctatgggatgagcggttttaacacctcgggtttactcatgatgtatgttatatcaaaggtacatttactgcttccagtatacaatttggcgcttactgaccgacctgactataaaaggcaagttaaaaatatagctgctttgcattggaacggagcgaagacaacggctctataagttctgttttataataaggcttttattacaaactggatgcctttattatacttactgtccatatgcacatcagtcgtatgtataagatgtgttctataattatgcagttgctgatactgccatgcattgaccagtgacatcataaggcaggcgctactgctgcatcgttgctactttcttatctgtaatacaaactatagagtgtctgactagaaggtctctttgagattgacttctgtaagaagatattaccttttgcttgtgaaaaatgcatcactgggagtggaagtgttttattccgacgtaatgtggtcgaaattgattgccgggggaagaattttagacattgatccctgccggtacctgggattttt

SEQ ID NO: 604171 - DNA, 285 bp, Homo sapiens
  misc_feature (27)..(29): n is a, c, g, or t
  misc_feature (57)..(57): n is a, c, g, or t
  misc_feature (64)..(64): n is a, c, g, or t
  misc_feature (67)..(67): n is a, c, g, or t
gcaaaaggcttggtcatgggaggcagnnnaagtgacatggaaaagccaggactacangacctgngcngatgaagtacggaataattacaagctgtcttaggcccctgatctaagcatgccccttgttctccacactcagaccttagatagtttttgtgtgtgtgtgtttgtttgcttttgagacagggtctcactctgctgcccaggctgcgacgcagtggcacaaacatagctcactgcagccttgaactctcaaactcaagcagtccttccaatcacctaatg

SEQ ID NO: 604172 - DNA, 243 bp, Homo sapiens
gctttcaggccccatgcaggcagccctgcaggccgctgcccacgccagtgtggacatcaagaatgttttggacttttacaagcagtggaaggaaattggttgatactgacccccaggccctgcagtggggctgactccagatttttcctgccctccctggcagccaggaccagcacctgtataccccccactcaactttgacattaccaaatgtgcttcagaaaaataaataatattttttta

SEQ ID NO: 604173 - DNA, 365 bp, Homo sapiens
ggtagggaaaaccagaaatatagaaggatcggagaaaagtgtttattgccctaacggtgattaacctggtggggacagttctattctttctcattttgaaaccagattctgaaaatgtcctaggacaacatgagtcttctgatcaccagggcctcgaactcacccactctgcccataacaatctgacaaaggcagtacatgcttttaaaaactctttctacttatgtgtcaccaaggagatcctccttcttactattacaactgcttatacaggtctggaattaactttcttctctgctgtatatccaacctgtattggtgctacaaataaatttggagcacaacataaacgccttattgcactt

SEQ ID NO: 604174 - DNA, 152 bp, Homo sapiens
  misc_feature (33)..(33): n is a, c, g, or t
  misc_feature (134)..(134): n is a, c, g, or t
aaaagactatttgctaaatatggagaaccaggngaagtttttatcaacaaaggcaaaggtttcggatttattaagcttgaatctagagctttggctgaaattgccaaagccgaatctggatgatacacccatgngaggtagacagcttcgag

SEQ ID NO: 604175 - DNA, 754 bp, Homo sapiens
ctgggattacaggtgtgtggcaccatgcccagctaatttgagtatttttagtagagacggcatttcaccatgtatggccaggctggtctcgaactcctgacctcaggtgatgcacctagcctacgagcctcctaaagtgctgggattacaggcatgagccacactgcaccctggcctgccagtgtctttttaagtacactatgtgatgcttggtaatttgtatagaattagtagacagtatctagcatattgcgttactctgaatattcagtacttttcgaataagcgaatattgcttccttgcttggaatcatcagagtttaaacgtagcttcgtggcatggaccatgatcctaagatgagtttcagttgttgtgttctatagtcatctcttgtacaagcgtggagaagaaaagatatacttactacttagcttcaggtacacatagatgaaaaccgtctttgataaacaaaatttttattgattatacataatagagacaggggctcgctgtagcttccaggctggcctcaaactcctgggctcaagcaatcctcctgtcttggcctcccaaagtgttgggatttcaggtatgagacaccacacctgcccatttacgtgaggattattaatagggcaggttctttgctctcccaggctggagtgcaagtggtgtaagtcacagctcactgcagtctcaaactcctggactcaagcagtgctcccacctcagcctcctaaagcactgggatta

SEQ ID NO: 604176 - DNA, 574 bp, Homo sapiens
  misc_feature (140)..(140): n is a, c, g, or t
  misc_feature (193)..(193): n is a, c, g, or t
tgttggatactgagtggatgtactccctgccttcctcacggccctggctcccagctcccgggctttgtgcctagtggccccatctgcactgacaaaatcaatgctagcaactatgccagtgtgaaggtacccttgtgtgnggacagctgaggtgcccctagcatggagccatggaagggtgcatccctgggcntttcctcactctgggggctggataatcaagggggtgtcttcgtgggaggagctgaccagccaattccacccttttggtttactcagcagactactgtgccaagccctgtgctaaaactgtgttctggggcagacaccaatctgtgcccccacccagtgggccagcttgtctctctccctcatatggggtggtcccaggaagagactgaagtggggagggctggggatgctatggcaggtccctgttgactctgccccaaccccctatccttcctctcagactccagctctgattgtatatggagaccaggaccccatgtgtcagaccagctttgagcacttgaagcaggtgcccaaccactgggtgctgatcatgacgggg

SEQ ID NO: 604177 - DNA, 136 bp, Homo sapiens
agtacacaggctcaagatggagacacaggctcaagatggagaactgcagacggggagtccatcgtacagatgttgtcatactggctccccctcagttactcctgtggtatcacacataacatctgtacgatggact

SEQ ID NO: 604178 - DNA, 404 bp, Homo sapiens
cttctgactgaatctcttccatagaggaattccagggctgccactgacttagttctccatcctcctagccaacctgcttctcctcttgtattctttctttcagtgaattgtaggcaccacccggtcattgaaactaaatatctgggatcatcctagtgtcttctcccatattgctctgacaacaaataaccaccacaggctgcccatgtacttcctgaacctgtcttgaatttgttttctcctctcatcctcaggactcctgcctttaaaaaacatctctcctctgcatcatctcagcagcttcctaactgatctccttgtctccattttgctccgtatccacccccgaatccgttcccattcaggatctctccaaaaataaatctgaccatctaatggacctg

SEQ ID NO: 604179 - DNA, 1493 bp, Homo sapiens
aaaagctacacttgagctgacacacaataggggcactgaagatgatgcagacccagagattaccacaatggcaatatcagaccctcgaggattcggtcatataggaattgctgtacctgatgtatacagtagcttgtaaaaggtttgaagaactgggagtcacatttgtgaagaaacctgatgatggtaaactgaaaggcctggcatttattcaagatcctgatggctcctggattgaaattgatgaatcctaacaaaatggccaccttacatgtagtgctagtgagaattctccttatgcagattctcagcaagaaaggaaacaatgtgcattcaagatatctacataccagcaagcactctcaggactgacatggatcaactgtacccgaattcacactataataactatacagattcacaattatacacccttcactatttacaggactgtccttgttacacctaactgtacagttccatcctgggttttcacagccagaagcatctacatcctcaatgttccctcgaaataatagattgtcgtcaaccataccatcacctacaggctaataactaacgaaacacgtaacccctatcaaaaaggacagacatccaggacctatcaattcgtagacaccacacataatgaatagtataccatcagccactatccgaacaatgtattgacccttatgggaaactgaatccgagtatatcaaacacacaaaaaagacattagacatcacgatgatcatacgacgaggagtcacaacagagacgcaatggagcagcgtgcatcacgcgacccgcgcgacgacgccaagcaccatacaagtacaacaccgggagcgggagagacgagcaaaaagagtaacagagaccagaaggcggaccacatggacaggaaacgaaacaaagacaggtggaatcagcccatcaaacgagaacacagacaaagagtagagcacgaacaccgatacaatccaagagtacgtagtcagaagacaagtgacatctatcgtaaactgaactaagcaggtaagactatgaatagaggaataacgacatcacggaaagcaagaacagcgtaacacgaaaacagcacacaccaagaagaagagggaaccatgagagaggagaagaaagaaaacgaaagatgggagaactaggagcagaagaagagcaagagagaagaaaaaagagaaagagacgagaagaaggcaagagataagaagaagagaagaagcgaaaagagcggaagacgcgacacatagcggaaggaacaacggaggcaacacgagaagaccatgcagacgacgacgacgaagaagtaaagcagaaacagagaaagaagacagagaagagcgtaagagagagacagaaaacaggagcacagagacgagaggaagaagcgagcaggagtgatcagggaaagaaactaagaacgatgagtctgagagacagttgggagagatcaaaagacagaaaaa

SEQ ID NO: 604180 - DNA, 817 bp, Homo sapiens
atgacatgcctggacccttgctgccggaagatcttgcacgatggatcggctgcaggtggtggaaaagcagaaccttagcaaagaggagctgatagcggagctgcaggactgtgaaggccttattgtccgcttctgccaccaaggtgaccgctgatgtcatctaacgcagactgataaacgtccacggtggtcggtgcacgtggttggcacagggctgtggacaatgtggatctggaggcctgtacacaggaagggcatcttggtctctgaactaaccgccaaatgggatctgcctcagtgaccgcagaactcacgttgctggcactgatacattgtgccgtggccaggtcgagaattccccaggctgagcgggcttcgcattgcaacgtgactgggacaccttgggaagcggacaggaaagtaccacgtgggaacactaagaaggggtagaacctgcgaacactgaacccaccgtaggggggaaaatacctgtgaggcgcccttaggggcaatgggaaccacttgggcgaaggaacgacagggacacagagaaagaccacagggcaattacaccgggtcccacaactctggcgaggccagttggccccaagaacagggtagatcaggcgcggcaaactgacaacgcccacgcgcaatgttcgattatgcatccccagcgcaccaggaacagaatctacttccggagggccatgttccacgctacatcgatcgactgcgaatcgacgacaacaagcgaacatagaaggccccactgagcaacacgacccgcactgcctgtggaggaactgcgacaccg

SEQ ID NO: 604181 - DNA, 274 bp, Homo sapiens
agagatagtgcactacatgcaaagcaaaagcctcccaaactgatgtctaagcttgtgaggcaaaaacatcaaaatctggccgggccgcagtgctcatgcttgtaatcccagcacttagggaggtggaggtgggcagatcacttcaggtcaggagttcgggaccagtctggccaacatggtaaaatgccgtctctactacaaatacgagaataagctgggagcagtgcttggcacctgtaatctcagctactcaggcagctaaggcaccagggta

SEQ ID NO: 604182 - DNA, 191 bp, Homo sapiens
gaaacccactagtgtaacacttggagtgacccctctctatactaggagttatacattatcctgatcaggtcatatggttgaactacgttaacagtgctgtacgcgcttgtaggtgtagtgtagggatatgtgtatacatatttcttaccattctcactctaatgagaagagcggaatgacccatatttatt

SEQ ID NO: 604183 - DNA, 442 bp, Homo sapiens
aagccatttacccaactcaagtataggcgatagaaagtagaaaactggacgcaagtacatatagtaccgcaagggaaagatagacaaatactaagcaagcataatatagcaaggactaccccctataccttctgcatcatgaattcactcagcaaatacaccttgcaaggcagagccaaagctaagacccccgcaaacccgacgcagctactacagcaccagctccaaagagcacacctgatctatgtagcaaaatagtgagaagattaataggtagaggcgcaaagcctaccgagcctggtgatagctggttgtccaagcataaatcttaattcaaattagaatttgaccacagaaccctctaaatccccttgtaaatttaactgttcgtccaaagaggaacagctctttggacactaggttaaccgcgcccgggtaccgc

SEQ ID NO: 604184 - DNA, 371 bp, Homo sapiens
tggcacgcgagaagggcttcatcatatgttacgagaactaacagctataaggcatatctgtcactactgttgagacctgaagcgagaccttgaggctcatacctggtgagatcttatgacaagataaggatataagaggataggcgtgccccgaatagtggaccaactggacgcgtgacagtgtatgtctggagcactgcaagggttatagcccagaggatccaaggtgggcccatattgagaggagcaccctgtcatgggagaaggagagctgtgttcgtacatattgaatatgtgagtgcacggtggatccactacccttatgagtctggagttccctgaggctttattcagagggcatggaccgtgct

SEQ ID NO: 604185 - DNA, 226 bp, Homo sapiens
atagccgattccagaggtatccccgctctccagtcgcatcatcatactaacatatatatggaacttctcttcaactattcagacataaaccacataacgttttctgtttttttttttaaaattgagtctcactctgtccacccaggctgcggtgcatcggcgcactcttgcttcacggggacctccaccccccaggtccaagcaattctaccagcctcagcctccc

SEQ ID NO: 604186 - DNA, 88 bp, Homo sapiens
gacagcagcttctacatctgcagtgctgcctgggcagggggtgactacaatgagcattcttcgggccagggacacggctcaccgtgct

SEQ ID NO: 604187 - DNA, 132 bp, Homo sapiens
  misc_feature (28)..(28): n is a, c, g, or t
  misc_feature (47)..(47): n is a, c, g, or t
  misc_feature (59)..(59): n is a, c, g, or t
  misc_feature (79)..(79): n is a, c, g, or t
aattcaaagcttctaaccgatgtacggnggacatgggctcttacccnttccctgcgggnctcttctcccccgacacatnttgttaaaatcaaacctgaataaaactacaagtttaatacgaaaaaaaaaaaa

SEQ ID NO: 604188 - DNA, 561 bp, Homo sapiens
gtatcatatagccttattaccatattctatagcctccccctgatctgctcttcagtcactggagtctgtggtttatgattcagttcataaaagatgtataaatagagaagtcctgaaggagtccctagataaatcttggttatctatacagtcttccacttttacaattatttcaagtcagcaagcctttccttaatgccaatcctagcactaagaaccagggacccagagacagacaaagcacaatccctgccctcaaggaactcattctagtgaaggagactcaaatggaacaactgcaattcaatgcaatcacttggacagcagaaagatcagagaaggctttctagaggaggggaaacagaagctgaggatgtgaacttaaagtttgcctggaaaatatggcacggaagagcacttcaggcagatggaagtaggtgtaaaggaatgaattggggattgggggagcatagagagataaatgagatggaaagggagaaagagataggaaacagagataaagaaagagaaagatcatggaactacacatggtcctggttg

SEQ ID NO: 604189 - DNA, 152 bp, Homo sapiens
ctgacttcgatagagaaaggttagactgtttggaccaaagatgaaggaaagtgatggtagagaaacacctggactaatcttattagtcgtgtcactcttcttgaacagaatgctttgtctaaaagatgtgaatttatagagtttgatgagtt

SEQ ID NO: 604190 - DNA, 378 bp, Homo sapiens
agcttaagcgtcagggtcagggtggtgggagtggcaccccagaggaatatcccttgagctttagcgacatgctgcagggcaggacagtctgcggctccgttaagagctgccgcggtcacaggacccacattagcttgcacggcaaaccaactccttggcttcctcaaggatcgtggggaatgtctcactgtccttggacacctttggcaggaacagcaagcccatggcatcaatccttgggtcagctccgaaagcaggcagagatgtggacttgcaaaccccgggccttccttgttgggcttgaagggggcccctcttcttccggtcggaaattgcttgcccctttgacttgccaggggtttcctaagaaagaacctg

SEQ ID NO: 604191 - DNA, 884 bp, Homo sapiens
ggtgccccgatcgtctgagacgtgtagggtctttaggaatcctgaggtgtctcatagcgttcccccgtgttttgtgcgcgccttgtatgcccgttcaatttccggggtatcttaccccgctgccggtgttgccgcccagggacgcctgtccccggggttttttccccgctttggcgccgcctggggtttaataattatttttcgggtgccccgttgagactgttagcttaacgggggcaaaccacaaaagggcctccttttgggcgtgaggagacccgccgttgtagacggcgttagccctttttcaaaggggccgcggtttgtctctttgtttctttggaccgggaacttcgcggttggttttgctcacgcgtggagacacaaggcggttatcagtgccgcgcaataccgacctatgcgccttccgggcttccaaaaggattgtgcctggccgccggcacatctcctgggttatctcgggattcaccacgcggcgcgcctcccaccgcataaccccacgtgatattttagtagtatctaagagaacaacggggtctttttcaaattggcgccaagtgcggtgttccgaataccggggcctcccaagggtgctcatgcgctcgcctgtgggcgcttccccaaatgttggggggtaacaagggctggcacgcccccacatgccccagcccgtacaggacattcatggcttataaaacaagagcgtcaccacccctttctatgcgatgcatgccaggcacttctgatgaaaaatataccatcgtgtacgaagttcatgggaatatttgcttgaatgaggagccctccatatccccttggtggaggaaaaaaaaatacaaaggggcaggggcgggcaatccatgaca

SEQ ID NO: 604192 - DNA, 236 bp, Homo sapiens
  misc_feature (4)..(4): n is a, c, g, or t
  misc_feature (13)..(13): n is a, c, g, or t
  misc_feature (40)..(40): n is a, c, g, or t
  misc_feature (49)..(49): n is a, c, g, or t
gggnaaaagaaanactttattgattgctcagaatgcaggntggacccanacttaaccacacttacgcaccactctgccactcccgccactttgcctctccagctgaaatcttctttcagcaaggcttcgccagccttgcattagtctcagctatggcttctgaacccagtcctggatggaagtcaccttcacatacacaccatactcaccacacaggctcttatcaaacttagatc

SEQ ID NO: 604193 - DNA, 163 bp, Homo sapiens
aacccgatccctatttgtgagaaaccagacagaggcctgaggtttcaggccagatttatggggaatggggttttcacgtgtggtccacgttgttaggacccacttagggaaacaggtcgcctgtaaaaatagcgacgttaataaaccagaacaatggtttata

SEQ ID NO: 604194 - DNA, 749 bp, Homo sapiens
  misc_feature (219)..(219): n is a, c, g, or t
  misc_feature (385)..(385): n is a, c, g, or t
  misc_feature (402)..(403): n is a, c, g, or t
  misc_feature (409)..(410): n is a, c, g, or t
  misc_feature (422)..(422): n is a, c, g, or t
  misc_feature (425)..(425): n is a, c, g, or t
  misc_feature (433)..(433): n is a, c, g, or t
  misc_feature (438)..(438): n is a, c, g, or t
ggcggcttgctcctcttccggtcgcggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggncccatgtcaagcacctgtctgccagccagaaggcactgaagggagaaggagaaggcctcctggagcagcctctccatggatgagaaagtcgagttgtatcgcattaagttcaaggagagctttgctgagatgaacaggggctcgaacgagtggaagacggtggtgncggtgcatgtcttcatnngttacnngcgctcgtatcntgnggcagaangcacnatgtttacggcccctccgcaaagtttgacacaagagtgggtggccaagcagaccaggagggatgctggacatgaagggtgaaccccatccaggtttagctccaggtgggactagaaaagaacgagtggaagaagtgagagattgtggctgtgctgactgggctggtctgtcacgcatgaatcaatgctattaatggaactgttatgcaaggttgacatgtataatggcagttaccaaaaaaaataaaagaaaaatttgggggcgggaggaaagtttaacaactgtgggcgggcaagatatgaaggagtgca

SEQ ID NO: 604195 - DNA, 739 bp, Homo sapiens
  misc_feature (219)..(219): n is a, c, g, or t
  misc_feature (432)..(432): n is a, c, g, or t
ggcggcttgctcctcttccggtcgcggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggncccatgtcaagcacctgtctgccagccagaaggcactgaagggagaaggagaaggcctcctggagcagcctctccatggatgagaaagtcgagttgtgcggtattgacagggacccatcagggcgcgcccagctacgcttctcgagaacgcgatgtctgtgacagaagccatcgtgctcatcttcgtggagccgtacttgtctaggagagcangtctctgcagacaggaggggttgactctgcgtgggctattcggaggtcactgtagcacagggccccgagttgtatgtgcgtcaccgagtcacttagctctgctcagctgacaggatcttctgctgggcccccttctctgtgctgagtggaggtagcctctcagcgatatctgctgggataagacatagttaacgtgtaagattcattcgaacagacacactcagcataaactgcatacgtgtctggtctgaaccggggcaccagaaactaacaagattacaataggaccctaatactgtaactccca

SEQ ID NO: 604196 - DNA, 206 bp, Homo sapiens
tacagaggcatacagctacaccatcacggacgagcgggaaatcgtgcgcgtacatcaaggagaagctgtgctacgtcgccctggtacttcgagcaccgagatggccaccgccgcgatcctcctctgactctggacgaagagctacgatgctgcccgagtggccaggctcatcaccacttggcaagtgagacggttccggctgtccg

SEQ ID NO: 604197 - DNA, 432 bp, Homo sapiens
cattttttcctctccgtatggcataccacacctgtgatcccagaactccagagtcagtaagaccttgtctcaccgtgcagcagcaaatcacggatgacagatgaacagcaaaggaactgtccctccacgtggcaggaaggaacaaaagagctttgttgagcagcctggttgtcgaattttacgggttttaggaattctccttaattaccggggaactggcaaagttcataaatggtatcctcagtatgaaagtgcttttctcaaaatatcagccatacattaatggctaccagcacacccctgctcaggcccagaaatctactctgccagctcctaccctgttactccacctccccatcaacttcgaagttctgtttgactcccattgcttattttattttgcttttaaaaaacaaaacaaaacaaacaaac

SEQ ID NO: 604198 - DNA, 256 bp, Homo sapiens
  misc_feature (189)..(189): n is a, c, g, or t
  misc_feature (197)..(197): n is a, c, g, or t
  misc_feature (242)..(242): n is a, c, g, or t
  misc_feature (252)..(252): n is a, c, g, or t
caggaagaaaatctatggaaagagaaggctacgagtcctcgggcaatgatgactacaggggtagttacaacaccgtgctctcacagcctttatttgaaaagcaggacagagaaggtccagcccttccacgggaaagcaaacttcacccatttcaggacatctggtacccccgggccttcatcaccttgngaaaagancagcttgcttgggtcccgaagaccccaattggaattggtattgantggtcggcgnttca

SEQ ID NO: 604199 - DNA, 362 bp, Homo sapiens
ctggcctcccgagtagctgggaccagaggcgtgcaccgtcacacccagcttcaagtctcttattataaagttctggccacgcacagtggctcgcaactgtaatctcagcactttcggaggccaaggcggtcagatcacctgaggtcaggagtctgagaccagtctggccaacatggagaaactccgtctctactaaaaatacaagaattagctgggcatggtggcacacgcctccagtcccagctactcgggaggctgaggcaagagaattgcctgaacctgggaggcagaggttgcagtgaaccaagatcaagccatttgcactccagcctgggcaacacagtgagactccgtctcaaaaa

SEQ ID NO: 604200 - DNA, 190 bp, Homo sapiens
cagaagtgaattagcagatattgaggctaccttactctgcaatgattactagatacttgcagggagcaagtagacccgaacagcggctactaggcagctaaggcaaccgcttgagcaatgtggagttttgtgggcgaagctacagctgggtgtgtttcagtagatttagtaattaattgccaagacccta

SEQ ID NO: 604201 - DNA, 179 bp, Homo sapiens
caagctgctgggtcatgggaggggcctcaggccgcaggagggacacgccccttcccagactcctctgagctctgccccgggctccctggctgcgttcgcgcgagaggctgcgttcgcgagcgagtctgctttagcgcgagcggctgcgttcgcgagcgcggctgcgttcgcgcgcgagt

SEQ ID NO: 604202 - DNA, 148 bp, Homo sapiens
attctatcactgattagagaaatgcaattgaaaccaagtgagataccatctcaacagtcaaatgctattattaaaactcaaatataccttctggtgaggctgccgagaaaaggggatgcttatacactgttgatgggagtgtaaatta

SEQ ID NO: 604203 - DNA, 159 bp, Homo sapiens
aaaccatcatgcgcaaacccatcagccgcctggcggcttttatcggcttgggcgttagcctggtcgccagcagtctggcagcccctgccgtggcacgagcagaaggcaagatccgcatagccgagcagtttggcatcgtctacttgctacttaacgtgg

SEQ ID NO: 604204 - DNA, 741 bp, Homo sapiens
  misc_feature (73)..(73): n is a, c, g, or t
  misc_feature (241)..(241): n is a, c, g, or t
  misc_feature (245)..(246): n is a, c, g, or t
  misc_feature (248)..(249): n is a, c, g, or t
  misc_feature (253)..(253): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (269)..(269): n is a, c, g, or t
  misc_feature (275)..(275): n is a, c, g, or t
  misc_feature (328)..(328): n is a, c, g, or t
ttttttttttctctcctgcttccctcatctgttctcttccaaagaagctggtccttagcctgtattgcggacnagctttcggcgaccagctggaccctgggcacccttcttcgaacaatggcttttaattctcagactagaacgtttaggattacaaaagaaactggttcttttcacattcttattcttgtgatgtagcattccgcatatatatatatatatatatatatatatatatatntatnnanntatntaanananactacctncatcantccatgccattagacatgtataggaccatgcatggtgatctcctccagacaanagtaaatgctggtgcagaacaggatttgagtttgatgtcttgcatacaatgtgatcccactgtatgactacacaaatgttggcaaaagtgagttcagaggaaatggtaggcaagtacttcccagttttggccagaagatggagaaaaaagaattctcaaaaaatgttaaaggtgtctacagagaaatagacaagtgatgcacgacagatacatgtgtcagtctggtccctgcagttgtatttgtaataatacacattggagcaatttcatggccatcggttagagaatgtttgaagaatgatccattcatatcaagaaggacattttaaagatcaaaacctgatggaaatgctggagaccatggcgctgataggagctcatgcctgtggaccaattactacgtgacatgcttt

SEQ ID NO: 604205 - DNA, 1794 bp, Homo sapiens
  misc_feature (339)..(339): n is a, c, g, or t
tggcccctggggattcccgcaccactagccccagctgcagctgagccgctctcagtgcctcccctacctaccctacctgcccaacgacgcacatacacacacagactgaaacaaaaaacataaacgcaaaagaggaacatacaacataccacattcaagcaactacaaacaaacaactacggagaacaaatacccagactaacctctacagacatacatgtaaactaagatatactacgaactacatgacgtcacacgacgataaacatagactacactatatgataacatagctatacatacagacatggccacatatacacagaagattaactaagntaagcacacatacatatacacatacacacatacatatacaccacatggagagacactacgtatataaactaacagcacatgaacacagaaatgtaacatatgagctaaatacacataatactaaacgaatacctaggcaccatactctgaatagtgtagggcgtacacagagccacatgtgtgaaagataacaaaacataggaacacaaacccgacaccatacccggcactaataaaggaacaacccacacatacaaagaaatcccctacagaacggaccgaccagacgatagcaaaacatgggcgacacgtggcaaacaataccaagtcccaccaatataggccagcagtagacaaaggaccaaaaaaaacaaccaagccacaaactaccacgtaaaccacatacattataccgccacaaattacaggacagcggagcacccaggcataagtaaaacacatcaccacacaatacaaacaaaacaaaacatacatcatgaaacagaaacccacagacagaggagtccgacccaaggaccacacaaaccaccaaaccacaatcaaacaaacaataacaataaatccaacccaaaacacaacaaacaaaaaaggagagagaaacacacaatacacacacaagaaatggcacaaacacacacaacacaagggaacacaacaaacaaaacgacacacaaaaaacagagcagaacgcaaataaaacagccagagaaccaaaaacgaacacaacatccacaactcagccaaacaatacaaccccaacaaacgaaataaaaacgacccaaagaccacacaaaaacaacaaaagagaaaaacatgaaaaaacaagggaagcgaaacaagaaaaaaaacaaaacagaacggaaaacacggcacagaaacagacaaaaataacgaaaaaacgaaacacaaaagaaaacacacgaaaaacaacaaagcatacaagcaaaaaacaaagaccctacaaccccaaaaaaacacccaaaacaacgaaaccaaacaaccaaatcaaaaacaccaacacaatgaacaacacaacacaaacacaccacaggaaacaacaacaaacaaacaacgaccagaaacaaacataaaaaacaaacaagacaaacacaacacaaaaacattcgaacaacacacacacaaagagacacacaaaaaccacaagcagagcaaaaaacccacaaaacacacagacagtacgatcaacaagcaaaacaaccaccacagcaacaaaatgacaaacaaacacgaaagcagaaacacaagaccaacagaaagaagaagacagagaacaaacatgaaaaatgagagacaaacacaacaacacaagagaaccaaaacaccaaaaacaaaaccgaccaaccaaacataagaaaccacacaccaaaaaaagacaaccatccacaagagaggtggagaaacaccaacacaaca

SEQ ID NO: 604206 - DNA, 706 bp, Homo sapiens
cgcttccagatctcgcctgcttctgagaaagatccgtgatgctgatgcggaggatggtctgactggatcttctctcggctggcattgagccacagcatgtatgcagagatgggcctctggggggcataggggtcttagcccttcttcacctccacaggcttcttgcgggtctagcggtcgtgggccatcgtggcctttatgagctgtttccggttcttctcatcccggtcattgtcaccctcattactggaggagctggcagaggcgtggctgtcaaactcctctgccacatctgtcctcctcttcaccgtgggtggaatgactcatcggtttcttctcctgagtcatcgctgctgtcagtggcattctcctcccggatcttgccttcctccttcatcctctccaagtaggcatcatgctggtcctcatcagagtcagcatattcatcgtagcttgggttcatgccctctttcaatcctcggttttggatgttgagctttttcgcgttgacaaaatcaaacagtttcccgtactcctccctctcaatgctgctgaaggtatactgagtgccctgcttggtctcaattcaaagtcaaaggaagagtagtagtggtacacgagcaaagttgacaaggagactcatcgaagcgggtgcatggtcagggatctctgagtggacgcggttgagctggacgggggttaaaaa

SEQ ID NO: 604207 - DNA, 1174 bp, Homo sapiens
gcatttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgcatcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggcgcagcgaggagaagatctcggactcggaggggtttaaagccaattgtctctcttgaggaggctggagagaaaattacacacaggatgtcggtagtaagttgggaatctacctgctgatatcacggaggatgaattcaaaaggactattaggctaacatattggagaaaccagggagaaagctgtatggatacaaacaaagaggacaaaggattcggaatgtattaaaagctatgaagtgtaagaagcatttggactgaaattgggcaaaagccagaactggcttgataagagcca

SEQ ID NO: 604208 - DNA, 319 bp, Homo sapiens
  misc_feature (57)..(57): n is a, c, g, or t
  misc_feature (82)..(82): n is a, c, g, or t
  misc_feature (89)..(89): n is a, c, g, or t
  misc_feature (94)..(94): n is a, c, g, or t
  misc_feature (99)..(100): n is a, c, g, or t
  misc_feature (102)..(102): n is a, c, g, or t
  misc_feature (104)..(105): n is a, c, g, or t
  misc_feature (112)..(113): n is a, c, g, or t
  misc_feature (118)..(119): n is a, c, g, or t
  misc_feature (121)..(121): n is a, c, g, or t
  misc_feature (123)..(125): n is a, c, g, or t
  misc_feature (131)..(132): n is a, c, g, or t
  misc_feature (134)..(134): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (145)..(146): n is a, c, g, or t
  misc_feature (152)..(152): n is a, c, g, or t
  misc_feature (154)..(154): n is a, c, g, or t
  misc_feature (156)..(157): n is a, c, g, or t
  misc_feature (161)..(162): n is a, c, g, or t
  misc_feature (164)..(164): n is a, c, g, or t
  misc_feature (169)..(170): n is a, c, g, or t
  misc_feature (179)..(180): n is a, c, g, or t
  misc_feature (186)..(186): n is a, c, g, or t
  misc_feature (189)..(192): n is a, c, g, or t
  misc_feature (198)..(199): n is a, c, g, or t
  misc_feature (213)..(214): n is a, c, g, or t
  misc_feature (222)..(222): n is a, c, g, or t
  misc_feature (224)..(224): n is a, c, g, or t
  misc_feature (233)..(233): n is a, c, g, or t
  misc_feature (240)..(241): n is a, c, g, or t
  misc_feature (244)..(244): n is a, c, g, or t
  misc_feature (246)..(247): n is a, c, g, or t
  misc_feature (253)..(254): n is a, c, g, or t
  misc_feature (258)..(259): n is a, c, g, or t
  misc_feature (266)..(266): n is a, c, g, or t
  misc_feature (293)..(293): n is a, c, g, or t
  misc_feature (296)..(296): n is a, c, g, or t
  misc_feature (302)..(302): n is a, c, g, or t
  misc_feature (311)..(311): n is a, c, g, or t
  misc_feature (319)..(319): n is a, c, g, or t
gcctccggggtcagtttttgtagcctcggctcgcgcccgtccggcctctggcacgcncgaacttccggcccttggagcggangtagggnttggnggggnngntnncccggcnnccccnntncnnnaaagcnncngcnaaanantnnaaattnanannaaannanggatnnaaaggtaanngaaagntcnnnncgtaanncaatcaccctactnncgcccccnangcaaaaagnaaaggtnntgnannaggatnnaaannagccganttttttttttttttttttttttttttnttnattatnttaaacatntttttatn

SEQ ID NO: 604209 - DNA, 869 bp, Homo sapiens
gcatttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggctccacgacttccgttctccgccgcccggcatgggcctcaatcagaatcgcggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggcgcagcgaggagaagatctcggactcggaggggtttaaagccaattgtctctcttgaggaggctggagagaaaattacacacaggatgtcggtagtaagttgggaatctacctgctgatatcacggaggatgaattcaaaaggactattaggctaacatattggagaaaccagggagaaagctgtatggatacaaacaaagaggacaaaggattcggaatgtattaaaagctatgaagtgtaagaagcatttggactgaaattgggcaaaagccagaactggcttgataagagcca

SEQ ID NO: 604210 - DNA, 364 bp, Homo sapiens
cccttaaaaaatttaaaaagaaagtgaaattaattttaaggttttatttaatcctaggtatccaaaatatttaaaataggtaatcattataaccaaattagagattttatattattttgtttgggactatttgaaacccaacatatatttttacatttccagcccatcccaattccccctagccccgttttaagggttcaataaccccatggggctagtagctatcatactggccaactatggtaatattggatttttaaaaccaatacatatcaccaagggctgctattaaatcatagagaaacccagcccctttatgtctcctgattaaagccccctacttaatttgtccaggggtctccta

SEQ ID NO: 604211 - DNA, 335 bp, Homo sapiens
tttgcaaatttacaaaacttaaaaatgttcaattaacctcccaaagtttttaaaggccagaggaaaaattaagccagcctttatagcaaacccctgaaatttcccggaatcgttttgactggtgccctttggtttttagggcagcttttttgcaatggaaatggaatgctttggatttcaagttttttacccccaagacttcaaagttaaggacttgtaccccaagtattgcaatcccctttttttttttggacaagcaatgtaacaccccccagttttgggggttttaaaaaaaatcctctttttttttaaaaaaggaaatttttttgttttta

SEQ ID NO: 604212 - DNA, 218 bp, Homo sapiens
tagtatgcgtgcagctcagagacaggaggcagcaaactccccagtgccaggaggtgcttcagccctgaagtcttgcacctgtgagcaccaatcgcaggtagaggctgcgtgatggactgacattggttggacatgatagcttgagggccagtgtccggtgattgcgttacacaccctgtctgggcctagtccgggggggggtacccgagcctccgaat

SEQ ID NO: 604213 - DNA, 474 bp, Homo sapiens
ataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgattatatttggagagaagccagattattggtcgctaagcctaaaggtttgggaagaccaaggggttaactcctaatagtaagggggttcctttttggggttatgttaaactttgaaaggtgattgtggtaattgttgcaccactctggattttcttaaaaccactgaattgtatactttgaatgtttgaactgtgtggtatgtagattttatctcaagttgttataaaaaattaaattacaaatgca

SEQ ID NO: 604214 - DNA, 179 bp, Homo sapiens
agagcaagactttgcctcgaaaaaaaaaaaaaggctttttttgggcaaattttaaaaggggggcccttttcggggaagatacgtcctaatgccagggggcatggcctggcaatgggagctgggcctaaatgtcagccccaactcacccttttagacgagagcccatgtgcaatatgcca

SEQ ID NO: 604215 - DNA, 187 bp, Homo sapiens
  misc_feature (43)..(43): n is a, c, g, or t
  misc_feature (67)..(67): n is a, c, g, or t
  misc_feature (87)..(87): n is a, c, g, or t
  misc_feature (163)..(163): n is a, c, g, or t
tgcaatcgcagccgggagcccgcagcccgcgccccgagcccgncgccgccttcgagggcgcccaggncgcgccagtgaaggtgacgntaacttccgtctggccggaggcaagaaggacgagcccaagagcggtagaggcctatatccccccgacgcgcgcggngactgaaggccagatatgtggacc

SEQ ID NO: 604216 - DNA, 249 bp, Homo sapiens
  misc_feature (150)..(150): n is a, c, g, or t
  misc_feature (174)..(174): n is a, c, g, or t
aagcactggggcgctgcgagaggggattctgctgaagtggagatgcagtcagatgccctggatgcagctagaggatgattctctgtacatatcccaggctaaatttccagtcctggcaccttacacaggttaccgtccagattggtgccnagcttgaatcgtcggcctctgggncagtcttgtgcattggcgcatgatgaggacgtttgccactttgtgctggccaactcgccatattgttcagtgcag

SEQ ID NO: 604217 - DNA, 218 bp, Homo sapiens
tataaggctctaagggagctttttaaaatgataaggtggctgggctcggttggctcacacatgtatcccagcactttgggaggcccaggcgggcggatcacctgaggttaggaattcgagaagagcctgacatcctctctgcgtttcaaacgccagagaggacaacccagagaggcaacgcccagaggtctcccgttgaccaaggaactccttgtttg

SEQ ID NO: 604218 - DNA, 464 bp, Homo sapiens
ccaggagactccaggaagagcatcccaactgccacgcaataaaggccatcaagctacaaatggccttacaaatggaacctcaaatgaatttaactcaagcttctaccgaggaccccaggatcagcccactggtctcttaactggcctagaaagttccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaa

SEQ ID NO: 604219 - DNA, 816 bp, Homo sapiens
ctgcttcattctgccattcactcactgcagcatattcaagaataaagcaatatcgtttactacattttttattgaaggtcagccatgctttctgtattatattgcatatgaaattgtttacaaaagaaacactaactcatacttctctttacttggttgcaagtggcacgcaggaacagagggagagtggggggctggtgggggaggggagactttttgtgtctttgtccctgtgaagtgctgcttcgcagagccaggctatctctccaaggacacggcacgaccagtgggaatacgcacgagggactagactgccggcaagcacatttgcagcaaggacacgtggcggggtttccccacccgtcacgcccaaagcagaaacagctagcagacgtcgagcctcagccccgatccggggcgacagacactacagcaaggagacgctggaagtttaagcagatacgtttaatagcggtaatactgtgcggtctaactttatactctgtcttgagttattcctaccagagaaaaagacgtaacgtaacgctaaacagcacaaaagccttttacattaaagttccatccctcttgtcggggacctgcagggggggcaaccttaatccaaacaccgtggctatcaattatctcagaaggtatggtctcagacgggattccagtctccgggaggcaggggcataatgggggagggggccgaaggctgagagaccaaaagttccaaagcctccctcgaaggctctcctagaacgtgtattccggacattaatgtaccatcccatgtggactctgcgagtgtcc

SEQ ID NO: 604220 - DNA, 262 bp, Homo sapiens
tgggtattgtatgacacggcatatcaatggcaaactgtttcttcccaagtacgcactctcccaggatgtctgtacatacagagacttcatctacaggacggtagaaataccaggatgcccacaccatgttgctccctatttctcctaccccgttgccctgagctgcaagtgtggcaagtgtaacactgactacagcgactgtacacacgaggctgtcaaaacaaactactgcaccaaaccacagaaatcctatctggtagga

SEQ ID NO: 604221 - DNA, 356 bp, Homo sapiens
ttacctggtcccccacttatccgtgggctggggaactcacaggggctcatcagaggttccaggagacagagttcgagaccagcctggccaacatggtaaaaccccgtctctactaaaaatgtataatcagcgaggcgtggtggcttgcacctattatctcagctacttgggaaactgtggcaggagaattgcttgaacccgggaggcggaggttgcagtgagcagagattgcgccactgcactccaacctgggcaacagagcgagactccgtctcaaaataaaacaaaacaaaatcatgatgccatgatcagtgtttacttttggattaacacccggacacatgatagagaataaa

SEQ ID NO: 604222 - DNA, 111 bp, Homo sapiens
ccctcccacagaatagcagggttgggtgttatgtattgtggtttttttgtttgttttattttgttctaaaattaaaagtatgcaaaataaagaagatgcagttttatacaa

SEQ ID NO: 604223 - DNA, 809 bp, Homo sapiens
caggtgagacagcaggctggctcaagtggacagacgggattgcagagcgtgcggcgctggaggagctggtgaaacttcaggccagagcgcgtgcgaggcctcaagcagcagaaggccagcgagctgatcgagaggaggtggaaatctgaatgaggccagtgggtctgatgaaagcaacagaaatttgtgctcaaaccccaaggccaagagactatgtccccggagatggatcgcgagaaggtgttgacgtaatcatccgttgcttcaagcgccaggtgcaaatcattgatacacctgtattgaactaaggaaaactgatggaagtatgggaagactccaagcttatctatactgaaggacagggcggggagctcctgtcccttcgctatgactcactgttccttttgctcggtatttggcaatgaataactgacaacattaacgctacacatagcaaggtatatcggcgggatacccaccatgaccgtggcgataccgggaattctaccagtgtgattttgacattgctgggaactttgatcccatgatccctgatgcagagtgcctgaagatcatgtgcgaatcctgagttcacttcagataggcgattctggtcaagtaacgatcgagctctagatggatgtttgtactgggtgttctgaacagtccgtacattgctctcagtaacagtgcaggtgccggcgaggtgagaatgaatgtgaaaaggctgcacctagggtgcgctaggacattcacactggggactgtgacaggcccgatctaaacgcaaaagcgggctgacatagctt

SEQ ID NO: 604224 - DNA, 446 bp, Homo sapiens
  misc_feature (1)..(1): n is a, c, g, or t
  misc_feature (11)..(11): n is a, c, g, or t
nttgccctcangcccaagaattcggcacagctgcaacctccacctccacctcccaggttcaagcagttctacctcagtctcctgagtagctgggattataggcgcacaccaacatgtctggctaatttttgtgtttttagtggagacggggtttcaccacgttggccaggctggtcttgaactcctgacttcatgatccgcccgccttggcctcccaaagtgctgagattacaggtgtgagccacagcacctagtgaaagtgtggtttttttgtgtaggttttactgttgttagtgttgttctgtattgtttgtagaggatacgtggggagatttggataaaagcaactatcattattatcctcatcagacttgtaggtctaactttttaattttttaatttttaatttaaaatattttcatggtcttttatcattaattaagcgg

SEQ ID NO: 604225 - DNA, 417 bp, Homo sapiens
ggacaggaataaagagcacaagcgtgaggggagacaagacgaggacgtcagaaaggggggaaaggcaaaagaaaaaggggaggacagggtaaggggagtaaaagaagagagacgccaggaaaaggagagaacagggaggaagagaaggcggacaaggagagacgtagaaaaggagggagggaaaaaagccaaggagaggagaagagagagagcagagaagagagagaaggaaagagggcaaggtgaaaagaagaaacggagagagaaagggaaggacgagaaggggaggaaaaggagcgcaacagaaccgctcgcactcgctctcgctctctcgctcgcactcgcgctctcactctcgcgcgcactcactcgctctcacacactctcgcgcacgcacacacacacacaccgcgtgga

SEQ ID NO: 604226 - DNA, 491 bp, Homo sapiens
  misc_feature (413)..(413): n is a, c, g, or t
  misc_feature (486)..(486): n is a, c, g, or t
gtttaacgggtgacagcatctgtaaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggntcactgcaacctctgcctcccaggttcaagtgattctcctgcctcagactcccaagtagctgggcttacaggnacgtg

SEQ ID NO: 604227 - DNA, 104 bp, Homo sapiens
cttttctgccaacgatcgctgggagagttctctctgcatcaccagtggcagatggaaagtgatttgccctgctgacactatcagatcacgagtcgtgggagaaa

SEQ ID NO: 604228 - DNA, 316 bp, Homo sapiens
acgcgtcaagcactgtctcacctccgatgcccctcttcccgatcacatcatccttgtctaacacctcggcctggccgggtgagttccatctccgacgtcctgtagcggcacacgctccccgtggtgtgcacgtgctctcctgcggccgtccatgtgcggccttcagcagcatcgtctcacggctacagagatactgcaactgcaattcccagcccccgacccccgtgaagatcgccgtgagaaaagcggcaagaaattaactcagagccatcctgcggctctatgtgaagcagctgtcccaacaaagacacccgat

SEQ ID NO: 604229 - DNA, 215 bp, Homo sapiens
gtacatgaatggaacaatcatggtatactagctgtaacctagaccttccaggctcaagtgatattcccacctcagcctcctgagttgctgggaccacaggcatgcaccaatgtgccaagctaatttttaaatttcttgtaaaaatcgagtgtcgccatgtagcccaggctggtctcaattcctgagctcaagtaatccacctgcctcaagtaaag

SEQ ID NO: 604230 - DNA, 881 bp, Homo sapiens
ctgggggttcgggaccagtcctgggaccgaagctggttaggacccattgctcaaaaaaaaaaaaaaaaaaaaaaaaacgggggagagcccaaaaacgtaagccacctgcctcgcgggggaataggtgtgttcacctctgtggggacgcgtcttctgttgtcgtctgtcccccacgtcgtcgtgtctattttgggggcacccccccgggcttctggtgtttccacccctgttgttacaccacctgcgggtttgttgtgcaccagattgcgtgtgtgcgtctttttctcagctggtggggttccacccccatcttcgccccccggctgttgttcttttcactctccttcttgttggccccaacggggggtttgggtgcccccagagcaagagcgggagagagaaacttggctggggggcacaaaaccgggggggacacaaaaagtgtctttacggaccaccccgggggctagggaggaggaacccccggagggtggctgtggggcccccccaccaacaaaggggtgggcatcaacgccggcgaaaaatgcacgcccacacaaaaagtggtggtgttcaagacaggggggaggggagaaggaatacacccccagggagtattgagcagcggagcggagcgatcacagaaaaaaactagcgacccccatgtggttggtattcacccccctgtggtggttccccccagaggggtgtggtagatcaatcggacgagggaatgaacccaaaggtggcacccggaccgacggtgttgggcgtaactaccaaaaacgaccctggtgcaaaatggacaaaacgctcccgtggtgtataaaagacagcaacaagttttttgtatcacacaccagacagtacaacacttgggt

SEQ ID NO: 604231 - DNA, 789 bp, Homo sapiens
accagcctgaccaacacggagaaaccccatctttactaaaaatacaagattagctgggtgtggtggtgcatgcgtgtaaccccggctatttgggagactgcagacaggagaatcacttgaactgggaggtggagcctgcgagtgagccaggatcgcaccattgcactccagcctggttaacaaagagcaaaactctgtctcaaaaaaagaaaaaaagagaaagggtggaaaagagggattccagagtgccaggcacacagattttctggaaggtttacatgaggtactgctgtggtttgaatgtgttccccaaagttcatgtgttggaaactcaacccctaatgcaacagtgttgatcagtggaacctttaagaggtgattaggtcatgaaggctctgccctcatgaatggatgaaggtagggtgggttagttatcttgggagggggttcctgataacaaggatgaggttggcttcctccctttctgtctttccccttctccctctcacatgtggtcactctcttgcccttttaccttccagcataggacaacacagcgagagcttcacctagatgcaggcccctcactttgcccaggtgttcagaaaccatacatcaagtgaacccttataaatcagccagtctgtggtattctgttatagcaacacaaacagactaggacaggacactcgtgagctctttctctcttgtaggacctcccgggggggctgattgggactgtctgggaggcttggggtccaggctttttgaggggtacaaaaccgagtt

SEQ ID NO: 604232 - DNA, 1099 bp, Homo sapiens
  misc_feature (1099)..(1099): n is a, c, g, or t
cgcagtggctcaggccgtgtaatcccgaacattttgggaggctgaggggggcagatcaccgtgaggtcaggagttccaagagcagactggctgacatggtgagaacatgtctgctaataaaaatagaataaattagcatagtgctaattcagcgtggtgaatgcgccagatactcagggaggcgtgtggcacgacgaatcgcttgaacctgggtggcgagagggttagtagtagagcctagatcgtgcctagtgcactccagtcctaggtgaccagagtgagaccccgtcttgtaaacacatgtaatccacatataacatggaagttttagcaatactaaagataacagaacttcgtaagcatggtcacagggatatcgtatgtgaagttagaataggtacggctttgcgataaggggatgatgaagacctacttgagcgcgcaaagcacgtggtcatgcgcagtccagggtccaagactgttcccgtgggggtcgcataggttacatgaatccagcctatcagccgcgaggtctggaacccaaaacttgctggcaggcctcagccaaatcgtcagaacgtactcttggggaactctggagacagcttccaaggaatgccccatttcattccttctatataggggacctctcagaccgcagggggtgatcgcttgaagcctggcctccatgcactggatgtgtcctccccccatgtgtggtccaggaacttagtccaccctgggcctcctgggccccgggtgtaggtgcagcaagcccccaaaacacaggcctttcctagaccaagggacttaccaccaagggagcgacggccgccattcgcgcctacaagaacgcacctgcgcaaggcgaccttcggataaggggatgccccctgtaccagacacgacagagcctcagacgtgctcaggaaggtgaaagtcctctgtgtccaaaaatcagcgtatgtaccaacgtaaaacgataaacgaggcgtacaactaacgcatacacacgtagccttacgcgacgcatgaggacgacgagtaaaagacaagtcgtgcaacatccgctggcgtctgccttatttcctcctctggn

SEQ ID NO: 604233 - DNA, 182 bp, Homo sapiens
  misc_feature (6)..(6): n is a, c, g, or t
  misc_feature (14)..(15): n is a, c, g, or t
  misc_feature (43)..(46): n is a, c, g, or t
tctaanaaaccccnnaacagtatcgctcatggtggtcttagtnnnnccatgaaacatcttttcatgtgcttttcgtcatcctttttagtaaaatatctcttcctatcttttgtctattttctaattgaatttttttttgttttactgttgagtttttagagttcattatatactctagatat

SEQ ID NO: 604234 - DNA, 271 bp, Homo sapiens
acactctgtaacttcctgttatctcagtgtcttcatctaggcacggtgagcatgacaataaaaagcacttatcttgaagtagggaggagggctgcactgagataacacatagagctagagagtaacacaggcacatggtgtagcataagatgagtgtggttctgatcacttattccacaagtgtgtaatgccctactatgtcaaaggcactgtgatggcggtgggggatcagttgaataataacagacatgattcctaccccacgatagca

SEQ ID NO: 604235 - DNA, 485 bp, Homo sapiens
ccagaaacagctccagagtagctccagagtgatgaaggtgaaaccagcatttctgttatttataacaagcccctttcaaccacacctgagactatgttaatgaggtgattattggaaaatccctagataactacaggatgaagggttggttgccaaggggacttactgtgtgcttagagggttgagactcacagccccacaccccatctcacatccagagaaggagagaggctgaagtttaagttgatcaccagtggccaacaatttaatcaatcatgtctacataatgaagcctccataaagtaccagaagagctgagttcagggagcttccaaattggtgaacaagaatacattaacctgctggaagggtggcaccctccacctccacagggacagaggctcctgggcttgggacatttccaaaccttctttctttggctgttcatttgtatcctttcatgtatcctttataataaatgcata

SEQ ID NO: 604236 - DNA, 81 bp, Homo sapiens
gagagagatgaagggtcttactactgtgcctgtgacacgggggaccctcgggctttctcctgggacacccgacagatgttt

SEQ ID NO: 604237 - DNA, 201 bp, Homo sapiens
gatcacctcattgaggacatctgggatgctcacatttcttggactgtgatgaataaggctggtatgaacattgatgtacaggattttgtgtgaacatagttttcatttctgtgggataaatgcctcagagtgtagttgctgggtcagattgtagctacatgtttagttttttacatagtttgaatgcgtccgtcgaatttg

SEQ ID NO: 604238 - DNA, 144 bp, Homo sapiens
gagcccagcggctgtggcagcaaagatgtgtgttgacaagtagagtgagcaagaagtggctgctgtgagatgggtggagtgagctggatgaagatggagcaaagatgaagagtgctgagtgtgtgtgtgtgagctgtgggcctt

SEQ ID NO: 604239 - DNA, 295 bp, Homo sapiens
caggtggatcgcctgaggtcaggagatcgagaccagcctaaccaaaatgatgaaacccagtctctactaaaaatacaaaaattagcggagcgtggtggcaggcacctgtaatcccaactactcaggaggctgaggtaggagaatcacttgaacccaggaggcagaggttgcagtgagccaagatggcaccactatactccagcctgagcaacagagtgagacgccgtccaaacaaacaaaaaaaaaatacagttattcagttgtcctagccacatttcaaatgaccaccatatta

SEQ ID NO: 604240 - DNA, 514 bp, Homo sapiens
gactgcccaggcaccactgcaacgacagaaaaggttgttttcacctttaatgtaataataacggccacttatgcaaaaggactcaccgcgaagatggttggaactgggtggcatataacaaactcacaaacttatctggccaaacaatacagctgaaaatcaaatttaattatgctgactcactgaagccagaaaaaaacacctccagatagctagcatccaaaaaatttgtcaggtcacccatggtagttcacacctataatccctgaactttgggaggcagaggtgggaggattacttgagcccaggagttcaagcccagccttggcaacatggcaaaaccctgtctctacaaaaaattttaaaaatagctgggtatcatggtgcacacctgtggtcccaactattcaagagacagaggtcggaaggctgcttgcgcctgggaggtcaagggtatagcgagccatgattgtcccactgaactctaatctgggtaataaagccaggaacctag

SEQ ID NO: 604241 - DNA, 190 bp, Homo sapiens
ataagagtgactccttcaagtgtggcttgacttgacttccctcgcgggcccacttggacatccccatcccagaaccctccacccaaggatgatgagatggaaacagataagcaggagaagaaagaagtccctaaggtgtggatttctcccgtggggcaaggacgaagtgatgtaaagtggggcgagtaac

SEQ ID NO: 604242 - DNA, 1182 bp, Homo sapiens
  misc_feature (237)..(237): n is a, c, g, or t
  misc_feature (267)..(267): n is a, c, g, or t
gtcctccaaagacggttctaattttggacggccgccttatttgttctaatacataaaagttcgtgtcctccccaatatgtcacgtgttctccatccgccccggggtttgtttctccccacgctggcctacccgtttccctcgcgggttgatctcctagttctgcctcctccgccttgctttgtgatcttttaaacaaggctccccccttccgtgttcttctaaaaccggtaaccacntgggccaacccgctgttgtttgacaacccncctgagaaatctctgcaaaacctcgtttggtgaaaagatcttccctccctcctttttgatgccgtgcaaacaacatatactgcgtctcttcttacaatcatcgggcgacaactatccctcgctatctgcccccaccacttgggcctcgggtcttttcatatcctttatcgcacctggcgtggggagcctgcctgttgcggttttaaataaaccacacgaccagtagtaacatggcgcgtaccaccaaagatgttccaaatgagagagtgacgggcgctctctatcaaaggatacaaaatacaaggggtgtggtcgtcccagagactcccttccccgtaaataagatgccgggttttattagaatcaacaaacctcaaatggagccacctctgggtgggctactcccaacaaataaatacattggcaatgaggacaatattaaaggaaccatcttatagtgggcaagcggcaaccaaccccactggtttaaaagaaaggtggccgccgtccagttgtttgggtgcaacacgggatggtgagtgtagcagtgcgtaagtgtgaggagcagcagttatttgtattttgttttattacaacggggagaaggggggtactttattaatctattatccaccccgcttgcggcattcatacagtactcgcggtcagtaaataataacatttgatcgaaggacatagatggataagtgcctgtgctttccaggcaccaccgtagtaaattcatgggagtgcgtatataaattatttacaaagaagcactcccactcgcgggagggtgagcttgtttaccacagacatagattttgagttgtacataccacccccttgaaaaagatgagtagccccgcccttttccacttgcctgccaaaaaactttttccaacacccaaaaca

SEQ ID NO: 604243 - DNA, 308 bp, Homo sapiens
gattaccccaagctttggtcagtccgagaatgtagtctctgatttaccactcctgtgaatggccctaggcagatgcctaggtattgttgttactgttttgagacagaatctctgttgcccaagctggagtgcagtggcatgatctcagctcactgcagcctctgcctcctgggttcaagtgattcttctgcctcagcctcccaagtagttgagactacaggcatgtgccaccatgcccggctaatttttgtattttagtggatactgggtttcaccatgttggccaggctggtctcgaattcctgacg

SEQ ID NO: 604244 - DNA, 269 bp, Homo sapiens
gagggtgtcactgactattttgtgtttaccttttatatgtgtaaaactttgcagtagctttaaagggtaatcaatttttctatcaagtgcactattcatttagtgtgttgcaggtttatatgacttgtattaaaaacactgctctgagttgtttgtacactgaaaggagaactctagatgttactctatgtaaataaaaccttctgtgactttcaactgaatttacaaatgcaaagtactcggggggggtccctgtacccaattcggcc

SEQ ID NO: 604245 - DNA, 278 bp, Homo sapiens
tgaggatcccccagctcgctgtcgctgtggctatgctaatacagtttacaggaggggaaacagattttaccagtatgtatgtgaagcaagtaagaaattatctaattaggccaggcgcagtggctcatgcctgtaatcccagcattttgggaggccaaggtgggcggatcacaaggtcaggagatagagaccatcctgggcaacatggcaacactcctgtgtctggcccaaggcagaacgagcggggacaggacccgtcgccgagcgattttaacaca

SEQ ID NO: 604246 - DNA, 418 bp, Homo sapiens
gtatccagagatgagacctttgggaggtaattacatttaaatggattaatgaggttgggaattccatgatgagatcaatatccttatgaaaagaggaagagagaccagagctcactctctttctacgatgtgaggacacagcaagatggcggccatctgtaaaccagaaagaggaccctcgctggggaccaaatctgccagcaccttgatcttggacttctcagccttgagaactgtaagaaagaagtctgttcttttaaccacccagtctgtggtattctgttatgacagcctgagcagaccaaggcaattgtgctgtgggtagcacaaatacgtgcatttgtcaaaacttatcaagttatatgcttaaaacatgtgcattttacaatattaaattgtatcttaaggaaccgtaaaa

SEQ ID NO: 604247 - DNA, 181 bp, Homo sapiens
  misc_feature (134)..(135): n is a, c, g, or t
  misc_feature (162)..(162): n is a, c, g, or t
  misc_feature (170)..(170): n is a, c, g, or t
tcccaatcagcatctctcgcatgtggcacgtgcctggtagtctgtagaggatccgctctgtgtccaggctagagtgcagtggtgcgatctcagctcactgcaacctctgtgtcctgggttcaagccgattctcnnctgcctcagcctcctagagtagctggngactacanggcgtgtgcca

SEQ ID NO: 604248 - DNA, 202 bp, Homo sapiens
tcacccttcgcatcacgaagcacaaagtgctgttgtctgccaaaatgacctccctcatgaccatcatggcaagattactttgcgtatcgcggctttaaactacctcagtgcttgatgcgaaccacgataggcggcaggacctggggcatgctgctgcaaaaccattcaatcgagcccgcgctctgagatacttcactcttcc

SEQ ID NO: 604249 - DNA, 269 bp, Homo sapiens
caccagatgctcccacccttggagactggaggcttgcagtgaccctgagattgcgccactgcactccagccttggagacagagtgagactctgtctcaaaaaaaaaaaaaaaaaaaaaaattgtaggaaaattataaagttcaaagttaatccaaacttcaagttttggatttggataaattaaagctgtttggaataataagaatagtttcctctatttcatgccatgaagtccatccactattggagactggttcacaaagcaatgc

SEQ ID NO: 604250 - DNA, 881 bp, Homo sapiens
  misc_feature (316)..(316): n is a, c, g, or t
  misc_feature (323)..(323): n is a, c, g, or t
  misc_feature (520)..(520): n is a, c, g, or t
agcggggtgggcggtggctcaggctcctggaataggaccgtccacccctccgacgctggctggtgtggacgcggaatctcagcggagtaaacgcgcattgacgaatatggtacaatagcaaaatgaacatagattcagcagctctatgagtgcatgcagcctaatgagaagctatggcgaaccatcgatggtgacgtgtcctcagcaacgatgcaatcgcgagggcagcatagagcactgctcggagtgcgagttggacggctgtggttctcccctgctaggtgagcgggagtcatcagaccacgaagtgaacgcnttgtgtngcgaccagttcagtcgtgaacttgagcgctatgctcggacctgattggagatcgcctagctccagcttttattcggaggaggtagcaattaacaattctttatccctgaagtacgaaaccatcgtgcagaacttgagtgagctggtggatgcagccgttcgcggtggctgcactgttgagcgttacaattcccgtgnctgataccattgctgcgcgagaacgcctacgttgggtactgcacgtgtacgaagcccccgtagggacaacggtgtgcgcaaggactgacaacgagctagctttcgcggcatggccttagttgcgaaaacctccttggagatagcgtcccagcgtttggggaagaaatgcttgggccgagaacccagggccatcggaaacaaatctttaaaatttacgcaacaagttatgttcaattccccttgctatgaaacttaaataggcacaatcgcccttgtaaccgggacttatacacgggtcccatttccctgggggaaaccggttgggggcctttggttgagtgaaccttggggggaattccag

SEQ ID NO: 604251 - DNA, 497 bp, Homo sapiens
tagaggatccctcgccaggtctctaccttgataacatatgaatgtttattataatggtaagaatacccggcttattaacatatgctcaaatcttagacttaaaaacaatattacttttcctaacgaaggtaaggacaaaaagtctcccctcccccatttttttacatacctcctatagacgtgccagtggtactatggctggtaagagtagctgaagtctctgacacggtggaagggtgggctccgggtgacagccgaagcagtatcagaggccggctcagacggtagatggcttggattggtcaagggaacgcgctagtagctggtgattccattctggcagaaggggtgggaacctccggtaggttcatctacatcaaggggtaaggtccacaatttctggctgcattctggcctcaggggctggtataacagtagaaatcctagggcggttcggtggctcgtgtggccgatttgcatgagaatgtgaagcgtgg

SEQ ID NO: 604252 - DNA, 335 bp, Homo sapiens
ctgcctcaaaaaaaagaaagaaagaaagaaagagagagagagagagagagggagggtgggagggagagagagacagagaaagaaagaaagaaggaaagaagaaagaaagaaagaaagaaaaaaggaaggaaggaagaagagagagagaaaagaaaaaagaaaagaaagaaagaaagactgaagtctatgcaaaagagtgcagggtacggaccgggcgcggtggctcatgcctgtaatgccagcactttggaaggctgaggcaggcggatcacctgaggtcaggagttcaagcccagcatgaccaacatggaaaaaccccgtctctactaaaaata

SEQ ID NO: 604253 - DNA, 734 bp, Homo sapiens
ggaggttctgctcttgtcgccaggctggactgcaatgacgcgatctccgttcacatgaagctcctgcccccttcccccattcctccccgatgaaccagattctcctgccctcagcctcccaagtagctgcgactagaggcgcccgtccaagcaaccccgggctaatctttgtattatcacgtagatgacacgggtatctgccactgttggccaggcttgtgctcaaactgttggcctcaagtagatcctgcccggcctctggacttcccaaacgttgctggagcattacaatgcgttgacgtccagcagtggaccccgagacccgcgcagattcgggtcgtcccgcgcaacagtcccattgacaacacgctttgcgacaagttatttccagaagctataaccgatacgcgaaatagcaccaaccagagaaccaaacaaccataacggccgtgtactcattgatccgttggtgttacagcctctgttcgtgacacacgcgcggaccacaaccagaccccatggctggaaccacccaagcagcccggccacgcggtcgcaacctagcccgaccgcaagacactggcacgcacacccacacggagcacaaggcgtccacagatacccacaccaaggctcaagccacgccccgacaccacactccccacagcccagtccacgccccgcccacaccaaggacagcactcgcggcaaaacaaccggaagcgcacacgtac

SEQ ID NO: 604254 - DNA, 843 bp, Homo sapiens
tactacactaatcaggacataatgtctggggaaggtaaagctggtcctccatggagcgcagttcccgtgcagcatttccacaaggtgcgtaggaggacggtggccgctgttccatgcgctgttcctgtgtggggacagcatttcctgggccatcaggaccaggagggcctccccaccttttgcaggaaatttcgatcagacatcttgttacaggacactcggcctttgttcctggaaactaggattccatggcatatggggcacagctatatgaggaaatacccattttaggcctaaaagctgagtaactagactccgatcacgtgccacccttaagtcctccaggcccacctgttccaccaggttcctccacctcctggtcaggttctgcctcctcctcttagcttgggcctcttacactcgaggagatcgccctccaccgctctgttcttttgtccgtggacaaccgtttgtgggctggcctcgcgattgcggtccggcttcctcctgggcctcgcatctccaatgttccaggctagctgccctcctccgtggtccctaccaacgtcctatctaacagtgtatcgtctccagcttccatggtcctcttctgacacctgcgtaccaccccgtgttccttctttggagccgccccttacactgagctcctcctccgagtcttcctggatccgctccaggtggccccgatcggcaggtccgcatgttgaatccagctttcttttcttccactacctaagagtggggttgcctagctagatacccgggtccacggcgaaagttcctatggggctcccccttgattcgggtggtatgggccccggg

SEQ ID NO: 604255 - DNA, 84 bp, Homo sapiens
gcctcggacaccgccatgtattattgtgcgagagcctacggtgactattattttgattatccttttgatatgtggggccaaggg

SEQ ID NO: 604256 - DNA, 331 bp, Homo sapiens
gacactggatttcagtacatgctaagtacagtctgctgcagttttgctttgtactagcgttcgttgttcgtgcttcttctattcgtatctagttctagttttggtttttggttttctcgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgagcttgctcttgagtgcgttcacctcgcggcccatggcctcgttgctct

SEQ ID NO: 604257 - DNA, 126 bp, Homo sapiens
gccttaggagggcagttggtccaggacccacacttgctttcctcgagtttcctgattctgccttgggtttttaggcatacttctggaaattccctttgggtccaagacggggagggtcccctaaga

SEQ ID NO: 604258 - DNA, 183 bp, Homo sapiens
  misc_feature (10)..(10): n is a, c, g, or t
tacagcggtnttactgatttcagtttttattgttgaccactcttccttggcaatgtgtgtgaaatgggtttcatccttgtgaatttaggacttttccagaccttgtctctttgataggccggtattggattagaaggagggagtagagctaattgagaaacaaaatgtctttttcttagaaac

SEQ ID NO: 604259 - DNA, 101 bp, Homo sapiens
acagacaagtgctacatctcgggaagtgagaagccccattggaccagtgtttgcttagtgtgagtccatgactgctgcagatgcagccagcccagctgacc

SEQ ID NO: 604260 - DNA, 386 bp, Homo sapiens
ctcctttacggcgacgacaacctacgcacacgagagcatgcctttcgcacaggatctccttaatccctctgcagacgaggagaggaggacccgcagcaggaaccgcctggcgcatagccccaagtcctacgccatggatgcgaaatgcccaccacgctataaaaccaccacggtctttagccatgcacaaacggctgtttcgcgggtcggttgctccactgacctctgccagcctacatgaggaaaagcagggcttacagaaggatgctcctttaggaggacgctgcactaagagcactgtgagtccagatgagtgggaacccttcggaataaacacattttggaaaaaaaaaaattgagcacgcttatgcagcgcgccggaacaa

SEQ ID NO: 604261 - DNA, 298 bp, Homo sapiens
gagactctagaggacccccctcaatcatcaatctaggcgaacatgcttgattgccttcactgttttagcatgagcaggatgatataggccagagtttcttccatattcaaaatgtcaaagcgatcaatgcgaaccttgaccttgcgcttcctcttggagtgaatccagttgcagaattttgtcaaccaagaatcgtctccattcttatcttctgcaagccaagtgccaaaatcatgcacccagtctggatgacgcatgattccatattcatcaggaaccttcttgacccaaaagcaga

SEQ ID NO: 604262 - DNA, 563 bp, Homo sapiens
ctgagtatctaaggatccgatcagtgcattgtgggaaaagggtggcatagtcaatatgtactagatatggataagagttcgttatgaaattcagtatgcttttagcacacatctttaggtggccagtgctgtaatcagtgctaggaatttaaagattgagtaagacatggtgtatgcccacaatcaaatgaggaggacacacgtatactgggctactttgcaccagcgtggcaagggctctgcaagtaggataaacaagccaggttgaagcacaaggagacaaccatcaccaaggcccggaaagaattacggtaggaatcatagagtaagggaacttggcatctggcacaatggcacgtggatcgatccacgtgccattgtggatccacgtgccattgtgacaccaatcccaacacccactggcagacagaccccaaacacgaaacccatcaacaacaacaccacggtgaccccaaacccaaaaaccaccggcacacagaccccaacaacgacacccatcagcaccaccaccacggtgaacccaaacccaaacaatggcacgg

SEQ ID NO: 604263 - DNA, 696 bp, Homo sapiens
gcacgggaaagggaaccaggaaatggaagtgaagggtgcacatccacgatctagaaagggctgcgtcactgcagccagaaagacagtggtaaacagagttataagtggcagcaggggcattcaaagtgtcaaagaagagaaaaagaggtgcagaatggattgccaaatgagcttccaggtaggactaagagagtctttaagaaaatccaaaaatgagactgaaaagcatcctgaactaactaagtgaaaagatacggaaacgatgcatggacttaagcagtactgacagataactgaaaaagtactagtagtagcacgtaagaaagaactgcgtgaatgggcgactaagacggacctggaggacgtacactgagaggacagttcctaagagggtggaactcttggcgcagcctgctggtcacaaggatactgtaaacccttgcaacgggctacggaccaactactctacacaactacacgacaccacgacaacactactcagctacccggaggtcgttggacacgcctactccagcgcccgcagtaccgcaacgcgcgcgcgctctcacggaagcttactacgagatccggacatgagcccagtgctacactaggaacacgcgggatccacacacgacaaccacaagagctcacacatcctatgacagcaagaaccatccccatcgcccacacgaa

SEQ ID NO: 604264 - DNA, 371 bp, Homo sapiens
cgactctagcaggatccccactttcgccatgtttccctcactatcccttttgttatgtgtccattttcgcagtggcagtacatggagaaatctccaccgtcaccgcactatccaccaggcgcattaccacctgaatgtgaaggtctcatctcgaaggtgcgctcagccattataagaaaacatatttcagaatggaataataagtgtgctcttcccacccgcatagcggtctcaccttcagttctagctttctttactccaaagtcttctgagtcttccaagcatctctttcgatttgttcccacactaatattattaggaaatacattctgatgacccccatttaagatgccattgttatagaattggtt

SEQ ID NO: 604265 - DNA, 275 bp, Homo sapiens
gaaggtcaatgccaagtatatctgcatatctgttgataacaacatgaacatctctagcaggtgtgattttgtttatagtcagattaatatctttggaactgaattaccataacctgttagaatagttcattaaaattgcttttaaaacccgaaccaaaggacacatgtgaaataggaatctcttaaataacagtctcctgaattttatttctaaaactaatagaaattatcacaaagtagtgttaatgaatacttctgctacctttcttagatgc

SEQ ID NO: 604266 - DNA, 381 bp, Homo sapiens
tggccggacactagcagtatgataacaaggccaggagtttgagacctaccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggcta

SEQ ID NO: 604267 - DNA, 168 bp, Homo sapiens
ttcctcctcaccagacctgactgtctgcgttcgtgcctcctccacctccgcttcagggttttcttttacttctatataactgtgttgccttctactttttctgtctcctcatcactggccatagctgctgcctgattcaaaccagcatcctcagtatcttcttcttct

SEQ ID NO: 604268 - DNA, 167 bp, Homo sapiens
tccgttacgagccaggtgagaatggagtgctcacagtgcgctgggaagggaggacgtgacggcagtgtggatagggactctcttcggtcagagcaggtgtcgaaacaacacctttccttattcgcccggatcaaagtctgtcgggctagtcgggggggacgagctcg

SEQ ID NO: 604269 - DNA, 871 bp, Homo sapiens
cttagcatcagtcggaagcttgggtcatgacttacctgacttgtggcccgggggcaagcaagaaacaataacatcggtgcttataaatggcaccacatcttgttagctcccccccaaatacgtctctgaaagctcgatgcgacgatacctatgggattttacacaggcccaccagcgttataaatgctatggtctctatccatcagaaatagtcgattattcatatgtttgaaggcagctaacaagacaaagaagaaaacgacttttcctgagggatttctaaccatgtatcctaatcctcccattgggcgggtatagggtgtagttcagggtttctttggtttaagaaaagaagcttgataacttttgacatctgacgagatgtgttgcaagggatacggctgcagtattactaatttccatgtgtatctgggaaggtatattgcaaagtggcgatagctaaaattccagaagtttaaagatgcctatagaaagtaaacaacatttatttaggaaagaacgctgaatatgccttcttttttaattagaaatatttggagatagggtgtggttaagtaactaataatggagtaggttacaggatctaaagcagccctgttcacagtctagtaggagagagaaaatattggcagattagcactttagaggcaaagaacaatgttattatcagcaggttcctgccatgtgtggcaatttgaatctgttagaaaagggtttcaaaagcaaaagatgtctcgggtgcgaaactgaaataaattccggttgtgacaagggaaaacattagcaatttctgtggagcacgaatcaaaaagaagaaacattggggcgcccaattcaaatggggcctaga

SEQ ID NO: 604270 - DNA, 442 bp, Homo sapiens
cacatccacattgacatctccagccacacaggacatcaacaggacattcctactcctcctcatggtatcttctcacctcgtaagctagctctacattcaggctctcgatcagcatatccaggatcagtcttagacagagtgagctcatccagcacccggagcaggcacgaagatgtcaggcctccacgctctggcgcaaggccagctcattctcatacttgagcctgaagtcgtccacagacagcctgaaattgtcaatctccaggatgacccggttgtatacaatggtggcggtcaggatcttgtcccggaagactactacagaaggtcttgtaataggggctgtagtaccgctcagagatagctgggctctgcttcaggtgccagtcacggatcttcaactccaggtcagagttggactcctccagggcgcgcaccttct

SEQ ID NO: 604271 - DNA, 204 bp, Homo sapiens
ctcaggttatggagggtctatctactatataggactttgcgcttcgaaacttacggctcctcaaatcatgaaacttattaatattactgctgttagagaaatgaatgagcctacagatgataggagttcatgtgggtgtatgcatcgcgggtagtccgagtaacgtcggggcattcccgcctcatcaaaaaaggacgcaggggt

SEQ ID NO: 604272 - DNA, 809 bp, Homo sapiens
cgagttttccggagcactctaactgggccttatatctacggggtctttcctctagggaagcggtcgccctcggtgtcaattaaacacagcttttcttcttgttccgcctccgccgtcaattttatcgtccaagggattaatgggacgattgttccccgcctcaggggggggaagatttcggcccaaatagggaggcgcccacatggttttcccccgaagtattgttgcccgccgtgcacttagtcaataaaaccggcccgcatttttccaagtactcaaaagctaagcctcatctttcctcaagcccgtttttacccccttgcttcaaaacccgcggttccccaaagcaacaacggtctcattcagaattttttccccaagacattttgttggaaccctgtattctctgggagtactgtcacaccccgctccccggtggcagattattaataaatacatgcctgtacacccccccttcaagtatattaagaatctatggtattcttccctacataatcccttctatccggcttctcctggcgtctgaattaaattgttatctataaaattcctcttgccgacaacagtattttgccaagaactttcttagataggcttttcacctagcaatcccaaacatatatattgtgagttgcgaccacaccctgtctgtgtatatccccccaccagtctagcacactcatgtacaattaatggaagatgaaacacaatatgatctttgttttccattatgacagttgcaattactccgctaaaatccgtaacaaaaattgaacccccacaagaca

SEQ ID NO: 604273 - DNA, 341 bp, Homo sapiens
tgtatatatttatggggtacatgagatattttgatataggcatgcagtgcataatgagggtaaatggagtatccatcacctcaagcatgtatcctttgtgttacaaacaattcaattctttcagttattttaaaatgtataattattattggctatagtcaccctgttgtgctatcaaatactatttcttatttattctttatattttttgtatctattaaccatccccactttccttcttacccccgccacctccacccttcccagcctctgacaaccatccttctactctctatctaaaagttttaatttttagttcctgcaaataaatgaaacaatgc

SEQ ID NO: 604274 - DNA, 459 bp, Homo sapiens
cactgtacacacagttacactccaagttcgcctcattttaatagtagagtacacacccccaggtgaggattctatatgtaatgatacatgcagtgtgtgttggagcatgtaggtactgagcatgtgtgccaaccacaggcctgtctgcctttacacgcccgacctcgccgtatttcatgaacaggcacgcacagccaaccgcgggcctgtctgcctttacacgcccgacctcgccgtatttcatcaacaggcacgcacagccaaccgcgggcctgtctgcctttacacgcccgatctcgccgtatttcatgaacaggcacgcacagccaaccgcgggcctgtctgcctttacacgcctgacctcgccgtatttcatgaacaggcatgcacagccaaccgcgggcctgtctgcctttacacgcctgacctcaccatatttcatgaatgtgcatgcacagc

SEQ ID NO: 604275 - DNA, 722 bp, Homo sapiens
ctcggcgtcgaggggagtttgtcctgcgcacgtgtaccggacttgcgcatgtccctgccgggctcgctccgcgggtgccggcaggactcggccgcggtgattctggctcgcggtgcccgagtgtccggtgtgcggggctcgggaaggcacctccacctagccgtctgttacgacccccgaggcgcaatgtgagccccatctcgctatccgggtccggaggggttcaccttagaaggatttttgaagctcttggcgctggctctaatgagaacccacttccttgctggattgtcaggagtcaagaatccttaaacggagccaatttgcgtttgtaaagccaattgccccaagtgacttgcagtttcgaaagggagagtacttcctggacaactgcgtataaaaacgaacgaacaaaatacgttttattaatacggggagcctggtcaccaactggatgctcagatggaaccctgagcagcccatgtacatggaagatctttattgcagagatcttcaaaccagatggctcgcagagattgaggaacttgcccaaggctacgcagcttgaaactgaggctaaagagttagtattctgccaaggccagctaatagttacagagcatggttccaaattcagagctgtcggaagcttaagcccatgtgatgaaccacgaatgtgattttacctcatttaagccttgcagaaactctgccaaactagt

SEQ ID NO: 604276 - DNA, 203 bp, Homo sapiens
cttggacctcagcctgaactcaggcgtttagagatttgcgggtgcgtggtacagagagcgctttactcctcgtcccattgcgtatagattagctgggcctgaccatgctcaggctccagtctttagattggcacatgaagggcaagaattaagatcactagtcccagaattaggacaatccatgagccccgccccagctgcgg

SEQ ID NO: 604277 - DNA, 1030 bp, Homo sapiens
gaagaagcagagctactgcttccaaaaggatgctcctcttggcacgcttcccgaggggagtccatgcaagaaacacgaagagcctcttgccgacagtctctggttcccctagtccctcctgcaggaaactccttgccctacagaggcccctaagaagcactgctttgacccagtccctcctgcaggaaactcctcagcccacggaggcccctatgaagcaccaccttgacccagtccctcctgcaggaaactcctcacccacagaggccctgaatgaagcagccgctttgagcagggctaatgtttcactgctaaatcctgcccattccttatgttgcccgagctctcctctattacctctcactgtggctgaaggctgcagtgtggggaccgtggcgggggaggacaacacgagggaccccccagaaccctgtctgactgtgtccccgttgatgcaactggggaactctgatcccccgaaggaatgggagtacacgagtcgcagctctggtgactgggtgatgcatggtctcgtgttcagagatagcatgcaaggggcgctccgccttctcctgtccctaccactgtccctttagctgcccggtcaggaagctgggctctggaggactcgaccagatccggggtgtgccccctctagggcacgtctggagagctgcgactcgcagcctctgcccattcacgtgctcctgctgtcactgacttaaggctccaaccagaagcggaagcaccccaatgcagacccagcccgtgggccccagacaccatctaccagtgtgggaccatggtggcactacacccctgctaacgcacgaggaccaccagaattgcaagcaggcaagccgggggacgtcaaagcaacgaaccggacgcgtgacacaccccactacgagaggcaccacattactcgctgacccgcacgcgacaccacgcacgacgggcgacacggcctacaaacaggctcaccaagatacgcaacacaacaacgcacattagggccgcaatcccacaa

SEQ ID NO: 604278 - DNA, 312 bp, Homo sapiens
tcacaagctgaattttaagaattcaacgtaaaggccgggcgcggtggctcacacctgtaatcacagcactttgggaggccgaggcgggtggatcacagggtcaggagattgagacatcctggctaacatggtgaaaccccgtctctactaaaaatacaaaaaaaaaaaaaaaaaaatttggccgggcgggggggcgggaccctgtggccccagttactcggggggctgagccagggaaatggcgtaaccccaggaggtggaccttgcagggggccgagatcacacttttgcggtctccagcccttttgggac

SEQ ID NO: 604279 - DNA, 992 bp, Homo sapiens
gctgcgccatggtggtggtttgtgggtcgggtggtcgcgtgctccggcctccgtgggccttgctggagactcacgcccttcacgcgtcgctgcccccagctcagatcttactgcgggccgctccgacggcggttccatcctgtcaggcactatgcgggcaaacatctccttcgccaaaagcaggcgccgtcatcgggcgcaatcgtggcggtcggattggcgcagtggtgtgactgtccagtcatgatgcagggactaccaccaagttctaaatgccgctggaaagtgcaaggcgaaggagaccagactgggtttcggaggtgtgcccagcgattgggggtgagagcgacaggtgaaggactacttgctatggatggtacagaaggcttggttagaggtccaagaagagttactggatgctggctgcaccaatccaaaggattcctgttggatcctgtagacttgtgggcaggaatcactgtaaatgtgacttggagaacctattgatgacagatgtcccatcagaaacaaaagaatgtgatcccattcatgctgaggcttctgaggtacatggaagagtgagtgttggagcgaggacagtactggtgactggtatcacggttgtcgatctggtagctacccatatgcaggggtgggaacaatggggttaaggaggtgctggaggtgggagactgtcaggtgctggagtaaatcaaccaatggacgcgaagaccatggtggacagctgcgaaggcggtggggcggcgaccggtaaggcactgtattacctgaatggtgatcagaggtctagctaaaacggccccaagtccccttgaatgtgcaactcagtacccgggggccgccgggcgaaggggtgctaaataacccaagggagactgaagaacacagacacaaggaagagaaaaggaacatatgatatcggcatgtctaaaaaggatccagaaaaagaagacaggcggcaccagaggatt

SEQ ID NO: 604280 - DNA, 1606 bp, Homo sapiens
  misc_feature (883)..(883): n is a, c, g, or t
caccatcacccaaaaattaacatgtactcagagacataaatgtaaaatctaatactacgaaacttctaggctgggcgcagtaagttcacgcctgtaatcccagcacttgtggacagactaacgaagggcagatttgcttgagctcaggccgttgaaaacccagcctggataacatggcaaaaccccagtctctacagaaaaatacaacaagtagccaggcacggtcacatgtgctgtgaattcccagctactcagcaggcctgtggtggcgaggatcaccttgagcctgggggaggtcaagaatgcagtgagccaagatcattccatatgaaatccagcctgggcgaacagactaagacgcctgtatttacacataacaaggacagagcaccagacacttctagtcagaaaacatctccatgatcttgacggtaacgccaagatttctatataggacagacacaagcaagacatcatacaggagaaaaaactgtcgtctatgggtgacgtcagtctctactcaacctcaccaactaagaccttcaaagagtgcctcttttacaacgaaccagacaacacgggctgggcgtgatgaccacaggcatggaaatatcaagcacttgtgacagggcagccatagcagcatacttcgcgcccggcatctcacgaacagcgtgcaatattggttaagccattgtcaaactttgtaacatacactacaaggcggactacgccaccattgcacaacagcgatcaagtaaacctgatacccaaagggctgtggtaccacgtacttctctatgtgcagatatcaatcctcaaacaacatggacaatagccaagaggcaacactaccatcattgtgtcctacatcagacttttntactatattatcgtcgtattaagtatacagaagacaacacacaacaacacgcagaaatacaaagcacatacacatgaacctatagctaacagcaagcacaaaacataacagatcgcaagacaacaaccaagcagcaaaacgaaccactgcacaacaccacaagcaagaggaaagaggaagaagctattagaggcgagagagagagcgtaacccgaacaagagacaggaaggaagaaagacggcgagatgcggacgtagcgagtgagtaagaaagaaagaggtgaaggcagagcagaaacaaagagcatacaaggagagcacagcagataacgagaaggaagagcgcgacgacacagaggacgaggaataataggcggaagaacaagaagactcgagcgagagcacgagagacaaaggaacgcagaggagcctagccgagagccagggagaaggagagagagagaagacgagcaggagacagaaggaaagaggcgcgaacgcaagagaagcgcaagggaggcacagaggagagcggacagcgacagagaatagggataacgagagagacgaaggagcaagagacggcagggaaaggaaggcgcacgaggcggcgaaacaaccgaagaagacgcggacagcggcgagagagcaacgacagacaacgacgaaggaacgagaggacagcaagacagcacgcgacacaagcacaagagcagcggcaaa

SEQ ID NO: 604281 - DNA, 1373 bp, Homo sapiens
  misc_feature (117)..(117): n is a, c, g, or t
  misc_feature (198)..(198): n is a, c, g, or t
  misc_feature (219)..(219): n is a, c, g, or t
  misc_feature (222)..(222): n is a, c, g, or t
  misc_feature (235)..(236): n is a, c, g, or t
  misc_feature (273)..(273): n is a, c, g, or t
  misc_feature (305)..(305): n is a, c, g, or t
  misc_feature (646)..(646): n is a, c, g, or t
  misc_feature (1298)..(1298): n is a, c, g, or t
  misc_feature (1305)..(1305): n is a, c, g, or t
actggaaagaaaccatttaaatgtaaagaatgtggaaaaggtttaagttcagacacagccttgattcagcatcagagaatccacactggagaaaagccctatgaatgtaaggagtgnggcaaggccttcagtagcagctctgtcttcctccagcaccagaggttccacactggggagaagctctatgaatgtaacgantgttggaaaactttcagttgnagntcaagtttcactnnccatcagcgaatgcacactggggagaaaccttatgantgtaaagagtgtggaaaacgattaagctccancacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcntctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtaatcccagcactttgggaggctgaggcgggtggatcatgaggtcaggagttcgagaccagcccgcccaatatggtgaaaccccgtctctcctgaaaaaaaaaaacacaaaaattagccaggcatggtggcgcatgcctgtaatcccagctactagagaggctgaggcaggagaatcacttgaatccctgaggcagaggttgcagtgagctgagatcgcaccactgcactccagcctgggcgacagagtgagactttgtctcaaaaacagtaaaaaatgacaatggctagatttttcaacagcaaccttcaaagtcagatgaacaatgtgtatgccttcagactnctcatgngaaaatgtgtccccctgccaattctatactccgaagtttaagtatagaataaggcttttcagaccttt

SEQ ID NO: 604282 - DNA, 549 bp, Homo sapiens
  misc_feature (18)..(18): n is a, c, g, or t
gaagaacttgaatctaanaggttccagctggtggattcaaggtctcaagggcggttcctgggcaccgaccggaaccggatacagtaggactggactcgggccatatccgtggtgccgtcaacatgcctttcatggacttcctgactgaggatggctttgagaagggcccaaaaaagctccgtgctctgttccagaccaaaaaggtggatctcttgcagcctttcattgccacgtgccgcaagggagtccccgcctgccacgtggccttggctgcctaccttttcggcaagccttatgtggccgtgtacaatggctcctggtccgagtggttttcccgggcccccccaaaaaaccgtgtgttccaaggaaatttcttaaaaggcctgaaccgtgaccttttttgctttctgtaactgcggccggtttagtgaccccatgacttacaaccggttttttccttttaggtgaaggagatgacatgtttttaaaatttctgtgcaaggctccccctctttctgtcaaccctggaataaactttgccttttttta

SEQ ID NO: 604283 - DNA, 258 bp, Homo sapiens
attatagaacctggcgacctccagcagtgatagaacatgtactctattttatggagttgatacgactggattgattgagacagagtatcactcttgttgcctaagctggagtgcaatggcacggtttcagctcactgcaacctcggtctcccaggttcaagcgattctcctgcctcacactcccaagcagctgggattacaggtacccgccaccatgccaagctaatttttgtatttttagtagagacggggtttcac

SEQ ID NO: 604284 - DNA, 292 bp, Homo sapiens
gcataagcatcacatcgtcgccgcaaagtgacatacggatgtggcgctatagaggaatgtccacagaggcaaccacgcatatacagcattgaggacagtgatcccatagtcggaagatctctccaaatgtagcgggacttaaagatgtacctgtattcactaggcaacacggcggtgcttcaagaatatgcggctcacggtatacagatgatgaagctcatttctgtgtgtatctctctctcactctctctctctctctctctctctctctcactctctctctctctctctc

SEQ ID NO: 604285 - DNA, 435 bp, Homo sapiens
tacttttcgacaggaggaaaaggcagtgagacgttgggagtactgcttacaaaacaggatcaccagtgctttatgtggtcgtgttcatccccacgccgtgtgtctacgggctagggctggcgtgttcatccccacaccgtgtgtcatcatataggactagggcacttcatgatgtccctatcttgtttcgcagacgttccaaaaactatgtcgcttgcttttcctgtgtttttccgttgttttctgtccgattgagtgctacgggtcttacggactctcacccgttcccactctctgcaatatggatcaggcagtgtttctgataggatgtgaaatggactctcctcgggtgggtccagcacgggccctgcccaccagaacacagtccgtgctgtgctgcgcttaggagctggccctccactctcctttgtgcag

SEQ ID NO: 604286 - DNA, 345 bp, Homo sapiens
tggaaagatttaaaagtaaatgatttaattctagtaactgggctacaagaaaaacaggggaatggataccatcccggggcagcgccaaacagccgggtgctggaaatgcagctgaggacaaaatgattttcacaaacacgggcaggaggctgggaaagctcacagccccacaggacggcggggcaaaccgtggagccaccaggcattacggcacatggatcttggcatgtctcccaggtgctggggaaacacaagcattagttggtgtacaaattagtcataggcttgtgaagacatctgtgatcatctgagtccatctgatcaaaatatttataaaaagtcata

SEQ ID NO: 604287 - DNA, 134 bp, Homo sapiens
gcagtcttttttctcaaatgtgtctctgccaccagaatgggtcagtttacctgtaggtataggaaacccagggctcaactaagagtcccacacagctttctccaagtctggtctggactcaacatcagtctggc

SEQ ID NO: 604288 - DNA, 416 bp, Homo sapiens
ctccagctttggctcaaagggccccaggtacagctcaggccaccacttcggagggcacaagttgtaagccttggcggtttccttgtggtattaagactgcaggtgcacagagtgcaaaagtgaaggtgttttggtcatgggggtggatccctcatgagtggtttggtgccttcctcacagtaatgagtgagttctcattctgagttcacacgtgatccggttgttaaaatgagtcagggacctccccgtctgtcttgctcccacttgccgtggggtacactgactgcccttcatcttgcaccatgattgggagcttcctgaggccctcaccagaggcagatgccaatgctatgcttcttgtacagcctgaaccaaataaaccatgaagcaaataaagctcttttctttataaatga

SEQ ID NO: 604289 - DNA, 250 bp, Homo sapiens
agagatcccagcgctccgcagaagtatgtcctaaataactatctggtccggataacacacaatataaagagcattaataaaaaacagacataacatatactcctaaggtctaatgggaaatatccggtgggcatgggataaccaatcataggtgcagctgcggtagcaggatatgcatatgccggtgggtccataccatggtgcatattgggaacataacttccgtatggctcagcgcggggtaccggag

SEQ ID NO: 604290 - DNA, 1014 bp, Homo sapiens
  misc_feature (252)..(253): n is a, c, g, or t
  misc_feature (279)..(279): n is a, c, g, or t
  misc_feature (310)..(310): n is a, c, g, or t
  misc_feature (359)..(359): n is a, c, g, or t
  misc_feature (372)..(372): n is a, c, g, or t
  misc_feature (390)..(390): n is a, c, g, or t
  misc_feature (421)..(421): n is a, c, g, or t
  misc_feature (485)..(485): n is a, c, g, or t
  misc_feature (495)..(495): n is a, c, g, or t
  misc_feature (614)..(614): n is a, c, g, or t
  misc_feature (693)..(694): n is a, c, g, or t
  misc_feature (714)..(714): n is a, c, g, or t
  misc_feature (729)..(729): n is a, c, g, or t
  misc_feature (731)..(733): n is a, c, g, or t
  misc_feature (735)..(735): n is a, c, g, or t
  misc_feature (744)..(744): n is a, c, g, or t
  misc_feature (748)..(748): n is a, c, g, or t
  misc_feature (752)..(753): n is a, c, g, or t
  misc_feature (774)..(774): n is a, c, g, or t
  misc_feature (779)..(779): n is a, c, g, or t
  misc_feature (781)..(781): n is a, c, g, or t
  misc_feature (784)..(784): n is a, c, g, or t
  misc_feature (787)..(787): n is a, c, g, or t
  misc_feature (796)..(796): n is a, c, g, or t
  misc_feature (819)..(819): n is a, c, g, or t
  misc_feature (827)..(827): n is a, c, g, or t
  misc_feature (916)..(916): n is a, c, g, or t
  misc_feature (947)..(947): n is a, c, g, or t
  misc_feature (954)..(954): n is a, c, g, or t
  misc_feature (966)..(966): n is a, c, g, or t
acatacattcttgattgtggggcagacaattgttcatttcaacaggactttcacatggtaacagtcatcaaaattggcatactatattaaaaaatgaaatcaaacagcatagacaaaaagtatgcagctttatgccaatttaaatctcaacatgcaccacccctcacccatgatctcagaattatctgatgtgagcttattaaaatattagccagagagtgtctgaggtcacaaatgatcgtttacaaaatnnaacctcttttcctagagctacttgtnttgttatagaaaacccccacaaataaaaatnagccctattcaaggtgttcatttcaaaatcacatatgtatacacaagtntcaagccattgtntttgtgtctcacattganacatcacaatacatgatgtgaaactgatttnctgttttaatgtaccttgcctctgcttgtgtatacccattgtctactatgtggactgcttacanatgagagtgngttaaaacattttcagttattgggtacacttgtaatttgttcctcctcagtaactactcagaaaaactgcttgagtgacatgtcaaaatttgtgtttcttcctgttacaagaaatttgngtaaaaatctgtgattataaaacagatttgttttttgggtttttttagtaaagaaatggctaaattttttttgtggttnntatcttattttcaagatgantcagaattcaacgtntnnntnttttttttntttngggnnaagtggctaagagaaaaaaanaaaananganaanacggggggnttcaaagaggacgacaaggcacngtcacaancagtccaactgtaattctttcctttcttgtgattatgtaaattttaaagaaaagaggtttctcacaagctatatacagcagctttaaanctcagtgtttcattttcacttgatacacaantaaaatnaatttacgacanatacttgtcacagaaatgtatgtaggccatagaaactctacagcttta

SEQ ID NO: 604291 - DNA, 636 bp, Homo sapiens
attgatcaccctagcagcagtgatgcatataaacctaattataaccacaccagtcaatcgaagctaaaggatttggtccttttattgttgcttcgagggttatattgaaggggctatgggcgggacgggattctctttcagatctttgtagtacaataactaagatgttactcagttgctttagtagtctatattagtggattgcttagcgttataagcgtgtgccactggcctcctagttgttgatgcttacggataatggtaggcctgttggtgagttttagtggtgacttgggcatgtcttattcaaaaacaaaaacataaaacacagaaacctttcttcagtcataccaaggcaagcagccatttcatgactcacttaacacattgcagtgtaccagtttacaagatgattgttccctttttgcgtgacatggcagttctaacccccagagaattccttatttgtaaattggaagtttctactatgccttacagagcttaaattcagaagtttgtgcctcatatctgaaacaagggaaataacacacccattcaaaagtaaataaatctgcctagaagttttgtttttaacatttccatataaagagctctgttgaatgtcatgaatagacg

SEQ ID NO: 604292 - DNA, 354 bp, Homo sapiens
agatctcatggaggcagaacatagaatggtggttaccagaagctggacgggaagaagggagataaagagaagtccattaaggggcacaaaaatacagttagatggaaggaataaattctagtattcagtagtacagtagggaaattatagttaacagtagtttattgtatactttagccagaagagaaaaattgtaatattcccagcacaaagaaaagataagtgtttaagatgatggataatccaattgccttgatttgatcatcacacattgtatacaagtatcaaacatgtacccccaaaatgtatacaatattatatatcaataaaaaataaacatttttaaaaattaaa

SEQ ID NO: 604293 - DNA, 573 bp, Homo sapiens
  misc_feature (1)..(1): n is a, c, g, or t
  misc_feature (22)..(22): n is a, c, g, or t
ngaattcggccattatggccgngataaaaattttgtttaaattttggtagatttttatctatacaaatttaaataaaattatgttttgtaagctgtaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaatttggcccgcttggcccaagccaatttaaaattgaaaaaagttaatcaatgcggccaaaattgaagttaattgggcaaattccccttaaaggaagccgattaaaaataaattggccgggttttaaaaacgtcgaaattgaaaaaaccttggggtaaccaaattaaatcgctttgaagaaaatccccttttgccaagttggcgaaaaaccaaaaagccccaaacgaatggcctttccaaacatttgccaaccctaattgccaattgaaaattgaaaccgtaaatatttggtaaaaatccgggttaaatttttggaaattaagctatattttaaaccaataggccaaaatcggaaaaaacctttataaat

SEQ ID NO: 604294 - DNA, 285 bp, Homo sapiens
gcctcagcctcccaagtagctgggactacaggcacccaccacctcacacggctaattgtttgtatttttagtagagatggagtttctactaaaaatgttagttaaagtgttagccaggatggtctcaatctcctgaccttgtgatccgcccgcctcagcctcccaaagtgctgggattacaggtgtgagccaccgtgcccggcctgctaggatccaaatattaagattctgcatttaaagtcacttacgctctctgcacttaagcttctgtaaccttcattagga

SEQ ID NO: 604295 - DNA, 551 bp, Homo sapiens
tttgtcctgcggcgaaggggcgaggcctgaccctgagcatcagctacgttggccttcaatttagctataagcagtgaagaccaaagtctaacctgctgaaacagcaaggggcaagacagcattgacttcaacaggccttttttgtaaagcaaaaggtaagatgacaagatccggtcttgtctgagaacagctgcacagaatacacattataaatgagcactttctcctatctcagcaccctggtgaatgggtgtcagagaagtttctggacctgtcagggactcccagggcttagccagagggtcaaagtgttgtgcccactcactttttcttatttaacatactgtggagtgagacatgtgggaaaatcggatcccagagattacctaagcatcactttttagagacgttttggttaagggactaccttcctgagaaacgttatacattatgtgggtattgagcttgaatttttttaatcataaaatcttaagctgggcgtggtggttcatgcctgtaatcccaacactttgggaggccgaggcaagcat

SEQ ID NO: 604296 - DNA, 864 bp, Homo sapiens
aactagaaaaggttgtgttgggtaacccagcccaagattcaatcttaatcggtctaagccagtggtggcattcctagcctccctcccactgattggccgggaagggcatatgacctaggtgctgacccatgagaggtaaggagagttgccggaagccttcttggatgacctgtgggcacaggaacctctcttttctgtaagtgcaatatcccttagggtagtcactgaaaatcttcatgtttgaccatcctctgcctttcccaagttgaattgtgctcagtttcatccaaacaacgactataactcagggttgcattcaacatatttaacaaccgagataacatggaccctgactaactaatagccactggccacagactgcaggccatatggtaattaccagctggatgtcaacccaagtctgctccctattatgggctgcatgtagttggctcctgggggatacagagatacacacttatgtgcatattactgttctcaaggtgggcagtctggtagcttctgtaagacaacagtaggtaaggtctagaatgccaatgttcgcaattttccctgtaaatctcaggttctgaccgttggctgacattagggtcaggggggagcttggcccaggctgattcagcagatctggaggggcatgggcatgtatgtacaaagaaagtcccaagtggggaaaactctgcatatcagctgatccattccagcaggacgacgttcaagcggccagaacgtaatacctgagacctcctggcgaggtacagacagagaaaggactgaagtcagctgcaaggggcgagactagaccaatcagaaggtgggtcatagcatttctctaaacaagga

SEQ ID NO: 604297 - DNA, 102 bp, Homo sapiens
atggcatgtatgataggacacttaggcgaagaggaatcaaaagcccagctaccaaatagaaaagaccttgtcaacattgctaactagaagaaagtacaatgc

SEQ ID NO: 604298 - DNA, 268 bp, Homo sapiens
tgtaaatatgcgatagcgatcgatggcggatctgaggtgagggaggaatttggagctcttttgagcgggatacagatgataagatcgtggtgaacaaaaatgcatgtaagccggatgtggtggctcacgcctgcaatgccagcacttcgggaggccaaggcggccggatcacccgaggatgggagttcgagaccagcctggccaacacggcgaaaccctgtctctactaaaaaatacaaaaattagctgggcgtggcggcacagcccc

SEQ ID NO: 604299 - DNA, 351 bp, Homo sapiens
ttaggtttttgttgttagttttgttgcgttgcctttatttttttagagggggtgggccccatgaaagtgggtgccccacatcacttctctgagaatcgaacggacggtgaatccgctcttggatcgagaagctgagcaagctgtgcgggtttatgtacaagtgggttgggtttgatctcagttagggcaggtgtagactttttaacgtggggctttagaaaatctggggttagcctggaagacaaattggcctcagcctccacagtaccatttgaatttcactataaaagatggaaagctcctgggttcatgtgccaagggcttcatggctattcagggacttagtggtaa

SEQ ID NO: 604300 - DNA, 123 bp, Homo sapiens
  misc_feature (75)..(75): n is a, c, g, or t
  misc_feature (79)..(79): n is a, c, g, or t
agaataaaaaggagggttcactggtctttgtgctttaaaactatggccatagtcactgacaaacatttgggtccntggntaattttggctcggattgagggagatgccggtttttttttggga

SEQ ID NO: 604301 - DNA, 338 bp, Homo sapiens
agattgcgtgtggatcaacatgacggtcgttacttcagagatggtcactgctgaatcattgaacatcccgaccctcacgatatccagtaccgcctcggcctccccatgtgctgcgatttaccagggcgtcagccatcccttgcctggctcttccagtgaggctagttgaattaacgttgatctcggcgtgctgtatcatatattgatggttcattagctgtttcccttgttttaaaatgatcagatcaatttggatggagtgctgggaacaaaaggctaattggagtgaatttaagagagaacaggaaaaaaggaactggagactgggtatagatgac

SEQ ID NO: 604302 - DNA, 146 bp, Homo sapiens
gagacctgtttgtttcttatgctgttgttcgtgggtggttctcatgtgcattgtctgagtttcccttgacagggccccctcccccgaggaaatgcgcccaccaaggtgcctagaactcatcttggatccgtcctcaggcactcctt

SEQ ID NO: 604303 - DNA, 333 bp, Homo sapiens
ctccttgctagtgagcctcctgctcccgcctggacccactgcttcagcaggtactcatagtagctgtctggcctggtgccagtgtgaatatgcctggtgggtgaagaggcactgtgggtattgatgaacatgggcaccagccctatgttcttcccagacatggcgtgaatgtgctgtgtaagctatctccattgcctcctgaaacttcttatcccctgtgagaggggcgagctcccgggaactccagctgaatgctggccacctcggccacagtgctgtcggacggtccaccgtggcggatgggcaactccagtaccgatgttcacatccgag

SEQ ID NO: 604304 - DNA, 699 bp, Homo sapiens
gaccttatggaatcaccagactcttggaactgttatgcccagtataacctgtcttatctgtcagatgctcgatagtttaacggataatgcggctcgattggccacgaatattaatcctgaatgtgggaaaccctcaattgatgcatggtattcacccagctgccaacattatactattagccagatcttcgaataaatcaagttattatttcgatactgaatagatcaaagcagtaagtacatcctaggaacagtcaggtcatgactccagtctctcgtaacgggaaaaatggaacgaacagccgcgtgtgtttcttgggtatacttactaaagccggacggcgaacactctgtggggaccgaacacggcctgggtcagtcgacggcgaacaccttttgggtcaacgggtgcgcaagctacttatcgcggacgttagaagcgtttgagaacagcaaatatactaatgcaagaggtttgagacaccccctgcgcggaaaacaataccgggcttcggttcctttacactacccctttaatgccgccacaatagcgggggacacatatatggttcgggtttggaacaaccccctttaacagacgacgaccattatgtggcttgagaccccttatttttgtaactttcggtagggtgtggacccggcggaactcgcaaacgggtccataaaagtcttgaagac

SEQ ID NO: 604305 - DNA, 879 bp, Homo sapiens
attcttttggggcctccgtttccttccccattggcgatttgcccagggtgtgcaggtgcctgtggggattctcattgcagaggggtttcatataggtgggcccctctgggtgccgtgcgacgtggccccagggtctcatggggggcctccccagtatggacgccgccttgtgagtgcctttttgtgggtgcttgtcctgcgcaactggtagggctccgtaggcccccggggttgtgaggccagtgaccccgcccactgggaagttgggaaatgtagagcgctttttcttgtggccccctgggaccgctgggagtgcagcacacttgtagtgttgagacgctgcttgcacacctggggatgtagggaaaggaaaaattttttggaaggatgcccttggtcccagaggatgtcccagatttgaccattcttgggcgccaggattccccgcccccgggatggcgcccgcgtctccaggatgtctccctctcagaaacaccttctgctcgcgcgtctcccactttattttggtccgctgcgggggtgacccacaccccacgtggcccgcaacatttccgctgtggcccgacattgtggggccccactggggtttttcttggggctgagtgagattctggataattgcgtatccaatccgccaggtgagtcttgttcccccctgtgtgaggcttgtgagccctctcagattctcttttcttagcaaaccagccgttatttagagagcgcaacatcccttgttgacctgaaaatggcgaagcccagataaatttttttgttttccttgttttctgctttttttccccctttgtggccttccaattttgggatccagaaattaacccttgtgaattgccaaaggga

SEQ ID NO: 604306 - DNA, 1140 bp, Homo sapiens
  misc_feature (2)..(2): n is a, c, g, or t
cntctgggccgccgccccttactctgcacccgcaacgcaagacggtgtctctcggtgtcgttttctgtggcgctcctccctcccaccgccccgtcgcccctcctcgtgcgtgtgtgtttcctctcgctcttgttgcgtcgtcgacaacaacaacgactcttctctaacgaccgctctactctcttcactcgagcgtcgctgtcgtccgactccactacaccgcggggggggcgccacgacgtcttccctccacgccgctcgtggtgttcttcatcacacggctggccctcactcacgtcttttcccatcactcctgggtgtcgggggggagacgtactccacggctgatgatactactccccccctccctcctgctgttttgtcctctcacctctgcggcggtgatgtctctcgtctttctctcccaccccctccctccgccactcggcggtgatgtaccgcctccttctccttctcccaccacacgcgtggtgtatttcgtcgtccgccaccactcctcgcgcgcagcgcacgctcgtgtgtgtttttaagtgactgtccttctctccctctctcgcgagtgttgtggtggcggcgcgtctttctcctcttctgttgcgtgccgctccacaacacagctccgacacgcgcaccacactctgtgcggcactttattatcagcgctcccaccaccgactctgtctatcttttctacgcgcgctgtgtagaaaacattgtcctcccgcgagagacagtcgctccacagacacacacagagctttagagagagagacacaggcggcgcgacatagatataaaaaatcactcagcagtccccacgtattaatgtggcacacatgtgcggcccgcgaggatctaatgtgtgtgaagcacttcctaactgggagtggagtggtgatacccctcattcacgagccgcgtctttgtttgtctcccaccccccgcagtatatttctccatccccgcgataagagagagagtaactcgtcctcaaacagacaatcacgtttgcggtgtgacctttttcctggcgaatcaaggtggtctcccgttcttttctccccccaatctttttttttttttttttccaaaaaaacgcctcccccaaggggtgccaca

SEQ ID NO: 604307 - DNA, 486 bp, Homo sapiens
  misc_feature (76)..(76): n is a, c, g, or t
  misc_feature (109)..(109): n is a, c, g, or t
  misc_feature (154)..(154): n is a, c, g, or t
  misc_feature (200)..(200): n is a, c, g, or t
  misc_feature (309)..(309): n is a, c, g, or t
gtgtgtccaaagggacctgaaaaatcggtgctgtggctcaaaaacagcttccagtgcccctgttaggagatgaacnacatcaacgcgccccttcttggtcatgggacanaaacagggtggggagctggtgttcccctcggttaaacggtggcanaaggggcaaaaaaagttcaagcgcttctcccccagcatccccaagntgcagtgctagtcccggcatccttatgggtccgccaggcctgctccagagcacgggtgaccatttttggtccggggtttcagctcccgttccccaagcccactcctaantggtccagtttcagcctggggagcttccccccgccttttgcccgtttgcatcccccgcctttcctgggttataaggcccccgggggggaaagctgttttcccctaaaggaaaagccccccccaattttgtagaaatattccaactaataaaatcctgaatatttttttgaggtttta

SEQ ID NO: 604308 - DNA, 573 bp, Homo sapiens
  misc_feature (135)..(135): n is a, c, g, or t
  misc_feature (172)..(172): n is a, c, g, or t
  misc_feature (211)..(211): n is a, c, g, or t
  misc_feature (240)..(240): n is a, c, g, or t
ttttgtttcggccatctgctgaggggggggcttgaatctccattcacttacccacttccagtgtttgggaagaattcccgctggtgggggcgatctgtgttgagggtggctccaccggcctcttcatcttcctcnaaccagttttttattaggcccggcgctccaacatgtntggggcagacaagacagtagagtttttcggctactcctnactcacggggtaagtttttttcctcaagntgggccccatctccttttttttttccctaaagttcatccgggaaatttatgttaacctcaagatggactgagttttgtatggcagaactattgctgttctctcccttttttcaggccctggtgaactctcctaccagctttttttttgattgactgaattgggggagggcaatggtgccttcccttttgccctttgggcattccttccccagagagggcctggaaattataaatttctatcccataaggattaaaaatttgaactttttaaggtgcctttagttttggtcctgatttttctttttacaattaccaaaataaaatttattaaga

SEQ ID NO: 604309 - DNA, 99 bp, Homo sapiens
ggcacttccctcatcatcagattctgtgttcatgagtgcctgactagagtagaccgctctgggtgccatccttgaaacaaatgccttcatttatctttg

SEQ ID NO: 604310 - DNA, 180 bp, Homo sapiens
gagccgcgtctgcaacctacaccacacacaccagatcgttaacccactgagcaagggcagggattgaacgcacaacctcatggttcctagtcggattcgttaaccactgcgccacaacgggaactcccccctggtgaatttttaatcaattagcccttactactcagagtgagatgcatg

SEQ ID NO: 604311 - DNA, 423 bp, Homo sapiens
cctatttaccaatcttttcactttttgcactgtaatcgtggctaagggaaaaaaaggatggggaaaggaggagtggccgtatctatagactagagggtcatcctatttgtggaaaactttattgtctacttcagtagggtcctgaatattagtccagtccttactgcccagtacttaaggaagagaggtctaagtgtgactgtatggggctagaagtaggtaccaaaggaaaagctagttcccaacagctccaaggagcaggagctgttgctcttcaggaagacggatactggtatggttgtgtaacattaatggccatggcacatatgttgtgtcaatctgatactcagagctcaatcctgtagtcaaatcgatcacagtcactccaggaaatgaggaggaatgaacccagatccctccaac

SEQ ID NO: 604312 - DNA, 347 bp, Homo sapiens
gggtctggggggggcctttttttttccccctgggggcaaaccggggggggccgaaaaaaacccaccccgggttttttggtgggccggggggaaaacagggggttttttgggccccggaaaagaaacaggggggccccaaaggcaggttttgggggggggggttttgcattggaaaaaaagccttgggggggcccccggggtccccaaggtttggggaacccctggggggggggcccccggggaaaaggccccctttttccggcttccaacggcctttttataggttccgggaaaggagggttttttggaaggtgccccgggggggaaaaaaaatggttcccccctta

SEQ ID NO: 604313 - DNA, 1155 bp, Homo sapiens
  misc_feature (613)..(613): n is a, c, g, or t
ggcaaaatggtcctgaagggagctgaagtcgacgacttctcctgtggagcccccgactgaggcggagacgaaggtgctgctatgagagctgaggggagcggctaagatcggcatctcccggctcatgtggcgacctatctgctgcggcggattaccgtcatgcgtgtgccagaaagcagtgtgacgtgactgcggagactgaggtcctccgtgccagagacaatagcatgcgggagaaaatcgtgattgccgtgcgcttaagtcacggtacaggtcggactcacgaccgtggggatgagaccgatacatcgccaggtcatgaagggcgcctaggcatgtcgctctcgcctagtgcgtcggtgagcaagctaggctggcgtccgctacaaggtccatacgaaaaagggcataacccgccactggaagacttcttgcggaaagcacatgggtggactccttgaagtcgcaccccaatgtttaaccgtacggatgcctggtaacgccacctagttcgcacgcgaggaagatttgtcaagaccaagggaatcactcaagggcatgggccgctagggggggcaccaacacatgttgtgccctggcctggtgtgcgtancactaatactagcaaggaatgcttcaatgagagcgctgtaagcaaccggcaacagtgcacctctttgcacgggaaggaggtgtatcctggaggacactactgggcatggaaacccgtggggtcctcataaacggagcggtcaccctgtggagaactttagtcatttccaaaagcatatgttcggatgagccctattacttctcaggaggggagtttgttgcgtaggtagtgggcccattgtggtcaaagacccttagttcatagcaagagctaacttggacgcattacagaaggaaatcgtccggtggaaggaaatcaaacgtttctggaaaccaggaaattcaagacaagttggctcctagaaacgggaagctaattctttgaacgccgggccgctgaagttcccctttggataagagaaggaacttagttaacgcaactcgtaaaatcgtgggcgagcctaaggaaagttaccgacggaaactttacaacacacgcgcgttggttatcaacagggcccgtcgccacctcatggtgagacc

SEQ ID NO: 604314 - DNA, 607 bp, Homo sapiens
cggggtccagagtggcagtaaggaggacgatggcggggtgccggggtctctgtgctgctggctgcgtgtggtgctgctgctgctggtgagcgtgagtgaccgcacgcctcgaggagctgaccatccttgtgagaaacagcaggaggaggaggatgagattcttcgcagggaacagatctatgagagtttggagttatgatcgcagtatcaagtgacccgttagctgggatgttatggagaccatggataagtaagaaaggtcggaagatctgaggcggttgaagtggcagtgcgtggtgttgaggccattgtgagctctgccactgggccgtgtcggtgttcccatttggtgggactctcgaagctgcggcacgatcgttacacccaacgtcacaggtaccgcggaggtagtgccacaaggagcaagtcgggagcgagtcgagtgcaggccgaagaataggcttatcctcagtctctaggtcttctaccgttggaactccgtaggtttgatataactacgacctagaaggtcgttaccgagtggaaagcctaccttgtatcttcgatatggagccgcgtggcaagcaggctcacaccgggataccca

SEQ ID NO: 604315 - DNA, 404 bp, Homo sapiens
  misc_feature (15)..(15): n is a, c, g, or t
  misc_feature (72)..(73): n is a, c, g, or t
  misc_feature (133)..(134): n is a, c, g, or t
  misc_feature (152)..(152): n is a, c, g, or t
  misc_feature (165)..(165): n is a, c, g, or t
  misc_feature (188)..(188): n is a, c, g, or t
  misc_feature (194)..(195): n is a, c, g, or t
gcttctgcacgtccnaccccaatccaaccagctcagggcagccagttcattcaacttctcctcaacttgttnnctgcttccttcccatgcgcacatcacatggccatctgtccagcaagtcaggcatgcaacnnagcacagatttctcaaanattaactggtgcnatgcttcagtcatcacaggcacntgctcnnatcactggtcactcctttgatccatcaagggacacagaagtccaggaataccagctttgccatgagaccgctacacagccaccacacaggacacaatctctcatggccatggcccatgatgcttcgacagaactgcagaagctggcagcacatgacaggatcctgcacagctgcacatggacccatgtgctcactctggtacccctcac

SEQ ID NO: 604316 - DNA, 278 bp, Homo sapiens
ttatgtcagcgggatgtcagttagaagacagcggcgtgatgttctcagatgtccacagcgcatgtaaatgagggatagcagtagtgacgcccatctccactggccgtcgtgatacatcagaaactcatctcgaatgaagtacttggcccgggtcacgcgtgggtcctctccgggctcgggagtagcatcctcaggagtagtgtagcgagcaaattctggaaagtagtcctcaatcttcgatttcccagcaaagaaccacacgaagcacaagaaccaca

SEQ ID NO: 604317 - DNA, 260 bp, Homo sapiens
gataccgtacagtggggcatctgtcaggaagtcatggctatgtgggttggcacgggtcaggtgaccagacctctgggggctgcagctgtacctacttcacacctatatgaaagtctccttgtatgtccttggagcagcctggagacccccactgctggctccgcatcctgggcactctgccagcagtgtggatgagcttgggcggacgtgttctagcaagtatgccccacttggtggtagggtaccgatgctcgaatatc

SEQ ID NO: 604318 - DNA, 871 bp, Homo sapiens
  misc_feature (871)..(871): n is a, c, g, or t
agcgtgatgtacgggttcgtcagctgcccagctgccctgtgccctctcgctgttgctggtctctggactccctcctcccagggccaggcgccgctcagaacgagccaaggattgtcaccagtgaagatggtcatatattctgagaacagcccctgtactcccatgtcaccctgcagtgtaacctcaccatacagactctcacacccttacatacagctactggactaaagaatgggagatggaactgagttgcacaattcgtaaggaatgccaggcaacgatgggagcttacaaggattcaattaaaggcctgaatcagccttgatgttgatttctagatgctgaaattaccaaccttgcggctactaatccagctcttgttcacaggcgcattacgtagacaggcaacaacagcacatccaagttgacaagttggaaacggccggcgtcacatgaacaattcacttgtgccaataaaaactggaagattcgaagcacacaataatcgaaatttgaccaggtgggccatgtggaatttgccatcaattaattggttatttcggcaaaatcttcccacggattggtgccgtaaccacccgaccaaacccccaagaaacctttgacaattactattggacggaccaatatgcaaactatataacgacaaaccagcgtcaattctccccccaaattgtactcccccatcatgatcaaacattacccattctatctacccagcatcatcatatcccaattccaaactcaaaactacagagacaccaaacttcaccaccactagaacttataacacccacattatgttagaaagacactattgctatagaattcacaacagcaacataaacccctn

SEQ ID NO: 604319 - DNA, 874 bp, Homo sapiens
aacactacagatcatatgactctggctcggtacagtgggtatcttgatcatcaccttacttggaactgtaacccgatcctcttccctatggaaatatgtccacagttgtctcacccagattcttccattttgcaacgtataaatcttgagctttggttgaatttattcaaagcaatcctttgtgtgtgcatcaacggtcttctcataatctggacctttagaacttacctttataatgcttctatttgccttccatgtttctacttgctcatattttgccctttatgttattcactctttctggccaactgctagtaatccttcaaagctcagtgaaactgtcaccttttcatacagtattccttactctcagccactcatatttaattgcttgggtatttgagcaatatataatgtgttgtcaaaagtgtatatttatgtacacgaaaagttaccactctaaaagaacttaataaactagtgaaaatttgttttgtaatatttagaaggttgctaatagcatgttttccaagtttaatgtgctgtgattaaatatttgtttctgttcctgtgaagggatttaccaattggaataagagagattttaaccagtttatcaaagctaatgagaagtggggtcgtgatgatattgaaaatttagcagagaagttgacggcaaattccagaaaagtcttggatattcagtgtgtttgggaacgtgcacgaggtccggagcttgagaaaatatggttcattgaaggggaagggaattcaaagaatattcgaagtgtacaaattgggggaaaactttctgggaatttggttcggaacattctggaaaattttttttccctttacaattttgggttcccag

SEQ ID NO: 604320 - DNA, 756 bp, Homo sapiens
tatttttagtagaggcggggtttcaccgtgttagccaggatggtctcgatctcctgacctcatgatccgcctgcctcggctcccaaagtgctggaattacaggcgtgagccaccaacccagcctccatctttaaacttttaaatgtgaaatttctatcatgtaccgttagcctaacaagattttctttcctatttctgactggtgcctttcccctttttaggagcaacgaaagctactctcttagttatgtctgtgtgatgtgaccacattgtcacgaagataggagaagagaatatttaattcgtttgatgctttgtgtcccaagtgtgaccctaaacttaagcttgtgtaggagtggacattctttcatgtcccttccctttatcatgccgaaatatcaatgggacatttggtgcttgttggttcaaaagtaatgtgatatatactggtggttttatctaaaagagtaaatggtattgtgccttggacaaaaagactgacacaagagcaaaataaagcttaaaaatcggggtgttatgtgctttcctcccattttttgaggcatatttatccaagatggtcttgtataatataacatgagactgatgcagttaaagtaaggcctggtttataccattgttcattggacccctgttataaaggcaatttctgtgttgtgtttggagaagaggatatggattatacagattacttgtaaattgggtggggatttgggtaatttttcaataagggtg

SEQ ID NO: 604321 - DNA, 440 bp, Homo sapiens
  misc_feature (21)..(21): n is a, c, g, or t
  misc_feature (37)..(38): n is a, c, g, or t
  misc_feature (44)..(44): n is a, c, g, or t
  misc_feature (260)..(260): n is a, c, g, or t
  misc_feature (268)..(268): n is a, c, g, or t
  misc_feature (288)..(288): n is a, c, g, or t
  misc_feature (380)..(380): n is a, c, g, or t
  misc_feature (400)..(400): n is a, c, g, or t
  misc_feature (418)..(418): n is a, c, g, or t
ccacggaactgatatatcagnatggagagaacaatgnntatgcntgcacaaatccagaaatactagaagaaaactagccgaaacttctttctaaatgtgtaatgtaactattgattactgacatccttccgtttaaatcctatgtgttgaaaatgcaatcttggcagcctgggacaaatgttcagtggatgcttcaagttgaaatctgctgcattggcatgaggtttggtgaaactgcaaacgtcacaggcctgtgctcnttcttgantgtcatcaacatgtcaggcnttcccagaggctcaatcagtgtcaaaccattttttcttgtccacgtcaaacacacccttttctgtaattgatgcggttgacacactgttttnccgtcagtggtagtgtacanttctccatgattttatgngcatttcccttcgcagaggtgc

SEQ ID NO: 604322 - DNA, 301 bp, Homo sapiens
cggcgagacgcagagcacgagagccgctcgagaggagcgcaagacgagcgctctaaaacgacagccgcggtccccacgcgccgagcgccgacatcatcctgaaacgctgcagcgagagcaccaagcggaagctgcgtctgccgtctgaggtaggagcgcagtccccagctagcgtctcgcccttgccgccccgtgcctgtatatacgtgttctataagagcctgcgtctggacgccgagggcagccccgacccctgtcccagcgcgtcccgccaccctcaataaatgttgcttggagtgga

SEQ ID NO: 604323 - DNA, 471 bp, Homo sapiens
aaaactgaggcacagagaagttaagtggctgaccaaggtgacacagctggtgaaggacacagccaggactctaaccagctccacatcacaaacgtgctgtaatgagctactggctgcccagccagccgactgaacaggttgtttataaaatggagcaaatactatcaatcccacttgcccttagaaatgcccagagaattaaccaagctcaaggacagtggggatggcacagaactgactgtacaggtgtaaagtgtgatgatttatgcaggaactagctatcaaagttacggaaacctagaattttatccattgttgggtatctcccagtagtgcatgattagccattcttggcgatgattctgtgagctgttagaagtttttgtgtgtctaagtagatctgtctgaaactattttcaggttgtatgaatctttgtctaggaacttgcttccctggcctacccaaaaaaa

SEQ ID NO: 604324 - DNA, 276 bp, Homo sapiens
attgttatcgactcactgctgtatatgatagattggagagtgcgagacgctacgttagtgcgagagattggatatgatggatggggcagtttttgtcatgtgagagagcaggcgatgtcaagggtggttttgatgtcaactgcatttattttacgtcgtagatatgggagtactgtgattgaggtgagtaataggcgtagtagagtaaggtaaggaggtatgtggcatatgtgggatagaggctatgttttgtgatctcgatatgccattggcaaa

SEQ ID NO: 604325 - DNA, 872 bp, Homo sapiens
ttaacagtccttcgtgaatagagcaggcacagaaatacaaaccttcattccttgaatcaaggagcactactggacttcaactgccaaaattttttaaacggtttataggacttactataccttgatactgtctaagatctactgaactaacaggacgttctctcactaacggaccaggtgctttctaacggttaacgtgctttacaagacagtactccacagacacaactctgccttctctttcatacatcttgtctttactgaacttctactccaatgctctgccttaacctgccttctgcctacagctgtatcagcccagaaactcctacgccgatatctataactttagcttcgtcgtcaacaacctaacacacttcacaacatggctgctacgtcactttctctgctcggcgccaaactgggtaacctaattattacccccaagcatcaaccagctacgcaacaatccggtccaccacggcagccactggttccacgccagcacactatcaatccacgggatcatcagcacccagcacctcggccaactggctggcctacggaaataccctctctaactccagcccaccctcccttctaaaccaaggcccccatacacgtctcactactccaggaacatggcccaaaaacaagcacacaacgtctccccacgcttcctatagctaccaagcgcacttaacacatgtccctcggcaacacgaacacagctccacccaatcacgaccctcgtaccacacattaaggccggaacgactctccactaccccccaccaacatctgtccacttcaagcgtcgggcaatcaaatctcacaaccatacccttcatacccccaactcaacttacacc

SEQ ID NO: 604326 - DNA, 656 bp, Homo sapiens
gagctgtgagtgcttctgctgcagtcagagccctgtgctgcctgccctgctcctgtgtgtgctgaattccatgtgctgtggtgtgacactgatgccagtgctgcctgccgcctgtgatgccatgctggatgcctgtgtggccagatgcctggatgctgctgtcctgctgtccacgcatgcctgcctggccggccagcacccatgtggccctgcattgccatgtgtctgtatggatgtgtgtgcagctgagacatgcaccctgtgccctgtgaatgctcctcagcctcctcttcctcatccttgatgggcactgaactcactcaagtgcttgcccaccaaccctgagtgagagctggcaggtgtacagctctgcccagtgacagcgagggcaggtgtatctgcacagtggtctgccccacatgcatgaccatgtgttcacgggatgcccgcacaaaacagctgagtgcagctactggagaaggtgcagaacatgtctcaatccatatgactgtctttgtgacagtgcggacccagagagacttgcatgtacgtgtgagcaagcatggatgaaccaaatgaaacggactggagtccaatgttcaacacaggtggacgtgagaggtcataagcaacacctggccaggcagttaaggcga

SEQ ID NO: 604327 - DNA, 990 bp, Homo sapiens
gggcgagatgagactgttcgtgagtgatggcgtcccgggttgcttgccggtggtggccggcgacgggagagctccggggtcagagcagagggtgctcatcagaactgtaggcccggaagattgtgtggtcccgttcctgacccggcctagaggtccctgtcttgcagctggatagacgtgcagactacctctgtctgccagcatagtgcaaatcgtgccggatattttttattgtcgtgatcttggctgggagcaaggatgactctcactaaccaggggcttggcacaatgggaaagtcgacagaggctgcagccagctatgtctgcgtgcccatggtacatatattaagtggtccaacggcgagagaacgggggacatgatgtctcttggtatcgagttgcggagagccctctggactcatcgatctgatcgcatcgaggcttgatgtgctgtgcttgaatcggtggctgtgtccatgtgctggagggatgaccaagaaattctctaagactcggagcaatgagtctctggtagggggaggccctttatagcgccatatacttgtagagatctcccgaactacctccctgaagggagctgagtgccctgatcacgtggttccaagacatctgagtacccagagaaaccattgtcaagcgaggctgcaggagactgtacttgaaacagaaggtgtcgctggctctccggcttaccatccaaaagcagccccagccagcccgctgagggaagggtgcagcaatgagcctgaggaaggaggagctggtaacctatctgaggaggagatgtgcgaatggggtgaagggcggggagaggggccaaaaaggttccccgtggggcccaggaaatcaagggtgcctggggtggggaaaggagggtcacacgaggggcaccgtaagtaaaagggccactggaacacaggggtggccgggccggctggggaccgcgaggaacctatttggtgaagtcgc

SEQ ID NO: 604328 - DNA, 388 bp, Homo sapiens
tcttctccgacaacaatctggaagatagatgttatcattccatcaaacctttgctggagtaggtataaaaacgataaaagctggggtcagaatttcaaccctggtctgtctgactctaaagtcacagtttttttcttttccatgtctctgacctctattatgggacttgcttgctatgctttatggcatttctcagcccacatgtctctttccccggttagatgtatggtcagaggctggttcttacttatatctacatcctggaggtcaagcccaggaatggtcttatataagggtctcaataactgtggttaattgaacaaacaagtgagtgaatgcatgagtgaatgaatgaatgaacaaactgaggattatgttatgcccctag

SEQ ID NO: 604329 - DNA, 270 bp, Homo sapiens
aaaaggcggcggttgcaggcaaaaagcctttgggaggtaaaaaaagaaaaaaggcttctgttggggttaaaaaacaaaaaaagcctttggggggaaaaaaggcagccggttcccaaaaacccgcccctgaaaaaaagcccgcaaaaaaaaaaccccctccaaaggaaaaaaagcctgctgcataaacttttaaatttggttattcccaaaagggccaatccttttgggcagccttttttgaaaaaaaacccggttataccggccggggga

SEQ ID NO: 604330 - DNA, 429 bp, Homo sapiens
  misc_feature (265)..(265): n is a, c, g, or t
ccaaggctgcttccatgggcattcaagtccaccgtcggggcctggctctgcacaccaggaaaagtctgcagaccccagcctccgcaataattcccagccaaagccactggtgtacagagaacacttaaaaaaatgtttttatgtgaaaaaaaattaaactctgatctgtatcagcagtttgtgtaaaatggcatcagagagtctaaaaatttaaactttttaaaaaaatttccagatctttgatatcgtatgaggtaacttccangtagccccttgccccggcccggtgggccttgggtccaaaactgtggtcaccacatcccaaagggggcacatgtccctggagttgcttccagctgccaaggcctgtgcaaattcgctgttaagagtttttaattaaatattaattccttttaatacaaaaaaaaa

SEQ ID NO: 604331 - DNA, 325 bp, Homo sapiens
accctgtgggtagcacataacggaagggtccccaggttggggagagccccaagttgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgagcagcccactgcaacatattttcacaatttctctaataaatctgcccttctttacctacaactatcttggtaaatggctttaccacctgcaaaactgaccctagg

SEQ ID NO: 604332 - DNA, 364 bp, Homo sapiens
  misc_feature (3)..(5): n is a, c, g, or t
ttnnnttttctggagacagagtctcgctctgtcacccaggctggagtgcagtggcacgatcttggctcactgcaacctctgcttcctgggttcaagcgattcttctgcctcagcctccggagtagctgggactacaggcacccgccaccactcccggctgatttttgtatttttagtacagatggggtttcaccatgttggccaggctggtctcgaacccccgaccttgtgatccacctgcctcagtctcccaaattgttgggattacaggtatgagccaccgtgcccagcagtctctctttttaaacctgaagtcatggtgaataaattgccaaacccagggaatgactgccctcgtgccgaa

SEQ ID NO: 604333 - DNA, 153 bp, Homo sapiens
gcgctacccagatacctcaggaaaccgcctcgggagggaactggaaggtcacaaagggcatcaggaaaccggtgggtagcaggaggaccagattcaacaaatcatcaggtctgggggtggtggacaaacttggcacgtggacaggacataaac

SEQ ID NO: 604334 - DNA, 272 bp, Homo sapiens
tttgtttcgtgggccccgaggttcaaggacgcctcgggggcgagtcatttctggaggtcgggccttcgcccgctcaccccacgcccatctccagggcgaggcggacgaggtcggcggtgcgggcgacgccgagcttggccttgatggaggtgaagcagttggccacggtcttgtagccgatgcccaggctgtcggcgatttcggcgaggctccgaccctgggcgagcaggcggagcatttccaggtcccgcaagtcaaaagaaattagagct

SEQ ID NO: 604335 - DNA, 381 bp, Homo sapiens
cccatcactgctcatcaatgcttgcctcaacaagttgctgctctacagggtcgtagacaacgaggggaccctgcagctgaagagaagcttccccatcgagcagagtctcacatcctgtgcgcagcatcttctagtcccctgatgtccttccgctcaagggggcctgcgtggtgacgggcagtgaggacatgtgcgtgcacttctttgatgaggagacgggacgtgccaagtgcctgcttgtcaacatagctgcatgggccacagtgcacctgtgcttgatgtcagcttcaacctgagacgagagcctactcccctccagtgacgccagtcggcatggtcctccgtctggaggacgggagcagaagtagggtccctcggtat

SEQ ID NO: 604336 - DNA, 812 bp, Homo sapiens
gtgcttgagcagaatgtagttgcgggttgtggcaccatggcttcaataatatcactgtggttctaggaatatggccgccgtgtcctcatcgtgctggatcggatggaaagaccgcgcttctgaggcggaattaatgggcttcaagatgtaatgtaaatgaggacgtgacaatgggtgtcattgcacattgctaattgaagtcaactctaagggttgtgacgcacataggtgggctgggtattaaagatgagtgcggttggacttagggactgcggtatgtagactgtgaaataattgatgaaggccaactattgttaaggccatgatgcggatggtggagtcatcatgaatatgctgataaggcctgatctgggtggaaagttgagatccaatggtttcagggatgactgataattggacgatgagaacccaacaacgcgacggtggtatggtccttgagctgaggtgccctgtggttatagagagaaggcgggagcaaaattgttagaaccggagggctatttaaacccatattcaagaattaagactgattggctaattgaggacagtgctgggatcggggtgagctatgtgaacaaccctgaagcaagaatcaggacgataagacgttcccttggtgggacaataaaggggaaacccgaatgcccccatgattcaggaaagcacaaaaagcaaggctgtggagttccaaaaaggggctcccacacaagtttgtcacccgacagatgtggctggagacctgctggtcaatgaccgtcccccactgggagccaaaaatggaggcggaaacc

SEQ ID NO: 604337 - DNA, 233 bp, Homo sapiens
atcagtactcgtccgtcactgttcctaggacttctaacagccctatatctcaaatactctaatctagcatacttagaataaaattcccactatgcacattttatttctccaacatactcggattctaccctagcatcacacaccgcacaatcccctatctatgccttcttacgagccataacctgccgctactcctcctagtacctgtttgggctgatttgccttgttgtaaa

SEQ ID NO: 604338 - DNA, 222 bp, Homo sapiens
tctgtacactgctgccactgttgtgtcctcggtcttctgctggtggctcacgcaaggccccccccgcgcgtggacaacctcatatcttacccttggggaccccaagggcaaggttgggtcaaactgtttggggggacagaggttgggctctcatatgggaacacacttgtgctcaagagttaccatattctcacaaccagagtggagaggggaacacaccca

SEQ ID NO: 604339 - DNA, 220 bp, Homo sapiens
accaggtgagttatgagccatcatggagatgcccttcttctacagcaatggcttgctacggcgttcaccctacaagaaactgacagagggccaactgatgaacctcattagcgggctgttacatatgcccagatcgctcgcaaaacctgtgagtccaacatggtagagcatagcgcaccaccccatgtacctcgcaatctgtaccccgctggcatcaatg

SEQ ID NO: 604340 - DNA, 126 bp, Homo sapiens
gattaaggatccccgggtgcatgatgtgtctgtgcactaaggcagccattcgttcattgtatcgtaccatgttatccgggtttctggaacacgctgcagagataaccagtggtacggagctcgaat

SEQ ID NO: 604341 - DNA, 497 bp, Homo sapiens
  misc_feature (17)..(17): n is a, c, g, or t
  misc_feature (267)..(267): n is a, c, g, or t
gagactcggtctcaaanaaagaaaaaaaagaaaaagatttttgtcaaatttggacctgatttggaaaaaaaaaacaaaaaaaacttacggctttgactctgtgaccagtgctcttgaggtgacctaacaggttggatttaaaataaaagtagctaattgattagaggtgatatgtaatatatgcaaataaccatggttgaattgtgttccccgaaagatatttattgagtatttgtgcacaccactttacatttattatctcattcngttttcctaaacaaccctgcaggttattaccaggtacttctctgctcccactttacacgtgaggaaattggagcaaggttgttaacttggaaaaggccacaaaggtagaacattgcactgcctgaatttgaactcaggggctctaatattagagcccattctctcaaaagtttagatgtgctacttactacttgatgaaatgtatggtatttttattagtgagtgcatac

SEQ ID NO: 604342 - DNA, 180 bp, Homo sapiens
cctgcggcatatggatgttcccaggctaggggtccaatcggagctgtagctgcgagcctacaccagaaccacagcaacgcagaatccgagccacatctgcaacctacaccacagctcacggcaatgctggatccttaacccactgagcaaggccagcgatcaaacccacaacctcatggt

SEQ ID NO: 604343 - DNA, 1791 bp, Homo sapiens
  misc_feature (397)..(397): n is a, c, g, or t
agagagtaacagagaaacatacaaccgatcctcaacaatgtctagatcgtagacatagcatgtacccttcatgacaccatacttctccacgcagacatcctagccttacgcgatatttccctctcatcgctacgtgcatgcctctcctgcgctccaacgtcgaactgttacacaaccgtcgcctgcacgagttgtcattgcgcaacgcatcgcgtccgaaacgtgctgcagggtaacttgcttccccgaggctcatgggacttcgcaacccatcccggggctgttcccgtcgctcgcaccgaggactgtcctccgagccctcgcatgtcttccattagtactcgaaccaactatgcagacacgtgggacattgttccgtcgtggctctagtgactangtcggtgtcctgccatggtgctggtaatcgcgataatgcgtacacttgatatggcgtgttgtcgccaaaagtccttcgcctgcgctatcgtggcgtcgcatatacgatcgcggctaagttctctatgctcgaggactaacaccaggcgacacgcgagcctcgtggcacgtaaatgtagtggccgagcaaatgacgaagcatacacgacctgtaggcacctaggcagtacgtacgcagggagccaagcaggccaacggagggaccgccgaaagacccgggtggacttccggggagcaggcaggcacagcagaggacataagcgaacccattggatgaccgacggaggacctacgtgggatgtcagctgaatactaacccgatccctaaattgggcaaaaagattgttttgttcagttcgaacagcaggacgtggcaaccaggattacccggaaatttacaagggaggtaatccccggttgtacaactgtggttgtgcgggttaaaatcggggatagggtattagttggggagttccgatacagcggatgaaagggcgacgattttgtttgggattggacacaaaaaaaggaaacgtgatattcagattggatattcgaataacaagaaaggacttggagtagggtggggttgaaggaatatagagaagggggatataaactccgagaggaaggaataaaatggtttcttgtgtgcttgctttgaagaggccgtaggttatgtgtaaaagaagcttgtttggggccaattggacacaatagttgtttgttggaaacaggtgcggacaataacgatcgcgggtgggggtatggacacatatatgggggcacgctgctttacaatttttgttcgaaaaagagaagaggcgcacttaatgtaaatggtggcaccagaaaattgcgggggggcgagagatggttgccacttgtcctcttctgtggaaataaaaggcgcaaaacaccgcggaattcatagaagacagttttttaggtaaaataggcccagtttgtgtaatagaagaccccagatggtggggtttttttttatggtacccccggaaaagaatagaatacgtataaaaacacgcttgtttgttattatcaacggggaaaaacaatttggtagggaagggagcaactacctcctacaaacaaatatggttcacggagggagggacgacatatatcaaaagaaccacctgtttttttgacgacaagaagcagggagggatttcattatatgaggtcaaaaacacctatcgtgtcgtgacgtgaattgatacaaaaaaaagaaagcaggacaggtgttttcatctaaacacaaaaaaacgaggggagggatcatgttataatagtggaggaaacgcaaacgcaata

SEQ ID NO: 604344 - DNA, 789 bp, Homo sapiens
gactagttctagatcgcgggcggccgctcgcgatctagaactagcgacccacgcgtcgcacgaggtcaggagatcaagaccatcctggccaacatggtgaaaccccttctctagtaaaatgcaaaaaattagctgggcgtggtggtgtgtgcctgtagttccagctactcaggaggctgaggcaggagaatcacttgaacccgggaggtggaggttgcagtgagccgagaccgtgccactgcactccagcctggtaacagagcaagactccgtctcaaaaataataaataaacatacgtgtgcatgtgtctttacagtagaatgatttataatcctttgggtatatacccagtaatgggatggctgggtcaaatgttatttctagttctagatccttgaggaatcgccacactgtcttccacaatggttgaactaatttgcactcccaccaacagtgtaaaactattcctatttctctacatcctctccagcatctgttgtttcctgactttttaatgatcaccattctaactggtgtgaggtgatatcccattgtggttttgatttgcatttctctaatgatcagtgacgatgagtttttttcatgtttgttggctgcataaaatgtcttgagaaagtgtctgttcatatcctttgcacactttctgatgggggttgttggtcttgtaaatttactttaagtccttgtaaattctggatattagcccttttgtgcggatggatcagattgccgaaaattttcttcccattctgaaaaaacaaaaacaa

SEQ ID NO: 604345 - DNA, 551 bp, Homo sapiens
  misc_feature (180)..(180): n is a, c, g, or t
  misc_feature (197)..(197): n is a, c, g, or t
  misc_feature (204)..(204): n is a, c, g, or t
  misc_feature (342)..(342): n is a, c, g, or t
  misc_feature (345)..(345): n is a, c, g, or t
  misc_feature (448)..(448): n is a, c, g, or t
  misc_feature (484)..(484): n is a, c, g, or t
  misc_feature (536)..(536): n is a, c, g, or t
  misc_feature (543)..(543): n is a, c, g, or t
gtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttgaacttcgagacaagaaatacaagggcctcanccaccttcccaatgcantgctcancattacgtaagaatggctttatagtgctcaaaaagccaccatataaaatcatcaagatatctacttcgaagactaacaaacaccaccacaccaaagtccatctaattaatattaacatctttactgagaagaaatatnaanatatctacccgtcaactcataattataatatccccaacatcaaaaagaataacttccagctgattaccatccaagataagtacctatcactactccagaacancagagaaatacgaaaaaaccttcatctcccttaaanaaacctttgcaaagagattaagcggaaatacgactgtagagaaaagatcctnatcacantgctctct

SEQ ID NO: 604346 - DNA, 130 bp, Homo sapiens
attcggcacaggggctggcttggcgagagggcaggtttgcgggctttcgccccgttttccaaagaccaacaaagagtccgttcccaactcccaactcaaccccttttggaactatgtgtggtggttggga

SEQ ID NO: 604347 - DNA, 132 bp, Homo sapiens
ctctcgtccgagttgtcttcctccaagtagcggtaaccgcgcactttgtgctgggaccgcgagatgcggggctggcgcggggccacgccccggcgcagttctgctccatccgcaggtaggagaccgcggccg

SEQ ID NO: 604348 - DNA, 1046 bp, Homo sapiens
  misc_feature (260)..(260): n is a, c, g, or t
  misc_feature (326)..(326): n is a, c, g, or t
  misc_feature (373)..(373): n is a, c, g, or t
  misc_feature (387)..(387): n is a, c, g, or t
  misc_feature (390)..(390): n is a, c, g, or t
  misc_feature (545)..(545): n is a, c, g, or t
  misc_feature (584)..(584): n is a, c, g, or t
  misc_feature (607)..(607): n is a, c, g, or t
  misc_feature (628)..(628): n is a, c, g, or t
  misc_feature (659)..(659): n is a, c, g, or t
  misc_feature (671)..(671): n is a, c, g, or t
  misc_feature (687)..(687): n is a, c, g, or t
  misc_feature (698)..(699): n is a, c, g, or t
  misc_feature (708)..(708): n is a, c, g, or t
  misc_feature (720)..(720): n is a, c, g, or t
  misc_feature (723)..(723): n is a, c, g, or t
  misc_feature (728)..(728): n is a, c, g, or t
  misc_feature (745)..(745): n is a, c, g, or t
ggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgctttttttttttttttttgggaaacggtttggctcttgtntccccggttggagtgcaggggatgatctcaactctcaactcactgtaacctccgcctccgggatantccggcctcagcctccggggtagcggggattacaagcacccaaccangcccagctaatttnggnatttcggtagagacgggatttcaccatgtgggccaggctagtctcgaactcatgacctcaagtgatccgcccattcggtctcccaaagtgcggggattacaggcatgagccagggcgccgggcccccaaaggctcttgaaccggaaacccaggangggagatgctcactgagctgctgcttaatgtgtgcgggngcaatgtgtgtcatgtccgcggnagctgtctttggccactatangggaattcgggccacccggggtggggtgtgnccggggtgagancccaagctgttgcganctgtagacccnncctgtcgantgtgtgccccgnggnatgtntgagcctcagttcctcnttgtaggggggcaatgatactcactccacgggtgtggggagtttcactgtggggcgttcttcgcacaacacgcacacccataccaagaaaaacaagagggcgccgctaaatatccggggcacaattgcgaaccttttgtaacgggcacaaagagatcttaaaaacagcgccgcgcaacatcgcggggacagcacggctgggaaccctcctggtgtcgggcacaccaacgccggaaaagtcttggcccttggcgttctgtgatacgtcgtatcccctgtgcgccccagctagcctccataca

SEQ ID NO: 604349 - DNA, 253 bp, Homo sapiens
gcaacgaacgagaaaaacttaactagatagcaagtgatcagaaagtaagcttccagattttcccatctagtctaattttcactccatttctctgctcaggaattttagttcaatgactaagatgtgggaggaaaataatgacactcatcttcttatctttcagaatttacattagagagaaaataaattctgaaccctatccctagaatcaggcaaaaccgtggtatgacttaaaagcaggacctcagaaatg

SEQ ID NO: 604350 - DNA, 722 bp, Homo sapiens
gttcctatactggggcacacacctgggcctccctaatggaggaacaagttttctttcgattgttgtgcttttttttgctcttttgttttcttttttggtaagactgcactgactatgtcgtgtgactgagcagacactggagaacacgatgctcccctggctccctctactgtcttaacacatcatcggctcttctctagtcttctgtgtgaactggtgtaatgtgcacagtaatagcacaatcactacaagtccaaactatagcacaaaggccaattctaacgtcattggggaaatcggcggtgaaccttgcacgtggatgaggagatcagacactagagtgataggaagcgtactggcagatactccttgttgccactgctgtgtgattagacaggcccagtgagcccgcggggcacagtagctggccgctcctccctcagaaaaaggcagtggcctaaatccgtatgtagtaaatgacgttaggctatgatgctgtgggggactggctgggctgctgcagaccgtgtgtctgtcagcccaaccttcacatctgtcacgttctccatacgggggagagacgcagtccgcccaggtccccgctgtctttggaggcagctagctcccgcagggctgaagtctggcgtaagatgatggatttgattcgccctcctccctgtcatagagctgcagggtggataataccagagcgctggaacctt

SEQ ID NO: 604351 - DNA, 271 bp, Homo sapiens
tgacctccacgagctgagtactaccagattgcctaagaaggggtgaaccacgcccaggtcggacagatgatgagtgactcacacttgtaatcccagcatttagggaggccctggcgggcggatcgcttgaggccgggagttcgagaccagcctggccaacaaggcaaaaccccaactatattaaaatacaaacattaactgggcatggtggcgggcatccgtaatctcagctactcaggaggctgtggcacaagaactgcttgaacccggg

SEQ ID NO: 604352 - DNA, 230 bp, Homo sapiens
cccccggcccgggttttttcccccttttttaaaaccaaaggggggggggttttttttggggggggcttggggggccccctaaagtcccccccggttttcgggggggggcccctcccttttttccccccccgggggtttgggggccaaaactttgggtggggtggggggggggggtttttctttgtttttttttttttttttcaggtaattaaaggtgcccccccttccca

SEQ ID NO: 604353 - DNA, 141 bp, Homo sapiens
atgtaatgatttctcgacagtattcacagctctttctagactctgtatctttggatggatatcttagggaagtaatttcagcaagtgacaattttaagaagctggagggttttttcgtttagttttagtttggtttggttt

SEQ ID NO: 604354 - DNA, 856 bp, Homo sapiens
gttcgcagtggtatgggctctgacgcccacggaccgcgtttccctatggttcccccgggcctgccgtttttggtgggccccatctgtgtacacatagtctcctccgtccggcattgccggttcccctcccggtgaatataaccgttccggaggccaagttccgggtttgcccgaaactttcttttccggcgggagggttaccttttaaggcttgtaagcgggggtccatccatggcggattgggccccgccccccacacccggttgggcccggcggaccacttcgcccgggcatggaaagggaaccccccctcgctcggcaagaagctttttgcccgtaggaatgccccccctctctcaaggaaaaacaactcctctggggggccccggaataactcgaaatgtttcaaaaagaactttagagaatcttttctccaacccaagactttagacagtctttccgaacagcatgtgtcgcccccaccctgggagaaaaaatctgaacacaaaacagtgactcatttcaatctcccacaacaaattggtccgcccgcgcccattgagccctctcgcaaccacgccaaatttcctatggtctgcttcacataagacgtacagattttcttttctggagccctcgaaaagctcccctcactcagggccccaataaaacgtggaaaaataattggaacccacaaaacgtgcgtccccaatataccgaccccctgaatacattgaatactagtcaacgtacccctgagatatttcctgcaaaaatctaaatcaacactggtgatttacatctgaacaaattttatttttaagaaaaaataacccggtcttaaaccccgacaaac

SEQ ID NO: 604355 - DNA, 142 bp, Homo sapiens
ctgcttcagcttcccaaagtgttggggttacaggtgtgagtcaccacactcagcctactcttgcattcatcaaatatttgagtgctgcatgaatcccagatgcagatgttcttttgttttttctggtccacatttggactaa

SEQ ID NO: 604356 - DNA, 687 bp, Homo sapiens
  misc_feature (403)..(403): n is a, c, g, or t
  misc_feature (423)..(423): n is a, c, g, or t
  misc_feature (456)..(456): n is a, c, g, or t
  misc_feature (461)..(461): n is a, c, g, or t
  misc_feature (466)..(466): n is a, c, g, or t
  misc_feature (474)..(474): n is a, c, g, or t
  misc_feature (476)..(476): n is a, c, g, or t
  misc_feature (478)..(478): n is a, c, g, or t
  misc_feature (492)..(492): n is a, c, g, or t
gggctctcagctctcggcgcagggcccagtcttccttcataatgtctactgttcaggaaatcctgtgcgaagctcaggtatggacgggtgatcactctacacccccaagtgcatactgggtcgtgtcaaagcgtatactaactttgatgctgagcgggactgctttgaacattgaatacagccatcaagaccaaaggtgtggatgaggtcaccatctgtcgaacattttgaccaactcgcaggcaatgcacagagcacacggactattgccattcgcacgtaccagagaacggaccaaaacaggaacgttgcatcagacactgaacgtcaagccttcatctggccacctggagacggtgacttattgggcctattgaagacacctgctcagtatgacgcttcngagctaaaagcttccatganggggctgggaaccgacgaggactctctcattgngatcntctgntccagaancnancaggagctgcaggnaaattcaacacgagtctacaaggcaacatgtacaagactgatctggagaagggacattaatttcgggacacattctgggtgactttccgcaaagctgatgtgttgccctggtgcaaaggggtagaaagagcaagaaggattggctctggtcatttgaatattgaacttgatttgacccaagaatgctcgggggat

SEQ ID NO: 604357 - DNA, 418 bp, Homo sapiens
gaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaacaatggagtcaaggagatagaaccttatgaagaagcaggaggtaaaaaattaaggagcactgttccaaaggaagt

SEQ ID NO: 604358 - DNA, 256 bp, Homo sapiens
tgttaatgcaatcgataatgccgacattgttgttgctttacttgacgcaaaagatcaagatactggtacaatttgggaaatggtatatgcttacgctactcataaacctgtggttgtattaacagttggtgatacgtttgagtataccattaatctgatgccggctcaaggagcaattcatcatctcggaaacaatactctagcaacaattgatttttatggaaataacaaacgtttctatgttggaaaacaatct

SEQ ID NO: 604359 - DNA, 221 bp, Homo sapiens
tgggattctattgtacttggggtgaatcgtgatagacgcgggtggctggtaagaaagtgagcaagcctgggagtgaggtatagcttagttaaagctttcgtttattgctaaaggttaatcactgatgtatcccgtgggggtgtggctaggctgagcgttttgagctgcattgctgcgtgcttgatgcttgtcccttttgatcgtggtgatttacgagggtg

SEQ ID NO: 604360 - DNA, 805 bp, Homo sapiens
gcgtgctttctgctcttctgggcaatttctcacactggcaaagcagtccagcctccgtcttctggctccactctgctctgagcagcctgggcatgctgcaactcttcagagcagattttatttactacgagcagatttctataacttctgatacaacggtcatgactatcctacgaactctctgtggttttccgaaaatcattgaacttctattaactgctcggtaccctaacagatgacccctctaacctgacactgatgcgactgaccgcctgtgcggcctggctgctgcgagtctctcctggccccgcctctcttccacaccgcttgctaccccaccataatgctgcgccaccctccacacgagtcccaattccccaccaccttgccatttggcccaccgcacgccccattctgcttgaggcttacccacaattaaccttcataccccttaacgcggccccaacctatctccctagagcgcggcccttcagccgccgtagggcgcacctcgacacacctcgacccatcgaatccccctctggccatggcccactatgccacaccacaccatcaccattaaagttgccctaccaccaatttcggcggcaacaaacggccctccaacaaattccccggcagcaatcactggcctcagccacctatgcacccattcggcgatcggtccacagacaccgggagccttcaccttcagattagaccacgacctcgtaatccccttttaaaacgacgttgatcccacccaccacgcctcacacacaccagccacgcaacacacgcaaat

SEQ ID NO: 604361 - DNA, 128 bp, Homo sapiens
agacaaacgttagaagttatgcgtctcctacccctatgcccgccaaactgattaggagcagaagataaaagtaggactacctcatatataaaggagcagaactgggagtaactacctgatctctggga

SEQ ID NO: 604362 - DNA, 427 bp, Homo sapiens
ccccaggtccacctgctgccgccgccatcggaggagctggccctcaacgcgctggtgacgctgacctgcctggtgcggggcttcagccccaaggacgtgctggtgtactggacgaacaaaggcgaggaggtccccaaagacagcttcctggtgtggaagcccctgcctgagcccggccaggaacccacaacctacgccgtcaccagcctgctgcgcgtgccggccgaggactggaaccagaatgaaagctacacctgcgtggtgggccatgagggcctggccgagcacttcacccagaagaccatcgaccgcctggcgggtaaacccacccacgtcaacgtgtctgtggtcgtggcagacgtggaaggcgtgtgctactgagccccgtggccctgccctgaataaactccgtctcgcccccagcaaa

SEQ ID NO: 604363 - DNA, 638 bp, Homo sapiens
  misc_feature (615)..(615): n is a, c, g, or t
cgagccacaatgcaatcacaagtattaacagcagaaaaaaaaatctgaggaacgaatctcagaacttgaagattggttctctaaaataagatggacaaaaataaaaaagaatgaacaaaaccttcaaggaggatgggattatataaagaggccaattctacaaatcactggcatctctgaaagggaggtggagaaatcaaacaacttggaaaacgtagttcaggatatcatctttgaaagcttccctaaccttgctagaaaggccaacagtcaaattcaggagatacaaagaactcctacaagattctacacaagaccatcctcaagacacataaacatcaggttttccaaggtcgaaatgagggaaaatatgttaaaggcagccagagagaaagggcaggccatctacaaagggaaccccattaggctaacagcagatctctcagctgaaatcctacaagccagaagggattgggggactatatttaacattattaaagaaaatcttcaaccaagaattcatatacagctaaactaagctttctaaatgaaagagaaatgagatcatttacagacaagcaaatttctgaggtattcatttaccaccacatctgncttacaagagtatttagaaaggg

SEQ ID NO: 604364 - DNA, 120 bp, Homo sapiens
acagaatgatacgattgcatgatgggctagaatgtacacgtactccttgcctgaataagccatatatatgctcttaaacaaaagtttgaaattatccatctcatcccagctgaaatccca

SEQ ID NO: 604365 - DNA, 219 bp, Homo sapiens
cagcattccagcacagaacatcatatttatatcttcttcgaaaccacacttatccccacctatgctatcatcaacccggattgaaggcaaccagccagaacgcctgaacgcaggcacatacttcctattctacaccctagtaggctcccttcccctactcatcgcactaatttacactcacaacaccctaggctcactaaacattctactactcactct

SEQ ID NO: 604366 - DNA, 717 bp, Homo sapiens
gagagcgaccaaacgtcccgcgcttccaggcgcactccagagccaaaagagctccatggcggcgagggccaaagccacaacaacctttccctggtgttgcacggaccgggggacttgcgctggagaacttatcctatccctgaaccaggcccaaatgaggtctgtgcttgaggatgcattctgtgtggaatctgtggctcagatgtccactactgggagtatgggtcgaatgcgggaatttcatggtgaaaaagcccatggtgctgggcacatgaagcttcggggaacagttcgaacacagtgggactcattcggtaaagcacctaaaaccagggtgatcgtgttgccatcgagcctgtgtgctccccgagaaaacatggctgaattctggcaaggatgggccgatacaattctgtcaccttccatcttcttctgtgccaggccccccgatgaaggggaaacctctgccggttctataagacacaattgcagcctttgtgttacaagcttcctgacaaatgtcactcttgtgaggaaagggcgccctgatcgaggccactttctgtggggggatcccattgcctgcagaaagagggcggagttaaccctgggcacaccaaggtccttgttgtgtgggagcctgggccaaatccgggaatggtccatttgggctcgggtggccaaaggcaatgagaacaactccaaagtagtgggtgc

SEQ ID NO: 604367 - DNA, 548 bp, Homo sapiens
ctacagtcatgtatctctccactcttaacagcacgacagttgtcagcacagaagacttctgtgactgaatgtggggaatttctccccgcacaccaagcagtggacaccagctgggtgtcctttcagttctgacgccatctacctagagatagagtcagatcccacaggttgagggctcagtccccaagactgccccagtccccaccatgcatgagcctgggcctcctaaacttcagactgactggcttcaagttggggttcccacagccccctccttggattcaattaatgtgctggagcggctcccagaacttggggaagcacatttaccagtttattataaagcagcggtctgcagccttttcggcaccggggactggtttcatggaagacagtttttttcatagggggatggcttcgggatgaaactgttcccactcagatcatcaggcattagagtctcaggaggagcgtgcagcctccatccctcgcgtgtgccgttcacagtggggttcatgcttctgtgagaatcgtatgctgccgctgat

SEQ ID NO: 604368 - DNA, 156 bp, Homo sapiens
tagatctaacgcacttagctgatactgcacttaccagtattctcaatccttccagagctcagctgagactccagggttaccagaagaccagtcttacagctccttctctgtcagtgggacgtcatcagcaagcacgttggtgggtacgagctcgat

SEQ ID NO: 604369 - DNA, 355 bp, Homo sapiens
cggcggctggggaaggtggcgaaagagcgggtccacgcaacttggctgagacggaagcgaaggcgctggagccccccggagcggagccgggcgcggcttggcgcggcgctgcggcgggcgctgcggcggggccccgcgctcgcacctgagcgcctcgccctcactgcctcgcgccaggaagggccgccggcggcggagacgggcaggtcgtcctcgccgcgggccggcgggcagtggcgcggagcaagcttggtgcccgggagagccggccgcgcgggcccgctcacaggcggcgccgagccctcggccgcgggccctgcagtcctcccggcgcgtcacacggcaaagttgtctc

SEQ ID NO: 604370 - DNA, 859 bp, Homo sapiens
gcccaagtccagcagaggattgattacgccaacctgaccggaatctctgtcagcagcctgagcgacagtcttttgtgcttcatgtacagcgtgcggacaataagcaaaagggagatgtggtgctgcagaggtgaccacgtgattgatgacgctgaccaagacagccctcagtgccgaaaccgcgtgaacagcatcaacatcaaccagggcagcatcacgtttgcagtgggccccggccagggattggcaccacttgacttcacacccggctcggagtctgctcatcaccaaggccaagaacgggcaccttgctgtgggtcgccccacggctgaattctcggtgataaaggcgcccacatggacccttcccaacgcccaaatgcttttgcttttctcctcctccccttgcccagttaccaaagactcgaacttccagagagggacccagggacaccccgaagcccactcgcgaatctcccagctcctggccatccctctcttgagggagcacgcaggggccaggagctaccccaggagtgggccaggcgggcaccagtcaatacggaaagccaggccagagcgagccattgccaagcgctactgccgatgcccaactatatgagaagaacgggaactcttcgactgaggtctctctcctgaggctttgctgtgatggctttatagggacactaatttttaaagacaaggcattttcccagcccaaggtcacctgtgattgtgttttcccctgattcccgcggggcagggatgttgcccgagacagttgtgtggcggggcttgatgcccttcctggccggaacctctctctgtccctgtgctggtcctggtgtccctctcg

SEQ ID NO: 604371 - DNA, 109 bp, Homo sapiens
tctgagcatgtacactgaacagcaggctgttagcatgtactgtggctgtgcattaagatgttgctgagagattgcgaactcctgcagcatatttatactgcttccggat

SEQ ID NO: 604372 - DNA, 912 bp, Homo sapiens
  misc_feature (210)..(210): n is a, c, g, or t
ctgagcaccgctgcacctgctgtcatggtgggcctgcctcgtggccgccgtgtgggcctggggctgctgctgcctgctgcctgctgctgttgcttgctgcctgccgcagccctgccctggctgttggaccccgtggctgcagccctgtgcaacttttcttgctgacgcaggcctgtgggctgcagctcttctgctgcagagctacaactnccagctgcctgaacgaggtgctgttccagatgcgtggcctgccagctgggctgcacgacaccaacatcaccgctggagaatgcaatggctgccaggaggaagcagccctgctcagccagtgagtttgcggatggcctgggtgccataatggccaatggagctgtattgaacctgatcttggcagaacttcactggaccctgcagctgcgcagtgatcatcggagctgtgcgcaccctgggctctgccaacctgcccctggctaagcggcatgcatgtacaactgccctgctaagcaacatgagcaggatctactccacctggccaaggtctgcctccccaacaatgactgccacctgctggtccctggacccagatctcaccaacatcctggcttcctctgcgaagcatacgccatgctcctgtttgcctgggagggctgtgaccaacccgcttgcgtggcattccctgctgaaaccgctgtacggaggatctcactgccctcagcaattgaatgcctacaaagcagggacgggttcacaggacacagggggcctactggcgctcctggtacaaattccccaccttcgaggaacgatctggaacaactctaccaaagatagagccctctactgaacttcatgcctttcgtcgccgcgcaatgcatcgcgatacggagacgataacatcacctcatgggacca

SEQ ID NO: 604373 - DNA, 986 bp, Homo sapiens
gcgattcttctgtgaaggtactgcgtggtatgtgtgtatgtgtgtatgtgttgtgcgtgtgctctgtgccgagccctggtgtcccccgacatctgcgcccctgtccttcgcgtgcggttcccagtacggcaccctctctgagctggtctgtgctgcaccggcacgccctctggatggggggtcggggcctgtggtcgcgcctacagggctctccagtcacgcccactgagcgtagatcgcctactcgctggcctattcatggttcactgatggcgcgcacgcgtgtggtcggtgggacagtcctggatggttcgacatcagcgtccatgcttggctcagggcctgtggcagggtcctgtgtagagtcctagccccatagccccagccctcatgtcttgccgccttcctccatgtgtttgtacaactaactctggcaattccttttgtgaccctgagaaaggttattataaactgtggttatttatgcttcttctaagacatgagcgacttgcgtactatacaacagtaaacccgacaaagtttacgacaaaatcggaaccctttacaacggtagtatcaaagtaacgcgctgggcgtctctccctgttcgcgtgcggcgcaacaaaggggggaaagtcaaatgagggacgttggcccctccgtgtacacgaagccgagtggtccttggggaactagggggcagacaaggggacgcgggcctccctccagcgtgaccacaagaagaagcacatgaacgcgaggtaagacagcccagatgatagcgcccaaaaaacaagattataaaacttccctcacctggccatctcctgaagtacaacgtgacaccactggggtcaaagaagccaaggaagtaagcccaagtccactgggtgtatcccaagaactggcaacaatggtgtgtaactgctaataaaatcgttaagggcgaaatcacagcgaaaacccaggaaacgaccaacacaaac

SEQ ID NO: 604374 - DNA, 344 bp, Homo sapiens
tgtcgtcagaagtggtgtgagattactggcgtgagcattacgcctgctggccctctttgccttctcttacactacttcttcacctggaattccctttcctacctcattgccacattataacatttctctctttcattggcctagctccaagctgtctgtaagctgtctacttaataccgtaactggaacagatctttgcctctgaacttccctagactgttattgacgtccctgacttgaattttaattatgggggtacatttgttatctcctctgctgatctgtacatttttttaaatcaggaggtatttagttgaaaacaagaactaaattatcttctttcg

SEQ ID NO: 604375 - DNA, 145 bp, Homo sapiens
acagcgatgactttctgcaggtaccctcgcgctgttttgggtacccagcaattcattgccttgtttcttccccagggctggttcaggaacctgagccgacctgcgccagttgggctgtacccattggatcggtgcgttggcccca

SEQ ID NO: 604376 - DNA, 569 bp, Homo sapiens
gtcacgtgatcattgctgtttcttttttaactttttacttgtggtttattgtttcacggtacaccaggttgtccaagtccctgctgtactctttttgtgtaacgcacatgtgtctgggctgtggtctcgaagctcagttcctatgctccctcgttcgcctagtagctcaggatggtcgtctcgtctggttatagaggtgttgttccccgacctgaggtctgtcaggcggctcccctctcgccatccaatagggttcacctgcacacattgaatgtacaacgccactcaccactgtcgggtaaggcctccgtcgtcggcgcgctgcactcttgctgctgtcctgtccccgagcaccctgcaggtccgcctcctccgccgcctccgcactcaagagttagagcaggtcggctgcaggccttgggcccggagggtaaggccactgccggccacttggggcagacacagacacctcaaggatctgtgcacggaaggcgtcctttttccttgtagctacgttaggcctgcgtagctcccctcatctgtaacgctccaacctactaggtgtgcga

SEQ ID NO: 604377 - DNA, 164 bp, Homo sapiens
cctaggggatccttattacaatgcagaagcttctaataaagatttagagatggcacgacccatctgggagcaagtttgatgtcttaccagtttgatactcggtgctgagcaaagtggcacgtgtctatgttttgtcacatgtatttttaataaggatcccctag

SEQ ID NO: 604378 - DNA, 190 bp, Homo sapiens
aaggaaggggaagcccccctagttttcagtgtttgggactcttatgcaaaatcgaggcagttaactcttccaagaacaaaagcggcatgttgaaaaaaatttgggggattgggatgggggtatgtgtggatttttcctcccctaaatttgcaggaaacatgttgaacataaattcaaaaattttatccca

SEQ ID NO: 604379 - DNA, 156 bp, Homo sapiens
agctgggggcaaccgagaacggcctcaattcaagggaaagtccaggatggcaagctgcaaggcagcagtttagcagccaaagcccaggcctagtgatagacatggtccaacatgtgacccttctaggcgcatatcaccatggggcgtcatggctag

SEQ ID NO: 604380 - DNA, 101 bp, Homo sapiens
  misc_feature (27)..(27): n is a, c, g, or t
aatgtcaccgtcttgcctggaacttgngaacggcgcaacacggtggccttctcaaagacgtcccgggctcggagtcagtgtagaccagctccccgcccttg

SEQ ID NO: 604381 - DNA, 879 bp, Homo sapiens
tgtggtctataaggaggcatagttctggagcagatacagacaactgaagggatggtgttctgacaagaactgttccaggatacacttcattgtttcgtaaaatttaatgttgtgggctgggaccactgcagacacagacaaggacaaacccagcgtcatttctttccaacctggagcgcccactgccctctccgctggccgtcttcccagagttgtgacagccacatcggatgctgaagcaagatgcttttccaggtatcaaggttacaattgggcaagccctagttttagggggagatagatgttactggacctcacctggtacaagcatcaatccctcgaatgggtctcaactgaagtaacctttgccgttaagctcaccatgggttatggatccttggcagccaatggatgtattcgaagataagttttggcccagacatggaggtggaggaaccaaggatctggtgaccgaagccactcgcgagctggcgatcattgcacccagacactgggatccggaagcacacatatgaccatctagcgtccatcagcaaggacgagctggattttttccgccctatacacgagtgtcctcacacagcaagggggacccggcttgtgccggtactaggtgtcgagcaaacgggatctgacgtgctctgtcctcctgtagataatcacattcctattgcgagtattgaggatgcttggtaaaggaccacagtcccggacaactggacatcttcctgatatggcatcagtggcgtggactggtccgcggttttggtaagggtggtgagcattgaggtcccagtaacgacactcaagtggtagtgtttgccgatatgaactcaaatcaatgatcaaaaatacaaa

SEQ ID NO: 604382 - DNA, 193 bp, Homo sapiens
cctgctcgccttatattgtggtacgcccggcccgtctacatatgtggtttgtccattcggccatctccagccccgcacactaaccacagctctgtttggactgatgagaatatccttcttggagcctggagggcatcttcacacgggttcttcttgagtctcaggatcttgtgtgaggagcacaagcaggaag

SEQ ID NO: 604383 - DNA, 126 bp, Homo sapiens
actagagttccctcgatcgaggtctcttgcatattcctttgtggtgttctagagtcgtcagatgctttgggatgcatgtatgattgctagctctctcacacttactcactgtgaggataatatgca

SEQ ID NO: 604384 - DNA, 292 bp, Homo sapiens
ttgtatgtcgcacgacggagaggacccatctcgcactagcagtggtagacggagatgaaatccccatcaccaagatcggagcgatcagagcgttcagaacagatctcatcacagagagctcacggctccagagtcatctcatcatcagattctctctacagaatgattatgtaaagaaagccaagaagatcacacatctggtttcaatggacacgctaaacaggtctaggccgatcacaggtctaggactctccttacaaaatcaggaaaggaagtccagatcccagctcca

SEQ ID NO: 604385 - DNA, 791 bp, Homo sapiens
  misc_feature (585)..(586): n is a, c, g, or t
  misc_feature (604)..(604): n is a, c, g, or t
  misc_feature (610)..(611): n is a, c, g, or t
  misc_feature (618)..(618): n is a, c, g, or t
tgaaagtcatgagagtcgagcccaataagatgaagaagaaatggaaatctcaggcagcatccatgctgatacagaggctaaagcacgtggctgaagatgccgaccgtaaatatgaatgaggtgggcgcgctaacgtcctggctcatcatctgagagctgatctggaatagcgtgcagcagagagtcgggctgagctctcagataggcaagagtgtgccgagcttgaacgtagatgcacattgaagagactgtgacgaacaacttgtaacgtctactgtgaggctcaggctgagaagtaatctcgcagaaggaagacgggatctgaggccagagatcaaggtccttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcagttctcccaagactccctcgtcgagctggatgtcccacctctctgagctctgcatnngtctattctccagctgancctggnnctctctnttagcatcctggcttgagagccaggcacacactgtgagtttctattgtacagaagctcttcgttgcagtgtcaaataaacactgtgtaagctattctgtagtatctttaacttctatgatgggtttagttcaccttgatgaactaccagtggttccgaaaaaaggaaaaaatg

SEQ ID NO: 604386 - DNA, 669 bp, Homo sapiens
gggcggacgtgggtgagggcgcggccgtaagagagcgggacgcggggtgcccggcgcgtggtgggggtccccggcgcctgcccccacggcacccaagaaggcctggccatgggtaccctccgcggagccctggggtgtgtggtggcgctggtgcgccggcgccgcggatgggcccgggaccctccagcggccggagctggcgcctgtccccgcggccgctgtccctggttggcgcggcttgagctactgccggtgggccacttcctcaagcgacctgtgcgcgtccatgtggttcacctacctgctgctctacctgcactcggtgcgcgcctacagctcccgccggcgcggaggctgctgctgcttgctgggccaggtggccgagactggtgctgtgcacaccgctcgtggggctacgaggaccgaccgcgccgcaagctgtctgcgcccgctacggcccgcgcatagggcctgtctacctggtcggcaccgtctgatgtcctgtctgtccttccccttcatcttcagcccctgcctgggctgtggggcggccacgcccgagtgggctgccctcctctactacggcccgtacatcgtgatcttccagataggctgggcctccaacagatctcacactaagactcatcccggagctcgtaacgaagacca

SEQ ID NO: 604387 - DNA, 162 bp, Homo sapiens
tcgtcatagatgaatatgtgtccgtcacttttaattccaggtcatcgctgaagctaatcgttttttagtgatcgtatcggcctggcaattcatatgcacaggcgcggcgggggttaaaacgcgaaacaggacaatgaagagaatcactgccaaaaatccgat

SEQ ID NO: 604388 - DNA, 370 bp, Homo sapiens
caccgcctcgctgactttatctctcttccctgccccctgaattcatcttcccctcctgggcctgggcttccccatctctcttgctcctgcctgctgtgacagctaattgcaggatgcatttttctgcctcccatctccctatctgcatgtctccctacttcctttcagggtcattttttgattaaacctttatacttttattgagacaaagtcttgctctgacacccaggctaaagtgcagtggtgtgatcttggatcactgcaacctccgcctcccgggcccaagagattctcctgcttcagcctctcacgtaactgggacccaaggtgtgcaccaccgaacccggccaataactgaattattagcaaa

SEQ ID NO: 604389 - DNA, 522 bp, Homo sapiens
  misc_feature (367)..(367): n is a, c, g, or t
  misc_feature (448)..(448): n is a, c, g, or t
  misc_feature (511)..(511): n is a, c, g, or t
tcaacgctttatacttccagtctgtgagggaccccatatgtggtggtggtcccgtaagattataatggagctgaaatgttcccatggcctggtgacatcatagcgcagcccgttactcatgtgagtgtggttatgctggtgtaaacaaacctacagtgctgccagtcatatagaagcataggacaaacaattctgcacatacatagtatgtggtcatcgtaatacatgaatgtgttactggtttatggattcactatacagtgctttttattttagagcatactccttctactcagcaaaaaaatacttaattgtaaaacagcctcaggcacgtccttcaggagacattctagaagaaggcattgtngtcttaggagtaaaaacaacaacaaagaaaaaaaaacaggaaagcttatagaataaggatacaaagaaataaaatattttngtacagctgtgtaatatgtttgtgttttaagctaagtattattacccaagcttcaaaaagttnaccaaaattaa

SEQ ID NO: 604390 - DNA, 189 bp, Homo sapiens
ctcatctgatagaccataatgaaagatttctttcttcatgttttaggtacaaaacttagattaaggatagagagattaaggatagagattaaggatagagattaaggatagagagattaaggatagcgagattacggatagagggattaaggatagaaagattaaggatagagagattaaggatagaga

SEQ ID NO: 604391 - DNA, 775 bp, Homo sapiens
cggacgcgtggtcgacccacgcgtccgccacacaactctctacactatttctaggtaatgatagagcagatagattgattgttctgcatttcaacaagctcaagcttctcatacattactgcttcaaaacccctcggctttattgtgtgttgatttgcctcacagccaggctgcagcctgcgtaagcctgtcctatcttccagcatgtacctggagtcgcatctatagaaggctataacccatgaggcttagctccaaacgaaatctgacagatggatgctactcatgaggctgccattggcaagctctcctttgttcatgtgattgtagacacttattctcatttgctgaatgctacatgcaaaacagatcagagagcttggtcatgtacaatgggcattgtctggtcattttgcgtcataatggggttcctcgaaaaccttaaagaaagacaacacaaacaaaaaaacaagaacacagaaaacaaacaacacaacacaaacacaagaacaaaacaacaaacaagaaacaccaccacaacaacacaaccaaacaagacacaaaaaaaaacaacagaaaaaaaacagacgtgagaggggagcggggggacgcacggccgcagacaaaaaaaattctcctgccagcaggggcgaggcccccagtaagatcgactgagcgccggcccaccaccgcgagttacggttgagtgcgcaaaaaaaacgagcggggcaccccacaaccacctaggcacgacgacaggcacctattacaccag

SEQ ID NO: 604392 - DNA, 103 bp, Homo sapiens
ccactatcgcccaacacatcccccacccagcacatgaatatcatgaaagccaggaatccgaagagctgcatacacatgacatgccaagaaacagtgtgttggg

SEQ ID NO: 604393 - DNA, 679 bp, Homo sapiens
tggcacgagggggaacatggcggtgcgtgagccggggtccttgcgctccccaacagcggcgccggggtgcgcgggggcgccgtcgggcacagtcccggtgctcttctgtttctcagtcttcgacgcgaccctcgtcgtgtgccacacggggcgggctacgagctgctcatccagaatgttcctcatgcctgtacgtgcgaccagatcagacatgcacctgcaagattcgtggatgcagcatgattcgcctgatggaggtgggtgccaggatacgatggatcttgccccgaaggggcttcgcaggtgatgcgatgcagctgcaaggggtgcagccatcagtgcacgctgcatgatccatgcatcaactacccctgtgggacaatctttaccacgcttacaatgcacatgatgttattatactgcctgtgagtactgcacggaaacgggttcatgaaccaagccattcaacgtataatctggcgtgatacgcattaagctgtgtggaacatgagactttgtctgcgaaggtggccgcggagtattctagggaagttcgcgtgtcacttgtagagcacgtaacaacataccgctacaacggtctatggagacgcccgtgttcaagcacaattggatgttaacagggtgtaaacacctgggtactttccaagaggaacccagg

SEQ ID NO: 604394 - DNA, 313 bp, Homo sapiens
  misc_feature (13)..(13): n is a, c, g, or t
  misc_feature (65)..(65): n is a, c, g, or t
  misc_feature (67)..(67): n is a, c, g, or t
  misc_feature (74)..(74): n is a, c, g, or t
  misc_feature (78)..(78): n is a, c, g, or t
  misc_feature (92)..(92): n is a, c, g, or t
  misc_feature (110)..(110): n is a, c, g, or t
  misc_feature (118)..(118): n is a, c, g, or t
  misc_feature (143)..(143): n is a, c, g, or t
  misc_feature (147)..(148): n is a, c, g, or t
  misc_feature (152)..(152): n is a, c, g, or t
  misc_feature (155)..(156): n is a, c, g, or t
  misc_feature (194)..(196): n is a, c, g, or t
  misc_feature (222)..(222): n is a, c, g, or t
  misc_feature (225)..(225): n is a, c, g, or t
  misc_feature (251)..(251): n is a, c, g, or t
  misc_feature (272)..(272): n is a, c, g, or t
gggcgggcttggnggccttgccagctccggcggccttcttgtccactgctttggtggcccccacngnaactgtntgtntcttttcacggacngcaaagcggcccaaaggngggtggtntggggggctctcaacacacatgggnttgnngggngcnntttcaacaatggcggcatccccaggcttcaagattttnnngccttcttccggctttttaccagggnggnggtcaatcttttccttcagctcagcnaacttgcatgcgatgtgagcngtgtggcaatccaatacaggggcatagccggcgcttatttc

SEQ ID NO: 604395 - DNA, 509 bp, Homo sapiens
  misc_feature (49)..(49): n is a, c, g, or t
ccccagagcccaggccttgtctgtctgctccagggatgtctttccaccncaggccggtcacccccttggcttgctgacctccagctaatgtggcaaggggtcactgggagtgggtgattgtcaggtaagattgtgggagtgaaaaagtttggaaatgttagccattgtccttaattacaaatgatttcaggacaggaaccctgctgaactcgcttatttaacagacactgggaggtcctaccctgagccccacagcggtgctgagggctgcagtgcaggggccgggtctgaggcccagcccgggaggggcatggtctcgggaaatgcaagcagcgagctccaggggaggtcagaactggtgtttaagatggcttgaaggggccggacccagtggctcacgcctatagtcccagcaatttgggaggcctaggcaggcggatcacttgaggtcagagttcaagagcagcctggccaacatggtgaaaccctgtctctaataaaaaaatacc

SEQ ID NO: 604396 - DNA, 478 bp, Homo sapiens
taaagaaaactctaaaatatcagcaagcttgactcccaacttaaaattatgtgtgcaggaaggtatatcataagataagatctattgatgtcaggatggtaaagacagtgttatgaaacgtttgttacaatatcagggtttggatgttaggattgagaacctcagggttagataattccagaagccactcctggagctgtgggtagggataatcccacccaaactgcctggctgttttctggatggaaggggtggggtggtgctggggaggaaaccacaatgttggcagccaggaggaaacaaacttcactttccaagtttactgtacttctatattgtttgtgttatttgactattttacaatgactgttcattccttttgtaacaagcaagaccagtaaagctttttttattttaaaatctcctataaaatatagaaaacagataaacaaaataataaaaatcacctgtaatccta

SEQ ID NO: 604397 - DNA, 212 bp, Homo sapiens
taacggctttctgaccctttgaaacccatggcagagggggaacaagagttcacctggcccaaaaagtgtgccccattattttcaatcttccaacttgccagagtttgaccttgatgtttcgaggagttagtcctaattttaattgggagtattcctccaattagtgtaaatttcactcagttcagagattgtcccgctctccccctcatgtg

SEQ ID NO: 604398 - DNA, 1627 bp, Homo sapiens
  misc_feature (761)..(761): n is a, c, g, or t
ctctgcgcagcgcgcggagaggaggaggagcgagtcgatgtccgtgcgtcgaggcgtcaggagatgaataggcctggaggaaactgatggaagagggtgtggaggagaggatcaaattagagggaggagccttggaggacggtcgtactgttgaggccgacgtggaaacagagtggatactatcgaatgatagaacttcgtaatgatggacgagacgctgattgtaagagtagactattaggaagtgagcgcagggctagtgcgtgatagaggcgacgcgcgattgtcgactcgagagcgacagggcgacggatagtaggatgcgaagggctacccgggcaggccagtccgacaaatgtgaagtgacggtccgattccgcgatgcatctcgtcgcctgaggggcaagctcgtagcgtagtgaagggactaccaagcggagtcagcgtctgcaagaggtgcccggggactgtgggatagcttgtgaccagtgatgtgggtcattctcctggggtagaggcaccgtggcaccatgctttctcttgagttgatcatcctggcgatacttatggcgctatgccgggggtacatcaatatatcctgggggcgagggggtggaccggcgcgtggcggtataatctcatgggccggggtgcccctggaacgccgtgggttgcggtcggcggaacttacggccccacggggcgtcgtttccctgtctgcccttcctttgtatagtttggttgggacccacttgtgttgncgcaattaggggactggggctgcaagtgggagaggttggatcacttttgtagagtttggaggttccacaaggtggttgaacgcgaagaaaggctcataaggtatgagcgagaggaaaaaaggattattataggggaaggtattatgaagacctttactgcgtaatttaagttggcttttgtgcccaagagtggattattaatgcgtttccatttgcaaagggagtttgcaatcacttttgggaccggcttgaaactttggagttatattatgtagttttagtttgtggcaaaaaagagtggagcagttcggggaaaattatgtataagaaatatcactaaaatttatgatactggggaacatttatgtggctacagaggatacataaattaaaggaggcaaagaataggagagaaaaataaataagcaagaataagtggtgtgtgtgccgcaagtggatagtgatctaattgaggaggagatttaaaagggtaaattatcaggaaataataggtggtcaagaggagcgatgaagtaagatggaacaatatcacgcgcacacgtggagaatgtcagtaaaaaaatgtagtatattgaaaggaaagattgataaacagagagagatggaggagtgaaaaatagagagtgagaatgagggaatgaagacaaaaacaataaataagatggaggataaaaataatgatattaacagagaagagagattatatgaatgtactagtaagtgagtaatgatagggatgagaagaagggaggttagacgaggagagagaaagaagcgagagtaaggaatatagacgtagagaatagataagtgaggtatttattaacagtaaaattagaataaca

SEQ ID NO: 604399 - DNA, 626 bp, Homo sapiens
  misc_feature (117)..(117): n is a, c, g, or t
  misc_feature (119)..(119): n is a, c, g, or t
  misc_feature (121)..(121): n is a, c, g, or t
  misc_feature (124)..(126): n is a, c, g, or t
  misc_feature (128)..(129): n is a, c, g, or t
  misc_feature (132)..(133): n is a, c, g, or t
  misc_feature (137)..(137): n is a, c, g, or t
  misc_feature (139)..(140): n is a, c, g, or t
  misc_feature (150)..(150): n is a, c, g, or t
  misc_feature (153)..(153): n is a, c, g, or t
  misc_feature (169)..(169): n is a, c, g, or t
  misc_feature (174)..(174): n is a, c, g, or t
  misc_feature (176)..(176): n is a, c, g, or t
  misc_feature (181)..(181): n is a, c, g, or t
  misc_feature (183)..(183): n is a, c, g, or t
  misc_feature (192)..(192): n is a, c, g, or t
  misc_feature (230)..(230): n is a, c, g, or t
  misc_feature (352)..(352): n is a, c, g, or t
  misc_feature (364)..(364): n is a, c, g, or t
  misc_feature (372)..(372): n is a, c, g, or t
  misc_feature (377)..(377): n is a, c, g, or t
  misc_feature (382)..(382): n is a, c, g, or t
  misc_feature (384)..(384): n is a, c, g, or t
ggcaggccgcgtcgcctcacacgggaccacaagtagcttaggacctaagtagcggggcagatatgtggtcgagatactcccagacctgctctggcatgatgtgtgactgtttccagnanangannncnngcnnacancnncaggttcatnagngggggcaaggaaaaangggtngntcatntngggtatcanggagtctgatggaaagagataggcgcatctctggagtngatcgtactatgtgtcaaagggttggagaacattgattaaggaagcatttcctgattgaggtgaaaaaaataattcagttatggccatctacccctgctaggaaggggttacagggtattantgtagcaggcantgggttantgtanggttncnttaagttaaaacaccccgcccggggggggagggcaaaaaaacacaacttattgttgggggggccgcttcagccacagaaaaaaaagtttcttgaaaagacccaatctctcgttggggacagcgggggcacccacagaggtcacagagcaaaacggggacaccacagcgtttccccaagaaaagcccctggggacagagcaaagggcgtggtgtgctctccaccaaaaaaaaacgccggggga

SEQ ID NO: 604400 - DNA, 82 bp, Homo sapiens
tgtcaatcacatgagcggtaagggaccaagccaagactaggactaagccatctgattctagccctcatccgcttatccaatg

SEQ ID NO: 604401 - DNA, 410 bp, Homo sapiens
caaagatgctggccatagcaagttcgccggagcgggctccagcgcgttagcaagccaagaagccgcagtgaagctgtgttggtccgcatatatgtggtgcgaatggctcctttaccccagtgcagtgccatacttacactgggtactgctggtgtgtcacccgcggatgtgaagcccataagtggctcttctgtgcagaataataactcctgtatgttcaggttcagtcagccgagcaggccttgagccaggggtaactcaggaaggaaagatgacggggtctaagccgtgaccctacgatggagacccaaccggtgttcgatggagatgaaatcacagccccccactctatggattacacacttggtgatcaacggactccaaactgaacaacaccaacatacgacatt

SEQ ID NO: 604402 - DNA, 381 bp, Homo sapiens
tggaatattccacacctgaccttatgtaatgggttgtagtcaaaatgaaggcacacaacacacagtttcttcagcatcctcaagggaaaaaagaccctcccaggccccttcagctgtgatatttattttccacacatgcccagattcccccatgcaagcacaaccataaagggtcataaaatggcacatgtgtaggctgcacatgccaatggcaggttctccacgtgaaaagagagatttctatgaccattgttgatgaggcagatgactgcagaaaaatatttttaaaagccatccagcagaatgtttcctcatccacagaggacccacttactggtcccttaaccacttctgatgtttccttgcttgtcctgtcgcggg

SEQ ID NO: 604403 - DNA, 255 bp, Homo sapiens
ttcaggctagactgtcgaccaggttgacaggagctgggaacactctggaaaccttacttggatctagggaagagagcattcttatgtctctctatagcaacctctggccttttcagaagcagcactggcagaagtaaaacatgtatagcctctaattcaagaaaaatagtgtcactgtgtaccacattagtctgtcaaatatactctgcccctaccatccgcctacctatttcttcccttattatcacccaaata

SEQ ID NO: 604404 - DNA, 265 bp, Homo sapiens
ctgccctatcccctttgctaacgggggcccaatgccccttcagcacctcccaggttagctctgggggaggtgagggctgtatcccactctagggcaacaagggccattcaacaggagacctccatggtgtgccccgagggccccgaagaaagagttccagactcgctgctctgggacaggctgcgagagcggcaccgtttgccatcaacggatgctgcactgttcagagaggctgaacgagaccgggacaggccagtcatgcagg

SEQ ID NO: 604405 - DNA, 180 bp, Homo sapiens
gacccttcctgatagtgggcagctgtgttgttgccttctggagaatagcagagatacacgtgccatgatcagcacgaggggcatgccggaccccctcaccctgagatggaagctgtcttcccagcccaccatccccatcgtgggcatcgttgctggcctggccgtcttggctgtcctagc

SEQ ID NO: 604406 - DNA, 543 bp, Homo sapiens
gacgttcgatctagaggatcccgacgctcgtctctgttggggaagtgaatgacagaagcaacatgttcctgaagtttggggtggggctcaccgatgttgtccagtgcataatgatgatgatggttatgacctgaagcaggtgagagcttgtacatactggagagacgggaagagatctggggtagggttggaatgcaaaaccaacagcacttatgaatatgactagacacatggagtgaaggagacaggtagatggcaggtgccttaataagagataggacaacatcgagagcagcgagtgtggtcaagcatcaggatcttggactttatgtttagctttgccaatctctttgaaatatccaagatagacatagcagtggtgctcagaaattaggtctgaactgggtacaggagcgtgttaacatataggtcataatcaatgcaaggattggggatgggatagctaagggaaggagtataaggcacgggtcctcggctacgacgtggggaattattctgcccctcaggtgatatctgacaatg

SEQ ID NO: 604407 - DNA, 242 bp, Homo sapiens
tgatcgtcaaacgataccacttccattaccccctgcgggattcgtcctcatgcggtatgttctgaggttcttctgtttgtgtccacaaaatattatatgccatcctattaggcctgctgcacacgagtagcttcttctggacttccacaaagattgctcgattctcctcctgggggcttcatggccctggagccggcgcggccgcccgtcggcggtatccgggcacctggattcgcgaccga

SEQ ID NO: 604408 - DNA, 310 bp, Homo sapiens
gtcgacaacaaagttgattaagaaaggaagtataggctaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatctaactgggacaaaattagatatatgtgattatgttctaaggggcccccagttcaacacttatttggaatgtttgagaagagttggttaccgaaataaccgttcgtgagggccaaaaaggaattgtgt

SEQ ID NO: 604409 - DNA, 399 bp, Homo sapiens
gcctcacatttgacggccacgcacagcagaatctggatttgtggtgagtcgttcctccgaaggcagcacgcagtcgtgacctggaattgcaaggccatcttcttggaagctgctgcctgccccagaataacgatggtcgtccatctggctcatgggtcttgagtggctccagttgggttgctgagggatgaagactggatgtgaaagaaatggattcaagctaccagaggagcagctccagggcaaggcagcagggataggcctcctctcgtcactctcacggtcagctttctcgtcgcgtcatgtctgtgggcatgcttgttgcccaccacttataaaataagaatatatagaaggagatagaatggatataaccagaaaactatagagaaacataaa

SEQ ID NO: 604410 - DNA, 132 bp, Homo sapiens
aaaaaaattagattttttttttaccaagggtctccatattaaaaaaattttcagcccttttaaggcccattaaaggacaaagtaaaaaaatttttgttttcaagggcaaaaaaatgttttttttcccttgga

SEQ ID NO: 604411 - DNA, 335 bp, Homo sapiens
ggacctgcatcagacaacagcactaattctagaacattttcatcaccctcaaaagaaagtccataaccattagtggccactccctatttcctgtgtctccaagtcttaaacaccaatctactttctgactggatttttctattctggacatttcatgtaaattgaattataaaatatgtgacctttgtgacaggcatctttgacctagcatgttttcaaagttcatccatgttgtagcatgtcactacaacttcattcctttttatggctgaatattccattgtatcaatatatactgcattttgtttatccattcatcagctgatggacatttg

SEQ ID NO: 604412 - DNA, 174 bp, Homo sapiens
cctaggatccttattatcccaacacattaaaatacaaaatagcggtgtggtgtggcgctgtatccagctacttggaggctgaggaggagatcactcgaactggaggcggaggtttgagtgagctgagatttcttcactgcactcagcctggtacagagcgagactcatctcaag

SEQ ID NO: 604413 - DNA, 186 bp, Homo sapiens
agattcttgatgatcaatgcacggccgtggggctcatggatcttacctcgtaaccgatcaccaaaatgtgcaagaacaatgcaccagtttgtgaaccatttccatgtcctctacgaccgagtaggcatcggcaggagaatgcgcgggctcttttactgatgagggtacttgaagggctgatggaca

SEQ ID NO: 604414 - DNA, 935 bp, Homo sapiens
gtcagccaccaattgtctcacagtccaggtggggtggcctcaagccaggtcattctccgcagtgtggtgtggtgttcttatcctcagaaagagagctgaagggaatggagtcagtgaagcaaggaagcagacattctgtttctgccacacaagaatcgatcccttttttggagcgtgctgtggaggacagggaacacgctaacctgggtctgcagaggtgagggagccactaggtggcgctctggcttcacatttctctagacttctccctcctgcccctggtcaccacccacaccccagacaccctacccattgactagctctcaagaattcccagaatccccctggttattcttcaggaacgccccgccccctcagttcaaacctctacgccattggtagcacactgggcttctagctctggaactctcccaggactctagggggcagtgaccacacaggtcaggtcaattaaggaggggattaaggactgtaagcttactggcaatggtgatgcacgcctttaatcccagcctttgggaggcagaggcaggctgatttctgagtttgaggtcagcctgatctacaaaagtgagttccaggatagccagggaaacaaaacaggactgtaggctctagaaagtgctggaatcgattttgaattatttagcaatgcttttatgtcacttgttaacaggctttaagtgccagggcttgttaattccgtgctagacaagacaggtgaaagggtggctccattccccaatgttaaaccgtcggcggtggggctggagggatggtcaccgctgaggacaaggcgttttcagaaacccggttgattcccgacgccatgggcccaaatgtggcgactcagtccgggggagttccttggctggggacggacaacccggcaatacacaaaagacccctttgaa

SEQ ID NO: 604415 - DNA, 219 bp, Homo sapiens
gacacgatgtgagtattcagcttgtatcccaggaatggctgtaaggtggaccgacttgtgatgatcatccgtagaggtagctcttcaggttccctacgatgcctgctagctgctgcttccgagtgtaggaatgcctgaggaacccatgtctgggcatcggagaactttctcgtgagacatcaggccatcaaatcccgaccgttatagccgatctgggga

SEQ ID NO: 604416 - DNA, 151 bp, Homo sapiens
gcactcctccgtaatcagtgagagaccgcagcttactctctgtgttttgccaccagtattgttttcccccggccccctacctctgaagccatttatgatctgtcatgtgccacctgagcctccagtaaacaaacagcttcctgtgaaaaaa

SEQ ID NO: 604417 - DNA, 746 bp, Homo sapiens
gtttgtatagtgtggattatttaaagcttgatctgttcaccctcctgccaggaaaatcccagaatagcttaagtgataccccaaaatgattacatcccaggtaggaaaaaagggagcgctttctagaggtcagaatcgtggagagaatactcagaaatgaaccttctttatagagcctatgctagcgagatgagtctactcttacttaatggaaatgttaaagccacattgaaaaagcatgctgtgatgcccaggttccctttccacagggtgctatgcgtctcctgtctggtgaatcacatgcggctgagtaggcaactggctccatcgagcctggggatgctgcctgtaccgaagatggaataggaatgcatgcacaaaatgcctttacgttgttctaaacccccgacgcataaagtgtagaggagggatggccaagggtgggtggtagaaagtgtgttcaggctgacactggcaatgagtaccagataatttcactttcctcttccaggggcaaaggctgatggcctctacctttgtatccaggagaaactgcagagcagccctgtgactttacaaaatatgctacctcaaagtggtaccgataaacctttctaactgtatgtgcccttactaatgggcacatgtcttaatcaaagttagaattggtatcctggatttgtataaatataaaggaatattgatgaatgacgatcttacctatttaagtatatacatgggaataa

SEQ ID NO: 604418 - DNA, 110 bp, Homo sapiens
cccttaactacaaccctttttacttttggtagaaaatcataaggcatgagttgtcaaggagcacactttgggaaatgtggttcgactagccttactagagctcgcaaggg

SEQ ID NO: 604419 - DNA, 790 bp, Homo sapiens
tgttatagaccagagggttttgcgcccgtggtgcggccggggttagtcggcggacaaaaatgtggcgcccgcggggatgtttttcgtcgcccactatcgcgcccgcggggcgcgtatcttttccgctgcgtcccccgaattttgtgtctgccgttcccctccacgcgagggggtggtttgtactcggtccgcctgtagatagccctgcgcgcggccacactctgtctcgcgcgtaaagacagactgtggcgtgagctacgttcgcgccgccacgccgcccacataagtgggcgtcgcccgctcgcgctccacacgatggcggccagcacaagggtcttcttgtaaggaagtacgacgccccccgcgctgagagaatcgcgagcgtgcattgtatgcgcacagcacgcgtatacgccacgcaagtgtgggtttacatatggggggggggcgccacagacccatatccgcgcgcggttctcgcgtgcggaaaaaagtagggtgtttgacgcccatcccacataaggacgcagcgtgcttggccgtatacgggggcgtccgatgtgaagccgccgggtttgtggccctgcttcgcgtaacgattgttatacgacgagatggcgggtcggtgtaaaaagaagtcacccacgcatgttgtatcgcgtggggggcccacacaataaagacaagaaggcgctccaggccgtgcccctgatgtgtacgtgtcacccatttctttgcggtgagccccaattcagctgctggggggtttcttgccgcccaacatggtcaa

SEQ ID NO: 604420 - DNA, 176 bp, Homo sapiens
  misc_feature (167)..(167): n is a, c, g, or t
aaaaagaatgccctatacagaagactatctatcgtggtcctgaaccagttatgtgtgttgcatgagaaaacgccagtaagtgacagagtcacaaatgctgcacagaatccttgtgaacaggcgaccatctttcagcctggagtcgataacatactccaagagttatntgaacatca

SEQ ID NO: 604421 - DNA, 412 bp, Homo sapiens
  misc_feature (333)..(333): n is a, c, g, or t
  misc_feature (359)..(359): n is a, c, g, or t
  misc_feature (372)..(372): n is a, c, g, or t
  misc_feature (400)..(400): n is a, c, g, or t
  misc_feature (411)..(411): n is a, c, g, or t
aggataatcgcttcaggccaggagttcaaggccctggacaacatagcaaggccccatctgtacaagaaataaaaaagagtagtcaggtgtggtggcatgtgtctgcagtcctagctacccaggaggctgaggcggaagaatcgcttgagcccaggagtttgaggcttcagtgaactgtgatggcaccactgcattgcagcctgtgtgacagggcaagacctcgtctcttaaaaaagagtcggccaggtgcagcgactcacgcctgtaatcccagcactttgggaggccaaggcgggtggattcacctggaggttcaggagtttgagaccagcnggaccaacatggtggaaacccctgtntattaaaaatacnaaaaattagacgggtgtgatgatgctgnctgtaatcctnt

SEQ ID NO: 604422 - DNA, 876 bp, Homo sapiens
gagtcaccatggacgctgaaggcctggcgctgttgctgccgcccgtctaccctgggcagccctggtggacaggtggctccgagaggatctgttccagggctcaattattgcatgtccgttggtcaggcggggcaggccccattgcatgcgtgggctgttgtgccaaatcctccttggggttgacctggcgaggggcatggactttccttccgaatgccgagtatttagcccctagactcatatctgccatacgtcttcctgtgttcgctcccgcgacggcgatcggaacgctgtgtgccgccggtgcggcgagagcgtggccggatggtcgcggggtccttgacctcactgccgtgtctggctggcgggacaccggcgtgtggcgctgcgaaggcagaggctgagtccgctgcgtggtgtgcccctttgcccagttgtctgacagcgcgcgttccgcccccgtggacgtggcccgacctggtggggcgcccggcgtgagcactgggagcatccggtggctacggcatcgcaggaaagacgcgacgcctagggattccggggtatgcgtggtgcaagtagtgggcttcgctggtgggcaagggtcggccttctccaccgctcaggaactgggaagggctaggtgatggtgaaggatgactcattgttcggtggccctgctggttggggtggagtcccctgtcggttgcctgtcggccgagggatcggctgggtggggggcagcgtctggtggggcagtggcgttgaatgccccgttgcggtgggctttgttggcagtttgctgctggtgccgcttgtcttgggtcttgggtcgggccggggagctgcccccgggccccgtgctgcggccgccccctg

SEQ ID NO: 604423 - DNA, 858 bp, Homo sapiens
  misc_feature (181)..(181): n is a, c, g, or t
  misc_feature (228)..(229): n is a, c, g, or t
  misc_feature (246)..(246): n is a, c, g, or t
  misc_feature (261)..(261): n is a, c, g, or t
  misc_feature (455)..(455): n is a, c, g, or t
  misc_feature (480)..(480): n is a, c, g, or t
  misc_feature (494)..(495): n is a, c, g, or t
  misc_feature (513)..(513): n is a, c, g, or t
  misc_feature (521)..(521): n is a, c, g, or t
  misc_feature (530)..(530): n is a, c, g, or t
  misc_feature (534)..(534): n is a, c, g, or t
  misc_feature (545)..(546): n is a, c, g, or t
  misc_feature (562)..(562): n is a, c, g, or t
  misc_feature (568)..(568): n is a, c, g, or t
  misc_feature (582)..(582): n is a, c, g, or t
  misc_feature (587)..(587): n is a, c, g, or t
  misc_feature (604)..(604): n is a, c, g, or t
  misc_feature (620)..(620): n is a, c, g, or t
  misc_feature (644)..(644): n is a, c, g, or t
  misc_feature (660)..(660): n is a, c, g, or t
  misc_feature (665)..(665): n is a, c, g, or t
  misc_feature (670)..(670): n is a, c, g, or t
  misc_feature (688)..(688): n is a, c, g, or t
  misc_feature (694)..(694): n is a, c, g, or t
  misc_feature (697)..(697): n is a, c, g, or t
  misc_feature (699)..(699): n is a, c, g, or t
  misc_feature (701)..(701): n is a, c, g, or t
  misc_feature (704)..(704): n is a, c, g, or t
  misc_feature (708)..(708): n is a, c, g, or t
  misc_feature (719)..(719): n is a, c, g, or t
  misc_feature (721)..(721): n is a, c, g, or t
  misc_feature (731)..(731): n is a, c, g, or t
  misc_feature (743)..(743): n is a, c, g, or t
  misc_feature (754)..(754): n is a, c, g, or t
  misc_feature (786)..(787): n is a, c, g, or t
  misc_feature (797)..(797): n is a, c, g, or t
  misc_feature (808)..(808): n is a, c, g, or t
gggctgggcttgctgaggtagaggcagcgccaagaagaggcctttgccgctggtcgggattgggatgtcgaagaacacagtgtcgtcggcccgcttccggaagtggacgtggatgaatatgacgagaacaagttcgtggacgaagaagatgggggcgacggcaggccggcccgacgagggngggtggactcctgcctgcgcaaaaacatgacagctgccctacaggcnncttgaagaacccccctntcaacaccaagagtnaggcagtgaaggaccgggcaggcagcattgtcttgaaggtgctcatctcttttacagctaatgatatagaaaaggcaagttcaatctctggacaagaatggtgtggatctcctaatgaagtatatttataaaggatttgagagcccgtctgacaataagcagtgctatgttactgcaatggcatgaaaaggcanttgctgctggcagaatagggtccantgttcgtgtcttgnntgccaaaaaaactgtgtnatctggcnggcaatggnttcnctgcctcgggnntggggaatgctggtanaaaaancaaaaaaaacaaangccancgctgccctgtgggtancatctgtttctctcanctttgccttcttgctttttcaaanctgtaaaaaaaaaaantaaanatcanttgtcctttaatgaaaantggganaanananaanaaantgtgttaaaananaagtgtttcntcctttcaaaancatttccgtgntgtttataccaatctgtatatagtataatttnnattcaagttnaattgtgcacntttaaaccctgttggctggttttttgttctgttttgttttgtattatttt

SEQ ID NO: 604424 - DNA, 299 bp, Homo sapiens
cccacgaagtgtagtgtgtggaactagactgcggagccaagccagaagattcggggtgaataacaagttgtggtgcttgccttgaagccttgtttcttcgtatttgggtagttgctaacaagacaaacaggtcccagcaattctcaaacgttattgctaaggactaagggacaagcttgctgctaacttcctgaggcttgtaaacagtaatctgccaaaaataagtaagtaaaagaacaagaactaaagacataaacactaagaatagtacccaaccgcccttggcacttcgtgggcag

SEQ ID NO: 604425 - DNA, 206 bp, Homo sapiens
  misc_feature (17)..(18): n is a, c, g, or t
gtgtcatttcagaatcnnggcaatcaactagcttatcttcatgtcctgggattaacgttcctcacatagggcagtcctataagctcccagtacagaagtaacacaattccccttgacactcactttttaaaaccttttggaaaattcttcatctttattaataaagcttgagattttggatcagttcacatagggtaccgagctcg

SEQ ID NO: 604426 - DNA, 396 bp, Homo sapiens
gagagagagatgttgtgaacccatgcgcatgtgttctcgggcccctgagtgtggtggggggtctcagtcacatatatatgggtcttttgtgtgcgctgtgttctccacacactgtgaatcttgtgggggttatctcgtggagactgtgagcatatgtcacaatatatatgtgccccgcaaatatcttcacacacaaccctgtcacgaggatccctatactgaggttgtgagtgtcattctcccccgtggggaaacacatgtggcgcgggagccgagagatggggaaaacccaaccctgacaaaacccctgtcctgtgtgacacaaggtgccgctgtctccacaaagttcttttgtgtgacgcactgtggggcacagcgcaaccccacatctcgcga

SEQ ID NO: 604427 - DNA, 201 bp, Homo sapiens
cctggcgctgagaagtctcatttaacaaacacccaacacgcttgttaattccaagtgtgctgtctattgcgcttagctgctctgtgaggtggagagggtggatggtgtggagataaatgagcctggatgccagtgtcatactggaccgtggcactgtcacctatcctgtggagtgtctaacaccctgacagaagggaaata

SEQ ID NO: 604428 - DNA, 314 bp, Homo sapiens
ataaagtcacgtcctttgcaggaacgtggatgcagctagaagccattcttgtaagcaaaccaaagcagaaagagaaaagcaaatattgcatgttcttatttataagtggtagctaaatcttgggtttacacagacatagatgggaataatagacatgggagactctgaaagggaagggaccatggctgaaaaacttcctattgggtactatgttctctacctggggtgtggtatcaacaaaagcccaaagctcagcaccatgcaatatacccttgtaacaaatctggtcatgtaccttctgaatctaaagtaaa

SEQ ID NO: 604429 - DNA, 359 bp, Homo sapiens
acaactagttaatttttagtaagataggattctcatagtttcccagtctagtcttagaatcctaggtcaagtagatctcctacttggctccaaagtagtaggctcccaaagtagtgggattacagccatgagtcatagtgccagcctttattttcatcttaatttcttagtcaaccgcaggaggtcattccggagcatgtttccccgtcaacccagccatgtattcgtagaattcttcttagtattaatttaagttatatttgaggtagagtctcgcggtttcaccccagataggagtacagtgatagcagatctcagctccctgtagccttagacctctctgggctcacgtgatttat

SEQ ID NO: 604430 - DNA, 108 bp, Homo sapiens
agctggtcctacttttcacagtgtaaaaaaatgagaccccaatagaagctgatgttgggaagagtaagcccatgagggtggtggatgggtaaaaacatcaactgtaag

SEQ ID NO: 604431 - DNA, 203 bp, Homo sapiens
ataggatcccgattgtcagcatcatgtcaaacagtgacttcaatctgagtgaacacctcggagtgcaggaggtatgcctgtgagttcacacttgccaattcaggttgtaatcctattgtacatggcactgctcgccattcataaaccgtgaataagcacaccatggctggttgtcagaatacgtgtagtgacggtctagtgtc

SEQ ID NO: 604432 - DNA, 909 bp, Homo sapiens
gaggatgcgtacacttacagcctgaggtccagagcttgttatacttatactcataatcacatggctcccaaaaagaggtctggtcatcctggctagaggagcagaggcaatggtgacggtcatccatgtcagaatgtcattagtaggcgctgagtgggtgttaaggtccctcgatgacgaggggctggggtggataaatgggccagtcacatgcgtagccgatgaatgtggctctattcgctacttgatgaccaacacctggaaagatgtcacaaaccctgtagggcaccatattgagtgtggtgtgtgctaccagtgaggtaatttgtgcagcacagtaagccatcgtggcagtctgcttgatgtgcatagggaagtatactgaaggcacgcacggaaataactgcgacagtgacattgataagccggccactctagtgcatggtccatacatgaactcgttcgcgctctatgacattagcgttctggggaccagtacctggtgtaccataatgactctatttggatgcaaatcagctagtctgcattgaattgcgcaggtcattaagatgttactacttgaggaagttgagtcgtgtaacggacgggatgaatacttcacaagaccggagggaacttggatgccagtatcacaatagttgcagcttgagttcggtgagacagctcactgaggtggcactggagagtggctggctcaaagatgcatcaggtcccaactctggttgtgaatatgaataggacacatgggaaagtgggacgtattactaaggagaaaatagggcagtaagggaatccattattccatggatttggggctcgtagacaaacacgagagggagggtaacaggtggccagcaacagcgcacgtcgttacacaatgtgggagga

SEQ ID NO: 604433 - DNA, 217 bp, Homo sapiens
  misc_feature (80)..(80): n is a, c, g, or t
  misc_feature (200)..(200): n is a, c, g, or t
  misc_feature (216)..(216): n is a, c, g, or t
aatgagttctttaatcatacttaagtgctatactgttttagtgtggtattttgtcttgatcctgttttttttttttattngagagagaatcttgctgtgtttcccagcattgagtgtaatggcggcatctcggctcattgcaagctccgcctcccgggttcatgccatttcgtgcctcatcctcccgtactacctgggantgttggcgcgtgccanc

SEQ ID NO: 604434 - DNA, 392 bp, Homo sapiens
ttcagcgtgtgtctgtgaacgcaagggtcccagcaacagtgcgggtttgcgctcggccctgcccgtgggtgcagggacgtgtgggtgtgtgggcatgtgtgggtgtgttggggagggtgcccagcgacatgtgacaaagacgcccgtctccgggagatggtgaaggggcccgcgagcaggcgctttgtctggctgtctgcagagtgaggttcgcgccgcggcggcgggcgcccgtgcggtgcaggatgccggggcgccaggatggccgggggcgcgcgcgcctgtgccagggtgagtgcgctgcggcagcgccgggggacagcgcggagggcccgcgccggcccgggcctcgggcgtgactgggcgccacccgtgggcgctgcagcggccgc

SEQ ID NO: 604435 - DNA, 347 bp, Homo sapiens
ttcagcgtgtgtctgtgaacgcaagggtcccagcaacagtgcgggtttgcgctcggccctgcccgtgggtgcagggacgtgtgggtgtgtgggcatgtgtgggtgtgttggggagggtgcccagcgacatgtgacaaagacgcccgtctccgggagatggtgaaggggcccgcgagcaggcgctttgtctggctgtctgcagagtgaggttcgcgccgcggcggcgggcgcccgtgcggtgcaggatgccggggcgccaggatggccgggggcgcgcgcgcctgtgccaggggcgctcaccatggccccgccgctcctgctgctgctgctggccagtggagcggccg

SEQ ID NO: 604436 - DNA, 315 bp, Homo sapiens
  misc_feature (62)..(62): n is a, c, g, or t
aaacagccaggggggactatcctctggaggctgtgcgcatgcagcacctgattgcccgtgangcagaggctgtcatctaccacttgcaattatttgaggaactccgtcgcctggtgcccattaccagcgaccccacagaagtcaccgccgttggtgacgtggaggcctccttcatgtgctgtagtggtgccataatcgccctcaacaagtctgggaggtctgatcatcaggtggacagattccgcccacgttccccccatcattgctgtgcaccctttaatccccaagacagctcgattaggttctacctctacc

SEQ ID NO: 604437 - DNA, 158 bp, Homo sapiens
ttaaaagccttttttttttccgggggagggttttttttaaaaaaaaacctatttccccgggaaaggccggggaattttttccccccaaagaaaagggaccttttgttttttaagaaaccaaaatgggcccctttttaaaaaaaaattttcccttttta

SEQ ID NO: 604438 - DNA, 361 bp, Homo sapiens
  misc_feature (229)..(229): n is a, c, g, or t
ctcgggttcttcataacgaaaccgccagaggtgcaacttgagtcagtatttgcccaatatttataccctcgatatgtgtgaaccttaaacagggtatcaaagacacttcgaggcgcccggtgtcgagagcatgcccatgtctgtgtacgccttcaccggcttctggtctgacgtgtcaacctggtgtgaagtggagtccgaggtcatgaagagtgactatgagagcggngaccacgggcacttcgaagagaggacgataccggccctggatttccagcagcacccggaagtctgactcttaacttcccccgtgcctgactttagagcctagaggtgatgtgagtgatcgcgctgttctttg

SEQ ID NO: 604439 - DNA, 1269 bp, Homo sapiens
ccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 604440 - DNA, 793 bp, Homo sapiens
gtacatatgaatcgcacgcatagccttgctttctaacagcactccccaggcctatgggagtatattttgaaaagctactatactttctgagtctccatttttgtgtgttatcagagaacacgatatttgcgtctggtcactccatgcactggtagtcaagcaggcagcgattaaggctcgacgtgcagccttaatgctccgtggctgctcaagcgaccctcctaccgtcttagcctctctgagtagctaggactacaggctgtgccccacatgcactccgactgaattcttgtcaatttgttagtagagaccaggtcttgccacgttgcctaggctgatcttgaactcatgggatcaagcaatcttctatgccttggtctcccaaagtgcttggattacagaatgtgagccaacacatcctagccagtcatgtttcctatttcgtctcagtctgaatccttcgtatcggctttctctatacataacctttgaaactcctatggaataatcagaaatgtcttattcctgacactgcgccaatgtgaaagacacgtaggataatacacaagatgtgttcaaaggacatctgtcattgtagagtaagcagaatatggagtagcaaattaatgctgaagtccagtccaacactgaaccacatcattctttgattccttcatttctatccatagtacacaagtcatctatctagagcctccactgcatgccaggtcctgttctgggctctggataaagcacagggaggataatagcaaaggctttgttctcacgggta

SEQ ID NO: 604441 - DNA, 618 bp, Homo sapiens
ctcgtgccgaattcggcacgagtaacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 604442 - DNA, 241 bp, Homo sapiens
ccccctgggaaaacccccccggggttgggggcccctatccacagggggggcccccttttttacaaagggggccccccccctttaatgccccagggccccgggggggacttgcccccttgttggggattgggttttttggaaaagccggggccccccaggggggggaaaaaacccccttttggcccccgggggggggggggggggttttttttttttttttttggggaaaaaccccccttta

SEQ ID NO: 604443 - DNA, 724 bp, Homo sapiens
agcggtgccgtgcaagccatgcgtgctctagcgagaatctgactggccggtcgttttaacaacctgccttggccagcctgcgagcgcgtggtacgaaggcgcgtctgcatccatgccccagcccggagagctggaggcgctcgcagtcagagtgcgagtgatgctaggctgagcagctgtggcggcccgtgtcgtgcccctgctgagccaagtgcggaagggcagcggcgcgctccgacatctgctctgccgcacgcagtggcgtgggctgcgggcatggggggcggtggggcctggccgcccgcatgggaagctgcggacgaagccatggcgccgcctgaggaaccccgaggggcagggaacaccgaggatataaaggcacaatgggctatagctcaacagtgtgtgaaacgcacgaaatagaggcccactaccagtaagaggcgcaaagcaacgctgctacactatccagaaaaggcctccccgtatagggcgcgcccagaagacgcgacgagaaagggcggagcgacgagcctgagtgtcaggacgcgacgaaagcaacgaggatcccttttctagtcgccgggataccaagttacgggcggcgagaacaacagcactcaagacttcgctgcgggggcaagcccagggagaccgagcgtactgaaggtcattagcactccatagttgtcaattctccgtgtggagtgcatgttagggatag

SEQ ID NO: 604444 - DNA, 609 bp, Homo sapiens
caacttctatatatcccctccccacatctttcccagtctctggctaatttttgtattattatttttagtagagacaggtttcatcatgttgaccaggctgggcttgaactcctgggctcaggttttctggctggctcaagcttccaaaatgctgggattaccggcatgaagcaatgggcctgggcctggttctttatacttcttgtctttgccaagattatttcttttctgaggctttctacagtttcatttgcttgaagtgtgtttgcagttgctcactgaagcattttttttttccagggttgctttaaatttatggtccaatcagtctaacatctctggatctcagtattggcatctggtgatggttatttttcatttagttggagttctccctggttggttgttatgaccaatgattttcaattaaaatctgaacatttttccattatatgaagagactctgaatcttaattaaataagatccttctgttttggctggcttttttgggataccattctggcaggggaaggggctgcatcctcattatggccagatggagctagaagtccagattccacacttgtcctccacggaccacctggaga

SEQ ID NO: 604445 - DNA, 148 bp, Homo sapiens
atctatacgccaggcatccatacttgaacattctaggtgttgtctgatacagaaagataaacagatagtgccttttatgagcacaaaaaagagttgctgtagctattaactttataatccattttttttcagattaaactaattgtga

SEQ ID NO: 604446 - DNA, 127 bp, Homo sapiens
cgttcgagctcggacccagctccgacacctcactgcggctgctctgtaccagttcgctgttggaggccacttctttgttcagctcctcggtcttgctcaggaaccaggtctcagcgtctctgcggtt

SEQ ID NO: 604447 - DNA, 203 bp, Homo sapiens
gttggtgtagcccatgtactcctcaccccagcccatcttctcccgcttcttgcgctccttggcctcgctcttggccgtgccccgtgcgcgcttctcctcgggcgtctcgaaggccttcatcagctcctcctgctcgttccgctcctcccgcagtcgcagccgctcctgcaggtctgctgctggctcaggagcagccgcggtcc

SEQ ID NO: 604448 - DNA, 300 bp, Homo sapiens
cccccaaataaaacttttttttttatccatataaatatataaaacccaaaccagactggatatccccccactaatttttgatagtagttccctctactggattagggaatccagcataagggattttaaatttatctgtgatgtttcttgtcccttaaaccatatggcaaaaaatgttaatatttatttccttggaatggaggattatttttttgaaatggaggatatgtatgtgggggtttattttctttttttttcctatattaaattttgttttcaataaataaaattgctacctta

SEQ ID NO: 604449 - DNA, 496 bp, Homo sapiens
tcctttttagctgcagactcccaaatcttttttatggggggaaatggccctcttgggggtccaactgcacggattgttcattggcactgcttcccgagacctggggcttaataacatcgggcagctctggcgggctggaaaacggatcgatgcacagggcctcaaaggtgtcatttgcccggaaggcccgtgtactagtgtactgcttaatgaaacctattcacagtcaagatgggtatatttagaaaaagcctatggtccatgagaactgtgagataaatatcaaactactacccttacaggcttccaaaaaaattctatgagcctcaggaaagcataagccattgggggtttgtttcaggtaagctctacagcagaatctggaccagaaatactatttcacattatatattgaaaaaaaattcgggctgcaaattgcattcaacgtaacactttaaactgttccatatttgagggcagagtttatacatattaa

SEQ ID NO: 604450 - DNA, 181 bp, Homo sapiens
ctcagtctcaaaaaacaaaacaaaaaacctgttggtatagtacgaaagacacgtcttgcagttttctgttgcagagaattaattaggcaccaacctgttggattatacacattcacctttcaggattctttcttctctgttggaacccacactctcagacagtttgttggcacacacgatg

SEQ ID NO: 604451 - DNA, 524 bp, Homo sapiens
tttggttgttttgtttttttgacccgagcttttgactgcctttttgagacagggtccctaggttggagtgcactggtatgatctcagcttagtgaaacctctgcctcccaaggtcaagcgatcctcttggccttctgagtggctgggactacaggcatgtgccaccatgcccatggggtatttttgtatttttggtagagatggcatctcactatgctgccctggctaatcttgaattcccgagctcaaatgatcctcccaccttaccatgccaaagtgctaggattacaggcatgagccaccatgcctagcccatatgtttctaatacttgaagagggcatttgaaggccccagtggcgttcagtacagtttcagtgcttgtttatccccagagggagcgcaggagcttcaaaatagtgggatgtgttaggtgcattgggaacttgtttcgactggataaattttagaacttttaaaggacttgggttttaattttatggccctttggaagggtttattttgg

SEQ ID NO: 604452 - DNA, 270 bp, Homo sapiens
ttttttttttaagagacagggtctgtcacccaggctgaatgcactggtgtgaccttgactcactgcagcctaaaccccctgggctcaagtgatcctcccatttcagtctcctgtggtcccaactacttaggaggctggggtgggaggattgcgggaccccagggaagccgaggctgcagtgagccgtgatggcatcactgcactccagcctggatgacagaacgagactggatctcaaaatatagataaatttaaaacccaaccccccca

SEQ ID NO: 604453 - DNA, 137 bp, Homo sapiens
gatcatatgtgttgtgtgtgtgtgtggtgtgtgtcatgtgtaattgctgtgagtgcgtgtggtgacagtgtgtcactcgactgtggtgtgtgcacgcatgtgtgtacacgtgccggcatgtgcagtgtgcttctcta

SEQ ID NO: 604454 - DNA, 85 bp, Homo sapiens
tactttcattgtatataggtcttatttcataaacagatatcctgtatcaaataaaagtatttgttatatatttgaaaaaaaaaaa

SEQ ID NO: 604455 - DNA, 249 bp, Homo sapiens
  misc_feature (145)..(146): n is a, c, g, or t
cgtgacgtaggcacaatgcacgtttctcatagaaggcgatgaggggttctgtggcctgtaataggtctccagccgcttttgatggtctcctcattgtcgtccacacgcccgcgtggtctcttccaccgtttcaacgagccgctgnngtcactggtctgagggcctgcgtccaccatacagcagcagtgtgggctgtccaatccgtcgctcaaactcttctccttgctgcacctccgtggcggtcgctat

SEQ ID NO: 604456 - DNA, 199 bp, Homo sapiens
gtctgggtatctgtccagaagttctgttggtatcttgtggtgtctgcgagcgaggtgggctgtcacagtgagagctcttggagctactccgtccagactcatgctgtgcgtccagcagtattttttccatgtctccattataaatagaaaccgaggctggaacgctgcccccgttcccattattgctgaagtgcagttc

SEQ ID NO: 604457 - DNA, 397 bp, Homo sapiens
cgacggtagttcttagacctcaatggaaataaactagaaatcaataaccgaaagctgtaaaactcccaaatatttggagattaatcaacacactctgaaataatgcatgggtcaaagaagaaagctcaagataattttttttaattcaactaaatgaaaatgaaaatacaccttatcaaaatttgtccattgcaatgaaagcagtacttagaaggaaatttacaacattttttgcatatattagaaaagatgaaagggccaggcacggtggctcacgcctgtaatcccagcactttgggaggccaaggcggtaggatcatttgaggccaggaactcgagaccagcctggacaacatggtgaaaacccatctctactaaaaattcaaaaattagccgg

SEQ ID NO: 604458 - DNA, 155 bp, Homo sapiens
taaaaaaaattttttttggggggggaccggtcaaatttttttccttttttgggggggcctcctttttcccccggggtgggcccttttaaaaaagggcccctgggtttttccattttaaaattttttttttttaaaaaatttttaaaaagggccca

SEQ ID NO: 604459 - DNA, 112 bp, Homo sapiens
gcacacgccgaatgccacaccccgtggtgccaggtcattgtggacgaagttgttgcgcaacaacttcgtccattaagatttcgcatagtggtatggttgctcggcgtgtgca

SEQ ID NO: 604460 - DNA, 302 bp, Homo sapiens
  misc_feature (188)..(188): n is a, c, g, or t
tgggtcccttgtagcacaggagattggggttaagggcccctcccagggaagggacaccatcaggcctttggttgaggcagtagcatagaggatccatttctacctgcatttcccaaaggactagcaggaggcagccttaagaaaccggcagttcccaagccagggcctggctgttctttcattgtcantgccctttccccaacctttcctttaacccactagagattgcctgtgtcctgcctcttgccttttgtagaatgcagctttggccctcaataaatgcttcctgcatttttttgcca

SEQ ID NO: 604461 - DNA, 261 bp, Homo sapiens
catgatgggagcagttgatgccgggtctctgggcctgagagacacgccagtccgtgttgggcggggcttgcacgctgggaagtcactacactggaattacaaagtggaaatacggacccagatgaatcaccgcaccgtatgtcttgtcctgaactcaactgctcactacatattaggaaattaaactccgtcttacctgtatgtgcaacacctagattgtaggaataaggcaaagtcccctcgctggcgctcgtaggggta

SEQ ID NO: 604462 - DNA, 410 bp, Homo sapiens
tatccgtgtcggggttttctggatgattttcccatcgtgatcaaacaccagtcgagtcccaaccttcgccgatccgtggcagggagaaatggagacatcattaagcctccgaagagctcttcttctaccccacatccatagcctgaaacttcaatgagacccattccatagtccttaagctttagatcaacattagtggcaccagcatccagactgttttctactatcttcttcatccagtgcttagactcagtaccacctgcccagagcaaatctgatggactgacttccgatcaataggtttgatggccttagcaggttctgtacttcttaatattcctttgaaattccttatggcgcacaggtagcgtagaaaataactgctttacgctgactgtggtccctctggg

SEQ ID NO: 604463 - DNA, 971 bp, Homo sapiens
aagacgcggactccacgtcttgggacggcgcgctggctatgatgacgaagctgaaggagattgtggcgcactgagacgtatgacatagagcgggttgtggagcggtcctgcaagccggtcgatggactcatactccacgacacggaattctgatgaggcgctttctgtctccgccgaggaacttcctctgcgagagtaccacagacggcgtggttccacgtcgatgtcctgctatataagcacgagccccgagggtttccggggcgtggtctggccggggaaggtcgaggcgtggtgtggcacgcacatgagtggtcccatggtcgtggaatgcatgaacacaagtttgccagaagactgcaggccctaggtgaatggacgacaaccaccgcgtgaagatgaatgggttcacgggcatacggagaaagcatgaagccccaggcatgcacgtccgggaatggtagggcaggacaaaatggcggctggcccctgcgtcctggaggagcgcaagattggctgaatgtagagcaggggctggctggtgagccctaatcgaccaatgtggaccccttcagctcgacctgccctaaggagtaactttggtcgtggggattgaatttaaagtcgcagtgtgactccagatgaggacacaactctctgtggcagggccatattctcgtggggatgcccctttgatacggtggttgggcgcctgtggtgctccggagtatcgcttggctgatggagctcgcctcatgaccttctgtggagctggaatctgatcacgtggttgtgttccgcgactgggccagcgtgaggaacgaattgccttcggcaggcgttctccctttttggagcccgacaaaggcgttccatttgctggggctggggccacggggcaggaggcttgcttttccgggaagccggatgggcgggggccgggtctaaatggcggggaccggttctcgggg

SEQ ID NO: 604464 - DNA, 909 bp, Homo sapiens
  misc_feature (71)..(71): n is a, c, g, or t
  misc_feature (116)..(116): n is a, c, g, or t
  misc_feature (130)..(130): n is a, c, g, or t
  misc_feature (134)..(134): n is a, c, g, or t
  misc_feature (137)..(137): n is a, c, g, or t
  misc_feature (164)..(164): n is a, c, g, or t
  misc_feature (166)..(167): n is a, c, g, or t
  misc_feature (171)..(171): n is a, c, g, or t
  misc_feature (181)..(182): n is a, c, g, or t
  misc_feature (184)..(184): n is a, c, g, or t
  misc_feature (192)..(192): n is a, c, g, or t
  misc_feature (196)..(196): n is a, c, g, or t
  misc_feature (201)..(201): n is a, c, g, or t
  misc_feature (213)..(214): n is a, c, g, or t
  misc_feature (223)..(223): n is a, c, g, or t
  misc_feature (226)..(226): n is a, c, g, or t
  misc_feature (232)..(232): n is a, c, g, or t
  misc_feature (240)..(240): n is a, c, g, or t
  misc_feature (246)..(246): n is a, c, g, or t
  misc_feature (251)..(251): n is a, c, g, or t
  misc_feature (258)..(258): n is a, c, g, or t
  misc_feature (261)..(261): n is a, c, g, or t
  misc_feature (286)..(286): n is a, c, g, or t
  misc_feature (302)..(302): n is a, c, g, or t
  misc_feature (322)..(322): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (349)..(349): n is a, c, g, or t
  misc_feature (359)..(359): n is a, c, g, or t
  misc_feature (375)..(375): n is a, c, g, or t
  misc_feature (390)..(390): n is a, c, g, or t
  misc_feature (392)..(392): n is a, c, g, or t
  misc_feature (396)..(397): n is a, c, g, or t
ggttccgtcacttgagctcatccaggctgctgaagccatgaaggggaacagaatgggtagacccagaggancccacagtcattgctgagaatgagctcctgggagctgcagccgcnattgaggctgcagncaanaangctagagcagctgaagccccgggccanannccangggaggcagnntnagtccttngaantatgnaggagcagatanntagaagctngcnaagtcnattgcagnagccancagtncactggnaanaggctgcgtcggctgcccagagagnactagtggcccaaggnaaggtgggtgccattccagncaatgcactggacgatnggncagtngntcccagggcnctcatttctgctgccnggatggtggctgggnancaannaatctgtgtgaggcagccaatgcagctgtacaggccatgcagccaggagaagctcatctcatcagccaagcaggtagctggctccacagggccaggctccttggtggcctgcaaggtcacagggtgaccaggactcggaggcaatgaaacgacttcaggctgctggcaacgcagtgaagcgagcctcagataatctggtgaaagctaggtacagaaggctgcagccttgtgaagagcaggagaatgagacagatggtggtgaaagagaaagatggtagagggcattgcccagatcatcggcacataggaaggaaatgcgacgagaaggaacgaacaggtggaagaggccgcggaagcaaactgggcccagaatccgggcaggagccagtacaagtttctgacttcccagctgtcacgatgaaccactaaagaaagctcttcttattcaatgcagaaccgggcccagagactgtgcggtgcactacaaaagccttctgggctgagggggccaa

SEQ ID NO: 604465 - DNA, 340 bp, Homo sapiens
  misc_feature (22)..(22): n is a, c, g, or t
  misc_feature (83)..(83): n is a, c, g, or t
  misc_feature (93)..(93): n is a, c, g, or t
  misc_feature (122)..(122): n is a, c, g, or t
  misc_feature (184)..(184): n is a, c, g, or t
  misc_feature (300)..(300): n is a, c, g, or t
  misc_feature (307)..(307): n is a, c, g, or t
  misc_feature (310)..(310): n is a, c, g, or t
  misc_feature (314)..(314): n is a, c, g, or t
cgcgtgcgtctgtgccctctgngcgggctctcctgggtccttctgccatcatgccgcatgcttcatcgctaaacaccaacgcngccccgcgcnctccgctgcccggacgggttcctctccgnagctcacccagcagctggcgcaggccaccggcaagcccccccagtacatcgcggtgcacgtngtcccggaccagctcatggccttcggcggctccagcgagccgtgcgcgctctgcagcctgcacagcatcggcaagatcggcggcgcgcagaaccgctcctacagcaagctgctgtncggcctnctngcangcgcctccgattcagcccggacaggg

SEQ ID NO: 604466 - DNA, 442 bp, Homo sapiens
  misc_feature (101)..(101): n is a, c, g, or t
  misc_feature (308)..(308): n is a, c, g, or t
cgtgggaggtgcctaaaaccacaacgctaatagttatgttaatggcattatagtgagctgggtcaaattaaggacatttaggttgatttgttgcacctgtnctaagttgagaccgtccctgctgagcaacatcctggcataagggcaagttcttaaccacatttcttcctgttagctgcagaggcggggtaggtgctgtcctgcagttgttcctgtgaacattgttcctttctgtcccttctccctagaccctccatctctatctgcctatccagcccctaactcctctctcagtgctttccctccangtacatacccatattttaattttcaagtgtgcaattttcacatttataattcgttaagaaagaatgcaagggaatgattcagatagtcatcaacacactgcagctgagtccaagactctggctacctttcttcc

SEQ ID NO: 604467 - DNA, 283 bp, Homo sapiens
ggaacggggtgtctggctacgctgaccctggtcttaggcgaggggaagatttctccctggtagagtcagtgtcctatcgctgtgctgccctgtctgcccagcccagggcgatgcctggaagtctactgactttgcagggagtcagcctcggccgcaacccctactggttttccaatgtttagactggagggcaaaattttactacgtactcatctttatggagaccagggctgccctgctggcaacctgccttctaatgtaaagttgccacgggcgtttggct

SEQ ID NO: 604468 - DNA, 281 bp, Homo sapiens
accagttggtcgtggtcatggtgtgttacttcatcctatctatcattgactccatggtacaaagttatgccagacgattcctgcagcggttgaactcagaggagaaaactaaataagtagaggaagttataaccctgcagcaaattggagtggatgggtactgccttaaattgggaggactccaagccgggaaggataattccctttgccaacctgtatcaatttgttacaacttttttcctgaaagccgtttgtccatctgagccgtttgtccgttctga

SEQ ID NO: 604469 - DNA, 1712 bp, Homo sapiens
aaagagccctcctgggtaggaaattgccccggtggaatccctcaccagagaagcaggtagcaggccctcgcagaggattaacacagtggctgaacaccaggaaggaactggcacttggagtccagacatctaaaatttggtatcgtgccttggatccaccacagtcagctgaaattatcagcccaggaccagtggaccaaccagcaggacatagaccatctgacccgaatgatcctgcaatgagaccacattgccagtggagatgacaacagcactgctctggtcactctggaagatgaccagtctatgcatggtggaagcttgagaaaatagcaagccctgctctagtcacaccaagaactgactagtctatgcacggccgaagcttgaagaatcgtcatcagatgaataaatgtggccagaaatcttaggcccagtaatcttctttgtattattcattatattgctcttgtgctattgtttaaccaaccccctaaatgcctttactgttcatgctggctgtaagaatgctactgtttgctttgtttgtgctgatccccatatctatgctagaaggaggacccgtattaggatgccgtcactgcatgcacactacatggataagaaacacagtaattgctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcggagcttgcagtgagccgagatcgtgccactgtactccagcctgggcgacagagcgagactccgtctcaaaaaaaaaaaaaaaaaagaaacacagtaattaagactttattataccatacatactataggtacctgggcacaagataggtcagggggtactgtacccctatttacatgcttaatcacatcataaggttgcaggtggtacttgaaatcatcactaatgagacagcaaatatgttagacttgctggcccagcaagccacagaaataaggatcaccatctattagaatagactggcttcagactgcctcctagcccaaaaagaaggattatgtggaaagttgagcctgatgaattgctgcctagaaattaatgataacaggaaagccatcatagaaatagctgccaggatgtggaagatagctcatgtcccagttcagacctggaacccagatggtctccagattccctcttaggaggttggttttcatcctttggtggttttaaaacagtaggggtagtgttggctatattaaaaggttgcttaatgttcccttgcctcttaggcctcctcatcagaaacatccaatcaatcacagaatccatcgttaacagaaccacctccactccactgatggctctaaacaagtatcaacccgtaccaaacagagaagaactgacttgtaatgaggaattaaatgatagtgatgccttctattgaattccatttacaggaggcatcaaaggggaagatgagatgggaaagaaagaaagaaagacagaaagaaagaaagaaagaaagaaagaaagaaagaaagaaagaaagaaagaaagaaagaaagaaagaaagaaagagaaagaaagaaaaaa

SEQ ID NO: 604470 - DNA, 115 bp, Homo sapiens
atcgaaaagttgggagtgggggagtcttttctccgcttcattcctaccctttccaaattgttctctcctttccctgtatctcccatggatcactgataaatatttattatataat

SEQ ID NO: 604471 - DNA, 193 bp, Homo sapiens
tatgtagacagttcttcattttcatcattgaatcatgttacttttgtaattcaagtaagcggctgggttaattcatgcatgtatgcccttttaatcaaactataagggtagagttcatatttgaatgcaagtagcctattcattatacaatttgagtttgtcttggttatacctttgccatgcataacctcag

SEQ ID NO: 604472 - DNA, 443 bp, Homo sapiens
aaagagccctcctgggtaggaaattgccccggtggaatccctcaccagagaagcaggtagcaggccctcgcagaggattaacacagtggctgaacaccaggaaggaactggcacttggagtccagacatctaaaatttggcctcctcatcagaaacatccaatcaatcacagaatccatcgttaacagaaccacctccactccactgatggctctaaacaagtatcaacccgtaccaaacagagaagaactgacttgtaatgaggaattaaatgatagtgatgccttctattgaattccatttacaggaggcatcaaaggggaagatgagatgggaaagaaagaaagaaagacagaaagaaagaaagaaagaaagaaagaaagaaagaaagaaagaaagaaagaaagaaagaaagaaagaaagaaagagaaagaaagaaaaaa

SEQ ID NO: 604473 - DNA, 2234 bp, Homo sapiens
aaagagccctcctgggtaggaaattgccccggtggaatccctcaccagagaagcaggtagcaggccctcgcagaggattaacacagtggctgaacaccaggaaggaactggcacttggagtccagacatctaaaatttggtatcgtgccttggatccaccacagtcagctgaaattatcagcccaggaccagtggaccaaccagcaggacatagaccatctgacccgaatgatcctgcaatgagaccacattgccagtggagatgacaacagcactgctctggtcactctggaagatgaccagtctatgcatggtggaagcttgagaaaatagcaagccctgctctagtcacaccaagaactgactagtctatgcacggccgaagcttgaagaatcgtcatcagatgaataaatgtggccagaaatcttaggcccagtaatcttctttgtattattcattatattgctcttgtgctattgtttaaccaaccccctaaatgcctttactgttcatgctggctgtaagaatgctactgtttgctttgtttgtgctgatccccatatctatgctagaaggaggacccgtattaggatgccgtcactgcatgcacactacatggataagaaacacagtaattgctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcggagcttgcagtgagccgagatcgtgccactgtactccagcctgggcgacagagcgagactccgtctcaaaaaaaaaaaaaaaaaagaaacacagtaattaagactttattataccatacatactataggtacctgggcacaagataggtcagggggtactgtacccctatttacatgcttaatcacatcataaggttgcaggtggtacttgaaatcatcactaatgagacagcaaatatgttagacttgctggcccagcaagccacagaaataaggatcaccatctattagaatagactggcttcagactgcctcctagcccaaaaagaaggattatgtggaaagttgagcctgatgaattgctgcctagaaattaatgataacaggaaagccatcatagaaatagctgccaggatgtggaagatagctcatgtcccagttcagacctggaacccagatggtctccagattccctcttaggaggttggttttcatcctttggtggttttaaaacagtaggggtagtgttggctatattaaaaggttgcttaatgttcccttgcctcttaggcctcctcatcagaaacatccaatcaatcacagaatccatcgttaacagaaccacctccactccactgatggctctaaacaagtatcaacccgtaccacaaaacaaaaaaaaaaaaaaaaaaaaaaaaacgtgtgttgcgcccgcccccgggcccccgaagaaactttcagaacaccatgcgtcgagggccgccgcggcgccccagcgggtaacggcgaaccggggccacacgaccggtgtctcccccagggaacacccgcgggccaccaaacacaggcgctcggggcattctccaccaactatatcaaaacgcccccggggcgtacacacgacgagccgttctgcgtaccacaccacccccagcagtgcgacatctctcgagggtaccatataacggggccactcatacatcacaccacgcgcctcccaccgacgaagccccccgaattatacaaactataaccgcccctcgacaagcggtgtaacacactagcaccacaccacaccacacacccaacccacctacacacaacactacccagacgcaagacaccacacacacgcaacaccccacagcacacaccgcgcaaggacactaaagacacacaccacccaaaacaccaacgccacccctccgcagacacgcatacaacaacgaacgagcacacggccacagcgacctacaactagacgccaagcgcagagcacacccaagcacgcgcaacccgaagactcaggacacacgccctcagacgacagaccaccaaccgccagcacacccctgaacaacacacttcagccgccaagagcccgccgaccggcacc

SEQ ID NO: 604474 - DNA, 196 bp, Homo sapiens
ctggcgcactccgttcctttgcggacatctcctttcctgtcagttcctaccattgccttgtttggttgtgcttgtcctcggtttttcgttcggttttgccagtaattggccttcgtaaacatatggatttgaacagaatattttgacttttaaattcatttgtcctctttttcatgcagagtctggtccgagcgga

SEQ ID NO: 604475 - DNA, 727 bp, Homo sapiens
caggagctgggtgaccgatggcttcatctgcctgaaagactactggagcaccgatgaggacaagtcctctgagatctggaatttggaccctgatgtcataccaacttcatccgtggttgcctgagacctcaataccccaagtgcatctgtctatacatcctgtcagctccttgagaactgcaatatccagagctgcccctgtaggtggcttaaaagggacagcattctcagagctctcctacaccacctctagcctggcccagctccaagcatgctggagtcccaatatagatggacaagaagctagctttttataataaaagtacccacctcgatcctgtaagaaacacaacggcagcagcagcaattgaacaatcttgagcatagaagtcattgtaaacgaagttaagatcacccgcgtggggatcccctgtccaataagctcctaatgaagggaatatagaataagttggggccgaataaaaaaaaaaaaaactctagaaaagcgcccggtgtccaaatcttactatagtgagacggattacactttactgggcggggttttaaaacaaaaagactgggaaaacactccctttacaccacttaatcagcttgaaggacatatgcctttagtcagcctgtataatatgcgaaaagaccgacaaatattgcttacaggtagtgcttaacaatagggccagagaagaggctctatatttcgttaccg

SEQ ID NO: 604476 - DNA, 105 bp, Homo sapiens
gtaaggcacatattgaagggtccctgctggtcctggtaccagcacaccaggccctcttcccggctgcacgtgcaccaccttggcccatggtgttcgcatgctcac

SEQ ID NO: 604477 - DNA, 948 bp, Homo sapiens
ggtattatattgaccgctcactcgtgtcatacttcaaagatcagagtagattatttctcccagcatgttctacttccgaggctagtgagacgtatagggtcgcggtttccttacaccaagcagcaatttccgttaggcacggttgagcagtgacagcgacggtgccccggactccgaacttcgacgtgatagtcattggtaggaggacatgccgggactagagtgcagccaccgccgccgctacggtgcggctactcggactactgctcctcactcaccgtgtggacacgatcggtcagatgtcatgtaatccttcctttggtaggcatcggaaagggacatatataatgagggaagtagatgccttggataggcctagtgttactcgcatctgtgaccagtctggtgtacattataaagtattaacaccggcgtaagggaccagctagtgtaggggtctgagcagctcagattgctaggaaactctataacacagaacatgcagaaagacatcttgaatacaccacatgcttactgcttcaggacgtgagctgtcgacagatcttaattctatacagaaccagagcctgaacacactggcgacatgccgtgtcacgtggcgcgtcgtacatggctgcatggaaagccacagtactatgcagacgagtgtgctactgactactgggaccatttctagagacagcactgcaccgatacctcggccatggccgaacgcctccacgccgcgaacgttcacgcgatcaacccctttgtaatacggcaatgcgggatcagcaaagaggtgagacaatgttactggctaagcatgtaagcgaaatgtgtatgccagcacgataccctcctccccgaagactagccaacataactctacataccttagcagcgattcacacaccagcccatcatccgggacaaacccgattaaca

SEQ ID NO: 604478 - DNA, 264 bp, Homo sapiens
aaagctgagatagaggaggagaagtctcttgaacgcgggagggtagatagcggtgagccagatcgtgccattatactccagcctgggcaacaaaagtgaaactctgtctcaaaaaaaaaaagaagaaaggaaagcagatgcaattatacaggctagtaaaagaagttttaactaagcttttttctggtggtgcattttttctggtctattggtttaggcccaattaaaatggtcaaaattgggtggtagccatagcaaagggga

SEQ ID NO: 604479 - DNA, 240 bp, Homo sapiens
tagaggatccggctatacataatcgttgagcgatggccacccacgcgggacacccggatcactatacgacttcgtctctgctcgacatgtccgtctcgcaagtcaaagcggggctttattgccatttgcacgcaaacgagcgaatttccgaaccgcttctagagccccaacctatcgttacgcccttcccgtttaccgcttttgcgaagggcgaaccggcgcacaagttcaaaacttggc

SEQ ID NO: 604480 - DNA, 142 bp, Homo sapiens
taaggatcctattctgcaccacagcaattgcacaataccaacttacagcctgaaagctgtcaggcatctgaagaggcatttttccccctaatgcgaagaaaactggtgtttccaatcaggggtcctcttgctattttttttg

SEQ ID NO: 604481 - DNA, 605 bp, Homo sapiens
gatctgaggatccccagagacgcagagaacccaggatgatagactgaaatagatagatagatgatagaagatagatagatagatgatagatgatagatagatgatagatagatagatagatagatgatagatactgatagatagatagatgatagatagatagatggtagatgatagatagatcgatgatagatagatgatagacagatgatagatagatgatcagcatagcatgcatagcatcagcatcagcatgcatcagcatgcatcagcatagcatcagcatcagcatgcatagcatgcatcgccatcagcatagcatgcatcagcatgcatagcatcgcatgccatagcatcagcatagcatgcatagcatgccattgcatcagcatagcatagcatagcatcgcatggcaggcccttcaaaggccctccattgagcaggggcaggcagctgcagcaaaaggctgacaggcggtgagacgagccacgccaggaaggaggtccctgggggaaaacagcatattccaagcagagaaaacagtgaacgagacgggtcctggggcagcatagggccccatggcccatggtaagacttctctgca

SEQ ID NO: 604482 - DNA, 238 bp, Homo sapiens
cagatcgtctgttagattctctatgccctgcacagagcaaagctctctaagtgttggatggatggcggacagacaggcatacaaatgaggaaacaaacccaacctcattcccagtaatctctacctccgtggggcccccagaaggacatctcgttcactcatgttcgtgtgacaacctcttcagaggttttgcaggcatgcaccctctttccggtggatcctactagcagtcgacctg

SEQ ID NO: 604483 - DNA, 191 bp, Homo sapiens
ctcggcgtatgacgggggcagcgcaagtgcacttcaaagttcgagaaggatgggttgcctgtctttggaatctacagcgccaggaagccgtcgaccgcggcgcttgacgtaatcgggacgacctcaactcggattacgtcaccctcgcgttcatcgagtcgctcggcttagccgacgtcgcacaaacccaa

SEQ ID NO: 604484 - DNA, 153 bp, Homo sapiens
atcccgggtcgacgcacgcgtgcgcagattttatgttggttttttgctgtgaagtgctgcgctctaataactgccttaacaactgtagatgtctcggataaaagtcctgcattttccattggttttcataatgggtgtttatatgaaactact

SEQ ID NO: 604485 - DNA, 108 bp, Homo sapiens
ccgatgttgaggatccgtgtaagaggactgggttacaccttcatagacccaccatatgggataagtaacttgtggaaggccttaaacctccaaaggtggtcccgggtt

SEQ ID NO: 604486 - DNA, 155 bp, Homo sapiens
tcaacgctttatacttcctcaaaataaaaaaaatggataagcagaagtcttcctagttttcttgattttaaaccttaacccagggttatttggcttctttcaagattggtggtggtggagggccacattggcagtacggtggtatgggagggggc

SEQ ID NO: 604487 - DNA, 914 bp, Homo sapiens
cttcgatgtctgtagcagtcgctcgcttggattgcgttaccgcccgtcccggcatttgtgatagtctgtccgcgcccctcttggtcctcgtcaaggcccctgtttcttgatgtgtattcactctttgtgcggttgggtcgaccacattcttgccgccggggaacaccccaatttgtgggtgtgggacatcggcccgccctatattggtcacccacctctgtgcgttgtttggctccgcaggttgtcgtgtcaccgccgagtgtgttgcgcgccagcgtcgcacattttcctcggccgggtgcccccctggcctgctcatactgggtggggtgtcccccccgcgtctgttttctgcgattgcccttattgtgtgtaaaaaacttcctgccaacggggcgcctcttttattccactcctcggcgtgcgtccagcgactgtttccttactgtcggcgccactgttgggcccccccccgtgcattcggcgcgcccctctttttgggaggccgcctccatttagtgtgaagatcacccagtgatcgctcgtccgacccccgtggtgggcggccacttcgccttgcacgggactcacgcactcgttccgtctgcaggctcttgagcttgtggagctcccccctggtctttctcacccccgcgctcgtaaccactcgggcgctgctggcccccgctgcgccgccccccgctggttgtggactattaggaggctctccgccctcgcacgaagcagttaacaggtgtgcccgcccttctctgggcctcgaatgcgttccgtccccttcctcggggtgtccggtagactgctgcacatcccgcgatccgtggtgtcttccccccatcatggagcgtagtcttgcttcccccctccccccttcccccccccaggccaaaataaca

SEQ ID NO: 604488 - DNA, 1695 bp, Homo sapiens
gaggcattgaggcagccagcgcagggtcttctgctgacgggggcacggcggacgcttgacggacacacccgccagactaacgtttttttctgcttttgacaacgactacgacgaccttacactaccacaacctacctttacacacacacaactactacgtgccactacggattacctacacggactcctgggcttacgacgtctacacggtcttcttacaccgtacactttttacactaccgctatacagactttttacacgacgacaacactacttgacacgacctttacgacacgaacgtacggcacttgacgtgacaccggacaacactgactaacacacgggtattctacaacaacacttgaaccgggagggtcgaagacttagacacggcttttccttcacctgggacgtacacaacaaaacttgctacctttaacaacacagacacaccttgagcggacgacaaccgggaccctacacagaggagcccccgcggacaccgtgagacactacacccacaccctaacggacacggggtgacaaacgtgcgcttatattattacggaacgtttacccaacacgtgacatcggggtgacccttttacaccacacaccgggcttgtaaccaacgggtatttagcggtttatgaacccaaacggttctaggtaacggggatggacctctacacaagacttacacgtattaggagcgcgggggcgacttcagtgtatataacgaaaacagaacgactgtgacacacgcgcgaaaaggggtggacttctacagacaagcaccacgttggaaacaacttcccccattggaagtgccaagagggaacgcacattgtggcgagtcccatttatataacagcgccctatgagttttacacacgggcgattttgataaacttacagaacgggccatgcaactgacaacacagttggcacagatgcactttgcaaatcgttggggcaaagttgggggtcagggcgatttggcaagcacgacaactttgggggagaacacagacatacacgcaaccaggctgtcacgggcacaggagtggcggacacacacccctgaggcacagagacacggacaaacgtatccccggggtcaacacgtgggcgcacaacgccacacaaggcacattctcccgacaggcacacgcacatacagagggacacaaagctcaggccacgcacatcaccagaacacacggctacctgaagtcggcaacggacacaacacagagagattacaagattcacaccgcccagcaagcacacccaccaccagtcagaacaacatgaccgacgacacgacagaacaccagcgcagacacggacgccgctgacggagcaacgagacagcagacaaatgaaatgtaacacaacaccacgccacactaattagagcccgacatccggaacccgcacacacagcacgacacaaggcacacaccagacagggcgcacacagcgagaagtaccagaacgagaagcagaaaacacgaagacaaaacaaactaactaggcgaggaccaacactaaacacacacaataaaagacagccagcggcaacgaaccacacgacgcagagtcgagaccacaagcaacccaccgcgtaccatgtacggagcagcacacagtgagaaactaacacaacgagatcgagagacaagaacgga

SEQ ID NO: 604489 - DNA, 570 bp, Homo sapiens
  misc_feature (569)..(569): n is a, c, g, or t
gagtccttcgagtctcccttcagcatttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagagcgagatgaatcctcaccatatgctgctatgttggctgcccaggatgtggcccagaggtgcaaggagctggggtatcaccgcccctacacatcaaactccgggccacaggaggaaataggaccaagacccctggacctggggcccagtcggccctcagagcccttgcccgctcgggtatgaagatcgggcggattgaggatgtcacccccatccccctctgacagcactcgcaggaaggggggtcgccgtggtcgccgtctgtgaacaagattcctcaaaatattttctgttaataaattgccttcatgtaaactnt

SEQ ID NO: 604490 - DNA, 1018 bp, Homo sapiens
cgtgggtggtgtcatgcttgtatcccagatgtttgtaaacaacgaatctcgagtggtgattcactgagaatggaggatgatcgttgacgtcctagcttaatttgcaagaatggcctgatataatcatgagactccctgatttgagctgcgggactgctcgagttcggatgcctgtaatacggactcatttggggccagggttcaaaggattcaagacactgagtgataaaggcctgttgagcaggtacctggacaagatgaggccattactcgtgctatgtttgccaccccagagatgcacgagaagattaagtgactccggcgtaggaactgaaatgcctttgtaggataatatatggggatgagcaataaggcacaaccaaagcatggtgtctaggaaaaggggtgaaagtgcgaaagggtggatgtgaggatagattttcctgcatgtgagataatagggagtagtaaaggttacagtgggactgtgagcagtgagtccatcaggagtgtaatagactggggctataaggattgaactaggaatttgtttaacgaggtagtttgaatgaactgatttgctacataggtatgagtgaaaccttgatgcagagaatattattgcatgtggcggggatatgctgaaatatgcctagtatggtggtgaagtaagacttacaagtgctgtttgtaggcagatgtcttgggtgtgaaggtgaaaagtgtattgtgtctgaccataggagatgctaggggagtgagcatactgcaggattggtcatgtaaacgcatggactgttttcagaagaatacacgtggaggaaagacaagcctaggactttattcctttgttaaagtgcagttgagcggcgggatcacaggacagtgctgggggtgcaaggtatgagaattggaagcaatattgtgggtagaaaatgaacgagagggacaagacgggtgcatgaataaaatagagggaaaggggatattgaaaagggaaaaaaaaagtaaaatcagg

SEQ ID NO: 604491 - DNA, 88 bp, Homo sapiens
tacagcgcctccgaatatagtaatcttgaccagcaatgacaagaaaaaagaggagcacctttacaagcagttgatagctctgttttgg

SEQ ID NO: 604492 - DNA, 316 bp, Homo sapiens
cagttccaatctcattcccgtcaccttcagccggctcagtcccagagctgcatttaccggcgtaatgccgaaatagatgccggcggcgtatgcgcccatggcgttcatcacattatgccggccgagaacgggaatacagaaagaacgatcaataccgtcgatagtgaaatatgtgccttcttctgcctgctttatttctttcaagcggagatcattgtccgcaccttcgccgtatgtcgttgtccggcaagtgtacgccttctcgcgcagcagcggctcatccccgaaataaaacagcactccgtcttccgtagac

SEQ ID NO: 604493 - DNA, 672 bp, Homo sapiens
  misc_feature (569)..(569): n is a, c, g, or t
  misc_feature (580)..(580): n is a, c, g, or t
  misc_feature (599)..(599): n is a, c, g, or t
  misc_feature (607)..(607): n is a, c, g, or t
  misc_feature (666)..(666): n is a, c, g, or t
gagtccttcgagtctcccttcagcatttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagagcgagatgaatcctcaccatatgctgctatgttggctgcccaggatgtggcccagaggtgcaaggagctggggtatcaccgcccctacacatcaaactccgggccacaggaggaaataggaccaagacccctggacctggggcccagtcggccctcagagcccttgcccgctcgggtatgaagatcgggcggattgaggatgtcacccccatccccctctgacagcactcgcaggaaggggggtcgccgtggtcgccgtctgtgaacaagattcctcaaaatattttctgttaataaattgccttcatgtaaactntttcaactccngccttctctccttcatcanggggtacncagggatttgatttcttcctcctattttgcttctttggagaaaagagcctgaagagagnagagat

SEQ ID NO: 604494 - DNA, 370 bp, Homo sapiens
gaaatctagacagtgatcttactggacattttctggtacacgtattcactctagcttattagaatactccctaaatgcagtagattacacaacaaaaatccaatctaccacgtggtacagtattatgtacgaatggtgcacagaaatccgaatttaccacgtacgattggtgtgctaccaagttcacacaattaattcgatatttttaatcatattcaaccactcacatttgggctatgttaagtcatagctcaacttggacccttactgctctgcagcaatacaacctgccggtggagtacaacctgccggtggagtacaacctgccggatgaaatacaacctgccggtgaagtacaccctgccgatgg

SEQ ID NO: 604495 - DNA, 682 bp, Homo sapiens
  misc_feature (598)..(598): n is a, c, g, or t
gagtccttcgagtctcccttcagcatttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagagcgagatgaatcctcaccatatgctgctatgttggctgcccaggatgtggcccagaggtgcaaggagctggggtatcaccgcccctacacatcaaactccgggccacaggaggaaataggaccaagacccctggacctggggcccagtcggccctcaagaagcccaccttttgtggcactctggccttcggagcgattaattgaaaagtatcagggtcgtgattgaggatgtcacccccatccccctctgacagcactcgcaggaaggggggtcgccgtggtcgccgtctgtgaacaagattcctcaaaatattttctgttaataaattgccttcatgtaaactntaaaggatagatagtatattaacaataaaattcgaggggaatttgtgcggcgggggatataaaggcggtgaggatattggcctt

SEQ ID NO: 604496 - DNA, 389 bp, Homo sapiens
ctggacaccaagctcagagccctgggtctggacaccaagctcagagccccgggtctggacaccaagctcagagccctgggtctggacaccaagctcagagtcctctgcaactggatacaggacttcctgacgggcagaacacaggctgcgagcattggaaaccgcacctcctccacactgattcttaacacaggggccccccagggatgtgtcctcagtcctctgctgtactctctgttcacccacaactgagtggctttgcaggacacctactcagccaaaccaaaggaattgattgttgacttcagaaagcagaggaggaaacattcccgaatcaacttgacgtcgacgcggccgcgagtttagtagtagtagtagtaggcggccgc

SEQ ID NO: 604497 - DNA, 163 bp, Homo sapiens
  misc_feature (162)..(162): n is a, c, g, or t
attgtagtggcatcgtcgtctatgaactctgaagaagtcttggtattcagtcttagacactgtggatagattgtcttggaaatcacattctccaataagcgccgtctgtgaacaagattcctcaaaatattttctgttaataaattgccttcatgtaaactnt

SEQ ID NO: 604498 - DNA, 1231 bp, Homo sapiens
  misc_feature (569)..(569): n is a, c, g, or t
gagtccttcgagtctcccttcagcatttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagagcgagatgaatcctcaccatatgctgctatgttggctgcccaggatgtggcccagaggtgcaaggagctggggtatcaccgcccctacacatcaaactccgggccacaggaggaaataggaccaagacccctggacctggggcccagtcggccctcagagcccttgcccgctcgggtatgaagatcgggcggattgaggatgtcacccccatccccctctgacagcactcgcaggaaggggggtcgccgtggtcgccgtctgtgaacaagattcctcaaaatattttctgttaataaattgccttcatgtaaactntaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaaataaaaaaaatttattccgacataaacccattgatattaaaaaaggacaaacttatttgccataactaaaacataaggctaaatttaaaaaatgaatgataaagaaggtcacataaatgaagagaatgagtattttaaaacgtatgcttagaaaaaaccttgaatctaacaagattaatcgtcatatgtataacaccctttacctgaaggtgaaaaaaaatgtaatgacacccaagcatatacttataaaacatatacacaaccttgaaggcaaaaaggaaattaagaaagctaatatttgacaaaaattaggccaaaaattttaaaacaaggtattattttataacaatgagcagaaatttaaaaaaacctttataagataaaaatattccatcaaggagtaagagatctttcaattttagcacacaattccctttttaaaaatggggtttttaatacataaaagtagcaatataccttaataggccttaatcccattattggaacccttcgtttttg

SEQ ID NO: 604499 - DNA, 122 bp, Homo sapiens
cagttatgtggtggatgttggtatgccccagcctactggggaggctgaggctgaggaggaggattgcttgggcctagtagtttgaggatacagtgagctatgatcatgctagggcattccag

SEQ ID NO: 604500 - DNA, 138 bp, Homo sapiens
gtggaagtatgtaggagttgacgattagtcctgcgatatcggtgtactcgtagtgtacagtaccattggtggactgagtgggagtggggggccttgctccacccacatcccctacgtgtgacttgctgaacaggcgta

SEQ ID NO: 604501 - DNA, 393 bp, Homo sapiens
ccctttgactcagtacacacacggaatcatcctattcatctccaaaccacagaacgatgtgtcagccctgtagctaactggatgcgttgcggaaacggaaggaaaagaaggtttttaagatgagggctgattaatgtaggatgatgccgacatggtcttgaaatctttaaacagggcggaagacttagaatcatgcagtgcagctacaccgcgtacaacattatacacatacctggttatagaggccagtgagcttcatccccaggtgggtagttgacaaaattcctccagcagtgataatactctgatgctctcataatctgaatagttactccactgttaacaaggtccctgagaccttgccgattgtgtcgatccatgtgccaaaaaagc

SEQ ID NO: 604502 - DNA, 903 bp, Homo sapiens
  misc_feature (447)..(447): n is a, c, g, or t
gcagcagcctcccacatagttacccaccgccaagagtggatcctacagccaagctccaagatcaattatatgccaacagagcaggcagctacgggcagcagagttacattccgacaggaccaccccagtatgcatggagctgtatactgggcacggagtctggaggattttccggaaccaggtagagaaccggaggcatgagttggacctctgataaccggggcaggggaatgagggggatcttgaatcggtggaggacatgaaggcacgatgcgttgggcgcgtgcgaggaaggaccgctgcgtcggaactcgaggcacgccgtcgtgcgatggatgccgcagcgctgggcttcaaactacacgtcctggtggggaaccccaatggcatagagaggatccaagatctaatgatcttaatgacccgaaccgtgtaagaatgccaagnactgtgaaagaagcatcctgagcaaatcaggtaggcaaatctatatgggtacacaagggaattgaacactgaacacgatgatgaacgtacgtaagaagtgaaatctggggcgaaggaagcatgtgctcttaacacgccccccgatggtccgtgcgcgatttcgttataacacggcattggcaaactcacacgcatggcaaacgtgcgtgttgctatcacccgcttattcggaattcccaacccattcttttactcattgcgaaccaatatgggcacaacactcattgcgccaattatgtgcgcacaaacaaggggaccgtaattgacccgatgcaaggttgtgtccccttacttgaatacgtaagcccctacccgcaagccttggcccaaaggggtccttggcccggctgggacattgggttttatggcactgggggacaaggaactttctttcaa

SEQ ID NO: 604503 - DNA, 127 bp, Homo sapiens
ggctcggtacccctacaaacaactaacctgccactaatagcttatgtcatctctcttattaatcatcatcctagccctaagtctggcctatgaattactaccatcacgaaaagaccacgcaaacgcc

SEQ ID NO: 604504 - DNA, 212 bp, Homo sapiens
ccatatggaggtggtaagtttcctgagtttttttcttttatctaatggcataggaagtttgtcttctagctaagctctgagtgaggcaaaaaaaaaaaaaaagtttgtgtagataagttttttggtttggataattttttaatcggctctgccttcatgtagatacagagttcaaatttacattactcatgtggtccaaaaacctccaatct

SEQ ID NO: 604505 - DNA, 264 bp, Homo sapiens
atcctggcatgatgtgaagactaaaatggcaaaccctggcaaataagaaattcatcaagtggaaaagagaaggcatatgtatacttctttataacatgaatgaagattactctgaaagactattgctggagaactattagaaacacaatcaaagacctcaatggctgttagtcttgaagatgtggaaaattactgcaaaacatgaactcgtttattacgtgtccactattatatattagaagactgtgtataataaacactact

SEQ ID NO: 604506 - DNA, 234 bp, Homo sapiens
gcagtgctgctgggtcgactctaacggactcccggcaccactgtgctggcattatagtcatcattactgaagaatatacaaatgaacaaagaaatgttaagagcgcagtctctctaagccgagcaactttgtaggtgtggtttgcaaagactccatgttcgtatgcacttcgtttttttgcctgatatgattccggtatcttctcatgtcatcgtggatcaaagcattggctgt

SEQ ID NO: 604507 - DNA, 511 bp, Homo sapiens
aggcttttcatgggaatggtttttaaagggcccacaaaaaagtttttgggggcggggtttagccacaaccctccaagggaaaacccagtggaggttccttttaaaggagatgtggacccacccccccaacacctcctaggagggatcccctttacgggtccctttttgggagcagttaagctcaaaaagttgggcaggggaactcccttcatccgggtccccccccgggctttccttgggggggaagcaaggaagccacccgttttagaaaattatcccaaaaaatcaaatgggattttggggccccccccccccctcctgaagattttttaaaggaaaaaatggtgtttgggccataatttttttccaggcccttggtttaaagggggcgggcttttaaaatcatgttttgttaacccccttccctaaattggcccttcccaattttaaaaagctttgaggggtttgttttttttaaatccccccataaaaagagggccctttgcctgta

SEQ ID NO: 604508 - DNA, 908 bp, Homo sapiens
  misc_feature (78)..(78): n is a, c, g, or t
  misc_feature (616)..(616): n is a, c, g, or t
  misc_feature (624)..(624): n is a, c, g, or t
  misc_feature (692)..(692): n is a, c, g, or t
  misc_feature (702)..(702): n is a, c, g, or t
  misc_feature (719)..(719): n is a, c, g, or t
  misc_feature (748)..(748): n is a, c, g, or t
  misc_feature (758)..(758): n is a, c, g, or t
  misc_feature (765)..(765): n is a, c, g, or t
  misc_feature (768)..(768): n is a, c, g, or t
gccagatgaagaaaccaaagttcagaaaagtgaagtccaaggccgggcacagtggctcaaacctgtaatcccggcacnttgggaggctgaggcaggcagatcacctgaggtcatgagttcaagaccagcctggccaacatggcgaaacactgtctgtactaaaaatacaaaaattagctgggcatggtggcgcacacctgtaatccaagctactcaggaggctgaggcatgaaaattgcttgaacccaggtggcggaggttgcagtaagccgagatcaccccactgcactccatcctaggtgacagagcaaaactccatctcaaaaaaagaaaagaaaagaaaaaggaagaaaaagaaaagtaaagttccttatccaaagtcacacagcagagccagacagagctaggtctcatacctgaatctctttatcctaaatccagtagttttttctacattaaaataatgaaactggggctgggcatagtgactcacacctgtaatcctaacactttgaaaggccaaagcaggaggatcacttgaacctaggagttagagatcagcctggacaacacagtgagaccctgtctctattttttttaagttttaataaaaaantgatggantgggatttgaattcaggtttttgattcctaacaactatggtatttatatgcatatatttctaaatacngtcatcctcncttatccagtgcatgcntgaaacccaaatagtaccaaatctatatntactatgttntcctatnttncttacctttaatacaggttcatattttacttctggcccggtaggagattagcacccaatatatagttaaatttgtacccagtttttcccctggacggggtacacattttgttccggggtgacacacataacacacaagcg

SEQ ID NO: 604509 - DNA, 308 bp, Homo sapiens
ttaaggttatagcaataaagaaaagctgggctgggtgctgtggctcacgcctgtaatcccagcactttgggagagccgaggaggcggatcactagatcagggattcaagctcggcctggcctctacatttaaacctcgtctctatcacaaatacaaaaattagccaggagtgtgtgcgtgcctgtaatcccagctacttgggagaatgaggcaggattattgcttgaatctgggaggcagaggttgcagtgaatggcggtcataactccttgccctccaccatgggcgacagagggccactccttctc

SEQ ID NO: 604510 - DNA, 556 bp, Homo sapiens
aggatgaggcggtcctacaacagacaagtgacgcgatgggcatttagcgtgactccatgtctttgctactatgtgctatgattaacacacatgcatgtgtctttatagcagaatgatttatattcctttgggtatatacctaagtaatgctaggttgactggtagttcaaacttctttgagaaatcaccaaactggctttccacagtggctgaactaatttacactcctaccagcagcatttaagtgttcctttttctccacagccttgccagcatctgttatcttttgaccttttaataacagccattctgcctggtgtgacatggcatctcattgtggtcttgatttgcatttctgtaataataagtgttgttgagcattttttcctgtctgttggccacatgtatgtcttcttctggaaactatctgttcatgttctttgcccactttttaatggggttgttttttgcttgttaatttttgatttgcatttctgtaataagtgatgatgagcatttttcatgtctgttggccgcatgtatgtcttcttttgga

SEQ ID NO: 604511 - DNA, 192 bp, Homo sapiens
  misc_feature (1)..(1): n is a, c, g, or t
ntgtatagcacaacctaggtcagttctgcaggttgtaagccatttaccaacgatagttgtaggtaaagaagggcagatttattagagaaattgtgaaaatatgttgcagtgggcagctcagcagagaaggggctacctgcaaagaggcaagggctggaggaaagttttatagtggtcctgcttgaagggtgc

SEQ ID NO: 604512 - DNA, 877 bp, Homo sapiens
agcttttggaaaatttaagaaactctccagggctctccatcttgatttatgcttgagttgttatgtgccatatttgctttgaactctgattatcagaagtttactagattttgaaatatcatttcatctgctttctagattttgtacatctcagtccataaagcaaagcttgtgatagtgtagttttctaaacgctgcaaatttggagcttaaccatacaaagaagtgtggatgagggatttttttttcttggtcaaaatagtccctgtttctgtagaatttccattttagataaaatgtgatggatgagctatcataattcaggtatacatttctttttctatcagatattcattgtgtcatgcagtagtagtaaaaacatcaaagatgcagcaagcttataaagtatatatttctaaaagaaataggaggcatttcatctttataatgagtacttggggttatgcaaacatttgtgataatataaacagttatgtcccctataaaatctggtcagaacctctttgtgattgggtgggtaagtaaaatagtctgtagtaggtagagtacgtgcgtacatgtggtccaactaagataagagataaataaagtgtaaattttaaaagaactgggttaatgcctaaacgttttgtgcctggcaaatattacatgatgttgtgtacgtgccaaaaaaaaaaaaaaagaggggggggctaaaaaaccggggggcaattaagggtaccgttttgacaggggccaatgaggcgaaaaagagacgggggtgaaacgtgtgtggaaagcgtggcttgagagccctctgggggatgaaccacggacggggaaaataagtatggacgtgctgtttaaggagagaagg

SEQ ID NO: 604513 - DNA, 404 bp, Homo sapiens
gtacttaagaagagatgagatgcacatgccatgtacagaatgaagggctgccgaaaagccctctacctgagactgggagcgaacttgccaggtaccaccatccacattgtgaacgttgtctagctgagtcctggcatgactcgtcaggcacgatgtggtcactcgtatgctgcggtcgctcctgtgatgtttacgaggaagagctcatgtgtgaaaaggagggatgctactctcacggctgcgtccagcgacagtgcccaatggctctgatgtgtctctcacagcttgaaaacgccggagacagctgtcttgtgagggactgagatgcaggatatcttcactcctcccctttgtgacttcaagagcctctggcatctctttccgcaaaggcacctgaatgtgtt

SEQ ID NO: 604514 - DNA, 129 bp, Homo sapiens
catgtagagaaaaaaaaaaaagaacgaaccaggaaaataaccaaaaccaacaaaaaaaccaaagacagtatcttggcttcattagggagtatcagacaagactggtcactggtcctcatgtcatacatg

SEQ ID NO: 604515 - DNA, 398 bp, Homo sapiens
ggtagcttgtagaaggaaggtggcagggcctcagtagaacagtgtagcttgtagaaggaagatggcagggcctcagtagaacagtgtagcttgtagaaggaagatggcagggcctcagtagaacagtgtagctggtagaaggaggatggcagggcctcagcagaatagtgtagcttgtagaaggaaggtggcagggcctcagtagaacagtgtagctcgtagaaggaagatagcagggcctcagtagaatagcagagtgtagcttgtagaaggaagatggcggggcctcagtagaatagtgtatcttgtagaaggaagatggcagggcctcagtcgaacagcagagtgtagctcctagaaggaaggtagaagggcctcagcagaacagtggtcgacgc

SEQ ID NO: 604516 - DNA, 926 bp, Homo sapiens
gactccttcgacctctgctgcatgccctgtgtccgacgcctgcctcctgggaagagagtgaagctggtgagatgtgagcccactgtacgcctgtacacccaatatctccagcctgcgcagtccctgaagagtgtaacgatgttctgcctgcgccaagctctgcctgcaccccctctctgatcctgagcttggatccatgatgttgcatacagaccaagtttctagcatcagtgtacatctcgaccaagagtgctagtagtgcactggacatgggctctacgtgtatatacatgggtgcccagaaatggtgatgtctcatgctaatccaaagggagctatcacaaccagtgcaatcaccagagacatatgatacagcatgcacaaactttatagcgtgcaggtcgctgccaacagcaagtgacgatggcctgcgtactgcgtgcctgtgctatatggccaccagatcatttctgggccacgcccttaaatcattacgtctctacatcgccacaggcgatacactcactaacctaagtccccgttactcatacacgctcaacagaagccactcgcctctggcacaggacaagatatgggacacaaccatttagcacttcccttgcacaacatcaactacagcactacatattgcaccatcccagctagcttaaccttcttgctgatacttgtccataaagaactacaaacaaatcggcatactgcactctacactcaacccctccaaccataaaccatcctcacaaaacacaccaatacagcaacaccatctaccctcacaccaacaacacacctctaaactcacagaaatcataaaacaaactaagacccctaccatatatctccccccccggcacacacaccctatctacactaccactacaaaacacacactaaccacctctctc

SEQ ID NO: 604517 - DNA, 123 bp, Homo sapiens
ggactcgaagttttgtcggtgccaattgaactgccagtgaggggctcggggagaccgaggtgctgaggcaactacgtttttgtacctggcaggcctggacctgcttctccgtgctgctgcctg

SEQ ID NO: 604518 - DNA, 149 bp, Homo sapiens
tcggccccgcttactgatggccatgtgtctctttgatcatatcttcacctgcatctgcgatcatgctggagtgatactcaagattaagatgcctgcagcatgttggaagcctgacagcagcatgacctgtgggattggctatattcctg

SEQ ID NO: 604519 - DNA, 1654 bp, Homo sapiens
gaactccatgtactttggaatctcctccaagatagccagagtttaatacatcttcattctcaacactctccaaagaacttgacctaccttatgggttccatatttttcttcttcaaatgtgcatccacatccatagccttgcccccaacccgtttacacatatattctatagcacctgtgtcaaatgccactccagcacttgacgtctttagagcacatatttcaactttctttcactacattggccacttcacaatttttatctttcatcaacagctttttgcacaggtccatcaacaccacacagcacccatcacattgcatgcatcagcacctcactcaccatttccgtctgctgctgtgtcgtgtacaccattacccaacatcactcttttcttttactaattctctctcacttgctctctgctcacaggtttgtccaactacactatctacaatgatatgtcttcaacgagcgcacgtcttctctcacatggccaagttcgcttttcatagacaaaccccacattctcacacagactatcactctaccagctcgcccacgagtccttcacctacgatggtgattcaacaccccattgcagtacattatctcgagcaataaatatacacgtccctatcataggtatgtatgcattttcgctcatcacttaattttcatctaattcctagcctatcttactaggctaggcttacagtcgtttcctctacacgttggctcctagtttcaatggcgcgccttattctttaggctgttctgtcaccatcactacgcattcatcactcagttacttcccctcgtccacttggcactacggccccaccacggtccattctgccccgaaccagagcttgctcgtcgcctcaacctaacaacgggcggtcatcctcaacttctcagcgacaataacaacatacaacaacctgaacctactccaatactaatccaacacccatactcaccacccacactccactcgcccagcccctcacaccacacccactaagacgcgcagagagcgtcgcaacccaatccaaagctagacgaacaggagaggacaggcgatagcggacggagatgcccggctccggcgcgaccgcccgccgcacgagcagcgcccgcggggcgaggtgcgtggagtaggggacgagagagcgagtggcacgcgcgcctcttctcgacccacggctgtctgcgagtagacgcgctgcagcgcagacgacccatgggaggggcgcgagcatccgataggtcaggacgagcagcggcgacgagctgggactagcgagaccagtcatcgaccacgcgcagactgactgcagttcaatgacactctgcgtcgtatctttcgagcttgtctcgtgtctgcactctcgtctcgtcggcgcgtagccgtcgccggcgacgacgagatcgcgaccatcgcgagcgacccagtcttatgtgggaggtcagagtaacaggtagccgtgctctcgtgcaccgatcgtatcacgacatcataacagccacaacgcagtaatggttgggctcgatgtcagcacgcagagacggagctacaagatcgagtcgactcatactctcgctacttgataaggtagctagagtttcaatgtatccatcaggctcctc

SEQ ID NO: 604520 - DNA, 289 bp, Homo sapiens
cagattgaagataatcagtcaaagagtattcctcaaaaccctactacatatgaggaaatatagtgtagtcacagtatttactcgcatacctttgatagcctacggaagtacttcaatcctgttttcaggtacaagagggataatcgcatctacctcatgtaggctgctcacaaagattgaatgagtaacactaacactgccatgtctatggaatagtaccaggccatgtcataagcaccccaaatttgacttatccttgtgcaaggcacggggaacacaaacagactgg

SEQ ID NO: 604521 - DNA, 138 bp, Homo sapiens
tacatgatacaatcgagctcggtacctgaacattcgtgtccccaacttgagatttgaaggcttttggtctccctgggagtgggtggaggcagccaggcttacctgtacactgacttgagaccaggacacgaatgttca

SEQ ID NO: 604522 - DNA, 1421 bp, Homo sapiens
  misc_feature (200)..(200): n is a, c, g, or t
  misc_feature (436)..(436): n is a, c, g, or t
agtacactcgagtaacggggggcactaatcttcaactcctgaggcatacttcgccccatataataccgtagaaccgagagctgacctgcggatgtccgtggacgtttgatcggatctgacgtatgtactcccggaatagacagccccgcaattcgtagtaagtaacttacatcagcgagagacgtctgggcacgtgcatngaggcgtggtcccgcacgagttagggcgttaagagatacagatgtgcaggacttgccgcgggacggtcttaataccgagagagcgcactgttcgacctgacttatcgagcgggagcgcgaggggggtaatacctaacagtgtccacactgctcgtgtagacactcatatgtgagagctacaacctatcatgtattcacttgccccgagtgcggttctcttaaggaagtgtaaattntcccgcgcgtagagagacatttctcttggcagaactaagggggtcctccgtaattatataatcccacgtgagtgatgtcatctccctcgcgtgcatgaacctctccctacatgatggaggaccgaaaaaaacagagaaaacacacgacgcaacacacacacggaagcatcagacaacaaacaaagacgatataccaaagagaaacacaacacgccgcgcgcgaggcgcggcacgacgacccgcgagaaagagaggggtatacacccccccgcagggagggcgcggcgccccacacgagtgttagtcgacgcaacgcgcgctcaatacaggaggtggtgtcgacactcggcgggcacaacaaatagaggggcgcgcctcgtcgcatacaatatgagaggcgcagatggtgcacaagtttagaaaaggagacataagagaggcaacaaaaggcccccgggggggagacgagcgcgcacaatgtatatataaaaccacacaagggcgcagctccagaaacacgacaagggggagaggcaacaaacccccacgagggacgcaagacgagcacacgctgagaaaggacgacactcgtaaatgaggagaggcgacaaaagaacgtgtaaccacccaccgtgagaggaaataacgggagaaggggtagacgagaagcggacgaccacccaaccacgacgggggagggagacaaacacaccacgtgggagccaccacaacagccaaccatgtccactcataagaacaaccaacccccccttgccaaaaagcgcgagaaccaacccaagaccacagaaaaagacccttccccaccagaacgcgagaggcaccaaccaaataaagggcccgcttgcacacacaaacgtagcttaggccaaacgatgctgggccgaacgaccgacgagttcaccaacacaaaaatgaactatcagtcagctgcacaccaccggggggagaccaatgtgatcacacc

SEQ ID NO: 604523 - DNA, 920 bp, Homo sapiens
  misc_feature (433)..(433): n is a, c, g, or t
attgtgtttttttttttacaaaaatccattgtaaaaccattgtgctcgtgacggagaaaggtggtgggggggatggagcgtggcatggatatcaaagtccttccccccgacaaactagtgagctccccagctcgtgctccggggagacagcttcccaagaaagactcccattccttctccgggacatggaccccaggcgggtgagcccagtggccgtgaggcacatgctcacacacggtgagggaggcactgcccaggggatgccacgctgctcacaggtggcctgcaggatcccttgggacaggctgtattatggggcaagacatgcccaaaaccgggacgcagaggaatagccggggcctaacccgaagaggaagcgatggcggctccatagcggccctgtgctatgctctagggcacaagtggtggcgcncatcggggcggctgggcccccatatagtggaactagcgccaatgtgacagaccccggggggctccttggtggggcagcccggatatctgtcccccagcttcttcaaaggggggaaggtctccacggggcgccccagaggcagggtgttaccccccccgggttgtgttgcatgagcacgaccagccgtttgaccgcccggtggtacccctgtggcttggtgcccacccactgttagggaagcggcgccatccttacgcccttgtgagagcaatggtggccggctgtgccccccatatatagagggagcccagtgtggtcgttgtcgggggcatcccttattatagaggccccccgctgttgtttgcccgcctttgcaaggggggctcagaagggaatggggggctttggtcccttgttgtctgtggataggtacaccggggggtgccaccagtggggccccctacccccatgtggggcagcaagatat

SEQ ID NO: 604524 - DNA, 905 bp, Homo sapiens
gtgctccctgtgctacctggggacttctttgagtcctgagaagtcaacgtgcgcggttgctgcgtcctgccgctgctcccctggccctgaggcgatgtgatgaactgtgagctggtgtacatgccccactactgtgagtgagtgaccctgtgtgcccctgccataaggccccctggagctggccttcgctgcctactttttcaattggtgcctggcatcccaatttgctcctgtgcgccgttctcaacgtgtgcttgccagcattgttcgcttgtctcttgcttggcccttcattcttgttgacaggaaagttgtattcacaattgtactttattgttggagtgaccttatatatttttttctgaagttattgtacacggcttgacagttgccattttctttctagaatgtctcctttaatacctgaatttggtgtactttgcagcctaccatttttattgacgaggagtactgattacccagcagagaaacgtaacaaatcattcgggaactctttgatactacttaccttagggggaaacaaggtgattgttggtggtaagaagtgtttgggaagttccaatacaatttataatgtatatatcaacataattgaacatgtgacctttccagtcttgatgattttgcttgacaatttggttgtattgggattttatagacaaggattataaattgttcccataacatttggcacttttaattcgacttattgccttggtacatgacaacaagactgaacacgtgacagtccccagtgcttgatcgacacaaccccttggcaaattacccacttagggggactgaacggccccttcccgtttgtgcccaactttaatggacataaacgactcatgggggacgcacgaattttaccctaaatgtag

SEQ ID NO: 604525 - DNA, 149 bp, Homo sapiens
ttttttttttccgggggagggtttttttttaaaaaaaggttattggcctgggaatggccggggaatttttttcccgccagggaaggggaccttttgggttttaggtaactataatggggccctttttataaagaaatttggccttttga

SEQ ID NO: 604526 - DNA, 162 bp, Homo sapiens
agctgaagctccacgatgccctgcgatacgtgcacgtcactctccaccaccagcttagtccaacgcagaacttcccgacatcaggtagaagatgcgttcccaaacgagatttctttctttccttcgtggtaagcgttatcacaggcttacggggtaccgagc

SEQ ID NO: 604527 - DNA, 168 bp, Homo sapiens
cctcatccagtggagatggaaagtcaaatttccatgaattgctgtgtgtgtatggagcagtggccatgtgtattgcagaggctctactgcatggcgattctggatgagttccttgtaggcagtcgggcccggctaccactatgctacgggccactggatgagggcatg

SEQ ID NO: 604528 - DNA, 384 bp, Homo sapiens
cggctgctggagcaaactgtctccgcatccgatgctgatcagcaggccctccggaaccaagcgctgaatttatcactcgcctacagctatgacacgcctgtcacatctatggtaggcaccatacccgatgaccaagagcagtctcaagttgctgagaagcccatggaaggcgaaagtagatacaggaatgggcactcagctggagctgctggctcccggatgaatgtcagacctggggtgattagctccaggcagcttggactcctaggacctcctgatgttcctgaccatgctgctcaccacccattccgccgcctggccatctagcctgcttcagcaccatcagccacctttcctgatccagctgtgtgtcgtgacatgttg

SEQ ID NO: 604529 - DNA, 154 bp, Homo sapiens
cgtttcaagggagagagaactgcgagcgttggtaatgtgttaaggccgggagcggctaagctctgtgatagagcgtgtatcctctcgatcacatacagaagaggattgcacggagggagctctttgagcttctatgcatagcgagggaccactt

SEQ ID NO: 604530 - DNA, 259 bp, Homo sapiens
  misc_feature (37)..(37): n is a, c, g, or t
  misc_feature (175)..(175): n is a, c, g, or t
  misc_feature (186)..(186): n is a, c, g, or t
gacggctcaacggaactttaattaataataacatcantactgggtcatcaattgcaattaatctaccacatcaatgcaagatattaataggggaaactgcaagggggaggaaggtgagagggtttatgggagctctctgtattttcccttcagttttttctataaacctaaaatngctctaaaaantatcctatttaaaacaaacttttttttttttttttttttggggaataggatcttcgctcgtgccgccagaggg

SEQ ID NO: 604531 - DNA, 530 bp, Homo sapiens
  misc_feature (43)..(43): n is a, c, g, or t
  misc_feature (58)..(58): n is a, c, g, or t
  misc_feature (114)..(114): n is a, c, g, or t
atacacagataaatgaaggcttatggcttgattttaggtatanaaagttaatgtttanagacatccatttatccacctggataaacatggtcattattttttaaatcaaagtcncaagagctccatttcacaacctgaaactatttaaaatcatgttagaaaattaaatagtaagaaaatactagaaaaaatcagaagaatgagtagaatcatagagctacaataattaaaataggatggtttggggggaaagatcagtaagttagatcaatgaaattgcatagaaaagcaagaaattgattattatatttctatgggcacgtgaaaactgtggcatttctaatcacaggggaacttatagattataagataaaagacattaagcctattgggtaactagtttagagaaaagaaaattcagttacgatctgacctcaagaaaaaaatgtaaatagattaaatatgtatatgtaaaatcaaaaaaatcatgaatatataaataaaattcgataagtgtttctatatttcaa

SEQ ID NO: 604532 - DNA, 364 bp, Homo sapiens
cccaaggggacaagctgggaaaaatacagcagcttctcctacctaataagaagaaaatgagtatataaaaatgtactgcagtttggcccaggtgctcacgcctgtaatcccaacaccttgggagaccaaagtcgggggatagcttgagcccaggagttcgagaccatcctgggcaacatgtcaagaccccatctctacaaaagaaaaaaattttttttaattagcccaggtgtggtggcacacctgtagtctgaactactcggaaggctgagctgggaggatcgcttgaacacgggagggagaggctgcagtgagccaagatcacaccactgtgctccagcctgggcgacagagcaagacactg

SEQ ID NO: 604533 - DNA, 304 bp, Homo sapiens
gtctctatgattttgactatgctcaagtactttataagtggaatcatacaatattttttgtgtgtaactggcttacttcatctagcataatatccctaagggtcatccatattgtaatgtctgaaaatttttttgtttttttaaggctgaataatatttcattgtatgtatatgccacatttggcttatccatttattcactgatgaacactgattgtttccatattgtgtgtgtgtatgtgtgtgtgtgtgtgtgtgtgtgtgtgtgtgtgtgtatggtttttttttggagacaacgggacac

SEQ ID NO: 604534 - DNA, 181 bp, Homo sapiens
ttgagcttaggtggagctggttttcctttatagaccagaatatattctcctgcttgccatagggaaattacatgctattttatacacacttatatattactttctacacccagtatctaacttgatatttagcccttgttctatatagacaaaggtattgcatttgcccattttaccatca

SEQ ID NO: 604535 - DNA, 925 bp, Homo sapiens
  misc_feature (5)..(5): n is a, c, g, or t
  misc_feature (124)..(124): n is a, c, g, or t
  misc_feature (208)..(208): n is a, c, g, or t
  misc_feature (213)..(213): n is a, c, g, or t
  misc_feature (404)..(404): n is a, c, g, or t
  misc_feature (424)..(424): n is a, c, g, or t
  misc_feature (426)..(426): n is a, c, g, or t
  misc_feature (496)..(496): n is a, c, g, or t
  misc_feature (503)..(503): n is a, c, g, or t
  misc_feature (524)..(524): n is a, c, g, or t
  misc_feature (582)..(582): n is a, c, g, or t
  misc_feature (584)..(584): n is a, c, g, or t
  misc_feature (602)..(602): n is a, c, g, or t
  misc_feature (651)..(651): n is a, c, g, or t
  misc_feature (693)..(693): n is a, c, g, or t
  misc_feature (700)..(700): n is a, c, g, or t
  misc_feature (720)..(720): n is a, c, g, or t
  misc_feature (812)..(812): n is a, c, g, or t
  misc_feature (843)..(843): n is a, c, g, or t
  misc_feature (854)..(854): n is a, c, g, or t
  misc_feature (864)..(864): n is a, c, g, or t
  misc_feature (867)..(867): n is a, c, g, or t
  misc_feature (876)..(876): n is a, c, g, or t
  misc_feature (899)..(899): n is a, c, g, or t
  misc_feature (901)..(901): n is a, c, g, or t
  misc_feature (908)..(908): n is a, c, g, or t
  misc_feature (925)..(925): n is a, c, g, or t
atacnaaagaatagaaaaactttacataaaaatatgtcaattttagcttccatattgttgtgcacacacaaaaaaatcgaaacatgatatctttttgttaaacctgtagcacgcgaccacagtngtagcaaggtcaatacatttgctttatcatgatggaaatggaacatggtatctgtatttattaattgagtgttaaaatgcacancccangggaaatgcactgccagaaccgtagtggtttccttaatgtgggtgtacagtgaatattgctaatgcgtagagattagtacaggtctacagatcagtttttataaatattctttatcaataggttcacaatttaaatattttaaatatttttgataactttgggtcattgagaactgcagaaacagtgtgcnaatatattctggaatgcctncnagagaacctgcagtggcagctgaaagcgcccaatgaaagattaagcaagtactgcttcaaaagggcagancgcaganattttaaagcttgttcttgcngggcgtggatgaaatttagagatcaatctagaactccccactgctgcacatgcataanangtgatggtaataagtatnttgtgttgacattatccactagtggacttcaaagaccaacctacctgtngtgtttagcaagaacagatccccgttttaaaaacaggaagtnagaaggnctatgagaagcaaccaactnccaggacaactgttgtgctccaaaaactcagggttaggcaggatggatatattcttgttcaaaaaaaggtaacaaagaaagtagttgttgtngcagaatacacttgcatagtatacctgtttnctttcgacgtngggcgccacngtnccggccccnacgctgggctgttctcttctgcnanaagatcngttaaaacactacccan

SEQ ID NO: 604536 - DNA, 188 bp, Homo sapiens
cccgacgagacacgtacaagtagcaggttcaggcagggtgcatggtggctcatgcatggtggggctgctgcggctcttgttttttttgtgcattcttcgatactggcccatttgggcacccccgccggttcgcgggggcaggcctcctcgggagaggagggtggatggacttcagggtgttcgtcatg

SEQ ID NO: 604537 - DNA, 113 bp, Homo sapiens
gggagacgggcagcaagagagaaggaggtccagacagtgagggcaggagggtagagaagagacgcagaaggagagcgagccagagagaaagtggttcttgtatttgaagggag

SEQ ID NO: 604538 - DNA, 140 bp, Homo sapiens
cccactccaccttactaccagacaaccttagccagaccatttacccagatagagtataggcgatagagattggaacctggcgcaatagatatagtacccctaggggaagatgggaaattatgaccgagcataatttagcg

SEQ ID NO: 604539 - DNA, 296 bp, Homo sapiens
gaggttgcggttcggtccctggccttgctcagtgggttaatgatccagcgttgctgtgacctgtggtgtaggttgcagacgtggctcagatactgagttgctgtgactctggcataggccggtggctacagttccgatttgacccctagcctgggaacctccatatgccacgggagcagccctagaaaagacaaaaagacaaaaaaaaaagataaaataaatcagcgtgtcaaccggtgatctaggattacccacattttattaaaattagcgtgattgggagaagtcccattcca

SEQ ID NO: 604540 - DNA, 121 bp, Homo sapiens
tcttgagtatcccctgctgtgggctttgaggtgcttgttatttaaccctccagcaagcgtatgctattctccgggagaggaaatggcacccaggaaggctaagggaagcctaagttgtcac

SEQ ID NO: 604541 - DNA, 563 bp, Homo sapiens
tgtcctcctgctgctctggggggcatgtggccctgacctgagacctgggcctggctcccactccatgaggtatttctacacctgccagtgtccctggccctggcctgcggtggatgcccctgcttcatttgcatgtgtgtgctactgtgtgactgacacccatgtatcgtgatgtgttctgacatgctgactgcctgctgatgtcctgagtgactggagcccctgtggctgccactggatatgatgcatggaaggtggcctggatgtatttgggacctggaacacacatgatcttcaagaccaacacacaggacttacctgagagaacctgctggatctgcgctccgctactacaaccagagctgaggccgggtctcacacttggcagacgatgtatggctgcgacgtgtgggccggactgtggcgcctcctccgcgggcataaccagtacgcctacgacggcaaagattacatcgccctgaacgaggacctgagctcctggaccgctggcggacaccgcggctcagatcacccagcgcaagtgggaggcggcccgtgaggcg

SEQ ID NO: 604542 - DNA, 1251 bp, Homo sapiens
atcatgaacgagaccgttacttatcctgtactagaaagttcactgagcaaaccgtactatgttcaggagagaagacatagactggtcattgaatgttccttacaccccggtgaagtgcgcacaggtgcctaaccacgagaaattcgggagaagaactagccaataattgtacaaggactcgatcgaccgcgcatgtctagtccttgtgctatttgggcattcacgcataggctcaattctcgggtgcgtggcacacgtagctaatcatgtgctgtcggcgatgactgttgatgggagtttgcccctgggagttatcgccatagatggagagaagaattggcaatcgcccaacagctagtagcacgtatgccacagaactagtgggccttgtaagtagagcacagcatagaagagtacctccaagtaacacgccaatggagacagggaacgccagagatgcagacatgacatcacagaggtcatgtggtggaacgtggaccaatggggccaagtcgtctagtgttgcctccgagcatagacatgggatgatgcctggacgaccttggactcacgagccagaacggtagtataaggtgtgctggcaatgtgacttcgtgtaagcactgtgtgccagctggtcgggatttgtttcgcgacatgatactattcaatcacacgtgaccacacatttctaacatcaaacaaatcgaagcagcagcttgacggagccccaactgcgagggcagcgcaagcctgggaagcttacctgggcaggggatccagcccttaaccagtggggcctagggggattggcaggtggcatggggggcgcaggctgggttggccacctcccaagtggacatgtcgacgtaacataacttcaaccccctggaagggcttggctggaagcataaacaggggcatggcacgaagcaccaagcaagagaagtccccttccaatgaaaacacaaagcggcgattaggtagcttagacaccaaggaagcgaacacgtggccaacaaacagggagaagtgtaataaccccaccaagggaccacgaggcacaactgggggcccattctggccccagcacatgagtggagccctgaacagggtggctaaaaccccggattagacccacgcaagaagaaacggggtcgaacaccatagaaaaccaaaacaatgaacaaaaccgcggaggaaaacacacccaaggtatacaaacaacacaggacactatcaacaaactgc

SEQ ID NO: 604543 - DNA, 144 bp, Homo sapiens
cggtgaggttgtctagtcacgctcggagccatgccgtccaagcgtacgctgcagtcggtgcaggtctcggacgcaagaagacagcgacactttggcgcactgcaaacgcggcaatggtctcattaaggtgaccgggccggccct

SEQ ID NO: 604544 - DNA, 934 bp, Homo sapiens
tgggggataactattttagcaaataaatatatttctaaacataggtgccgtgattcaagcgtcgtgtcgggtccagatataaatacccagtgtgggtacctagggtgctagtctccccactaacgttgagggaaaagaggtctcccagggtggggtcctcgtgcccacttggccaccacattccacattcccaaaggggaataagtgccgtgaggggccaagaaggtggctcaggcgtgcccgtggggctgaagtgtcacccgtgagtgaggcccactcagcctctggctccacttcagcctgaaggccaaacttggtgtgcctcataatctcacacttctctcccgtgtgtgggtctccctgtgcgcctgtgtatagtgcgcttaatacgtggggaagcgtgggcccctcgtggcgcgtgctcccaaacccagaggggctccacacttctggcctttcccccttgtggtgagatccccccaatatctctcccgagtctctgtggcgcctcctaagagaaaacaacacagcgtgttctccgcgagagagaaaaagacacactgtcttgtgtgagtagagactaccccccgcggactttccgaaccgcgtggtattaaaccttgccgtggggcctatatattatcataacgccctcttcgaatacacccccatgctccccttgatccccactctgagcagccccccgagaaaacttacaggaggcctccccaagacatacaaggacaagagcatgtcgaccccgatccgcagatgtaataccatacccctctcctctcggtggggacacccccagcaggcccaagagcagaagaaacatcctcgggctcgtagaaaacacccccccggggagcagagggtggtgggccagaaattgtggaccaggggggaaacacccggaggagacaactctccc

SEQ ID NO: 604545 - DNA, 443 bp, Homo sapiens
tgaagatccccacgactgtcacaggttgcaggtggctcgtggcctgtaaccccatgcattattggcgaggctgaggctggcagatcacttatttccaggtagttcaaagccatcctggtcaacattgtgaaaccctgtctctactaaaaatataaaaattagccaggcgtggtcgtgcacacctgtaatcccagctactcgggaggctgaggcaggagaattgcttgagccctggaggcggacgtttcagtgagctaagatctcgccactgcactccagcctgagcaacagagcgagactttgtctcttaaaagaaagaacggggtttaaaaaatatttggggccgtttccttagggggcctttttttccggctttagagaaaattaggccctccttatggtgtacctttaaagccctggccaacggtcggggtcccgagctc

SEQ ID NO: 604546 - DNA, 429 bp, Homo sapiens
gttgcttcacgatacaactatattctatataaggtacaactctatatgtcagtattttaaagaaatggatccttacaagaccaaaataacccacaggccatgaggttggtttttcctttttttttttttttttggttaaaccaattgtgccccaggattttccaacaggacaagtctgccataatgtttgaaagcgtgcgttgcgcaatactcccacattaagaacccagcgaagggttcactctagcacagagggtggaagccatcctaattaaccaactcgggtacctctcacgacaggcgtgattggcagcttcaaaggtgcccattaaggttcctttttccttgatgaccagagggcccactttgtccccgagtctctcgttatgttgggtgtgagccccatccaagatgtgaaactttggggcc

SEQ ID NO: 604547 - DNA, 198 bp, Homo sapiens
agtgactagtcacagatctattcaatttgacgtggctaacagcactgtgtacaaacttatgattatcatccaaccaggactgccactatctactgaagtctgatgatagaaccagagtcactggtgtttgaagctatggcaagggctcagaactcaggcagatctacaacttctcactgtagaggaccttgtatgtgg

SEQ ID NO: 604548 - DNA, 1050 bp, Homo sapiens
ccgcccccgctgttgaaacagagaaagcacaacgccacccacaggagagtgtacgtcgtacaaggttctcccccgcgcctgccgtgggcgtccccgacaaacccgcccttttgcgccagaagcgatgtcggcctgtaaaacagcgggcctctcccatttctggcgcggccctcgggcaccaaccacaaggcgaccccccggggtccgaatcctttgatggaagttagaatgagaaagaccaccacggaaaagtagtgggccagacagaccaggtagcagcgaagttgcaccaagagggagcgatttgccagtcaaagaccttgaagtatccccgtgaatgggagaggaagacaacaatgggaccgcgttgggaaaccctggagcccatttctccggaacgccaagaaccgaagtggaaagaaaaagagcccataaaggagctagaaagaatggttaacgccgagcaccaggacgagcgcagctgaccagcaacaacccgagaggccggaccatccgggccacccagaagaagccctttgtgagaatagaccattgacgagttgctgcccccaggccactggaattgggaaccgggtggccccggcttgtgtgactttaacaccccaagtgtttagccaagccaggcccgaagatagtgctccccgccatagcggcgtccaattccgtcgatacgtccctgccagccaggcccccgctggtgccactgagagagccccccctgtgggagaaccacatgaccatctcgccaataatttttaatcctactccacgtcagagcgtcttcaccagtccattgggattaattatgtgtggagtgtctttttggaccccaacccgttttgtcgtttagaagttgttccattggtttggtggattcgccatgtttcccttccctcaactgtgttttccctggcattcagagaggagggagaggaggaagaggaaagggagggaagcttcccccgagtagcctccacctgtgcttctgtgccattattctgagaataaatttctgtttccaactgtatt

SEQ ID NO: 604549 - DNA, 245 bp, Homo sapiens
catgaaaagaacaagaaaacaagaaaaaaagaacatgtgctactgcaagagaagggagcagtctctctcttaggaggtgacattagcagctgaagacttgctggatgcagagtctgccatctgaggaactgtgggaagaggccctgaggctggacacagctggatatgtctatggggtaggacgaaggtctctgcacctggagtaccaatgagcaaggggaaaggtggcgtgcgatgtgaactga

SEQ ID NO: 604550 - DNA, 1073 bp, Homo sapiens
  misc_feature (38)..(38): n is a, c, g, or t
gctataggaatcctagctaactttaagcctaagcatcnatgaatcatgtaactctgcattccaaagggtggcatggatctaactgtctcctctgactgcctcggtggatgctgcgaggcagctcgagaggcctagctatctcgataaccatatgcggtcgatagtgaagtgcatgcgtagctccgtcgactatcttatgtaataagaccatatttctagaataatgatgacgaccgtctaaatctctctccgagcctcttaatcaaatacattacagatgcatccgtcgttgattatcatccatgcctgtcaatgacgcgcgtaggctcgagtagagtagtcgattggtactcgtccgacaagcttgatcagagatcgccacgagaagacctatttcagagacgatttccagaaggcgcgagaggttcgcggagacgtaagtttctgcatggcttcgatcattggatgtcacagctcagatggcggccagtggcagtgcctagtacgaccactagtcaggatttcccgacacatgcatggatcttgtacatggaacaaacttcattgacgcattcactccatcttactctagggtacatcaaggaataatgatggccatttctgtaggcgcctcataggtcggtaacgggaaatactaatacgttgtcgtgcaaggtcatcttgtacctatgttaaaaacgttcgcggtaacgtgcttgatatatcagagggcatgcttaaaattaaccttcgcattccgaagggcccgaacaaactacaatacacgctcctatgaaaaaaacttttcgtagcgcccttcgacgcgtaaggcattaccgttagtttttgaccagtggtcttcccagtaggccgagttacagagtcctcaccaaggagtttccccccgtcaaaagggcaaaaaaaagagggtactcccagagggagaaacacgcagcgggcggaatttagtagggggggggcgggaaagctctccacggaagaaaatttatcagcacacgcggggctggaatacgaggaggggcgtgtgccacccaaatcagcacagggaaggt

SEQ ID NO: 604551 - DNA, 841 bp, Homo sapiens
  misc_feature (16)..(16): n is a, c, g, or t
  misc_feature (63)..(63): n is a, c, g, or t
  misc_feature (75)..(76): n is a, c, g, or t
  misc_feature (78)..(78): n is a, c, g, or t
  misc_feature (162)..(162): n is a, c, g, or t
  misc_feature (182)..(182): n is a, c, g, or t
  misc_feature (190)..(191): n is a, c, g, or t
  misc_feature (198)..(198): n is a, c, g, or t
  misc_feature (212)..(212): n is a, c, g, or t
  misc_feature (215)..(215): n is a, c, g, or t
  misc_feature (222)..(222): n is a, c, g, or t
  misc_feature (226)..(226): n is a, c, g, or t
  misc_feature (246)..(246): n is a, c, g, or t
  misc_feature (287)..(287): n is a, c, g, or t
  misc_feature (316)..(316): n is a, c, g, or t
  misc_feature (329)..(329): n is a, c, g, or t
  misc_feature (345)..(345): n is a, c, g, or t
  misc_feature (369)..(369): n is a, c, g, or t
  misc_feature (415)..(416): n is a, c, g, or t
  misc_feature (478)..(478): n is a, c, g, or t
  misc_feature (543)..(543): n is a, c, g, or t
  misc_feature (583)..(583): n is a, c, g, or t
  misc_feature (599)..(599): n is a, c, g, or t
  misc_feature (754)..(754): n is a, c, g, or t
  misc_feature (806)..(806): n is a, c, g, or t
agaactgttttcttangaagagctaggaactacaaatgtcatttagtaatgcattgaaatganattacctagagnnantatagcacagaaacttcaggtcacttcttctggatctattattttggataagcttccactatcatagcatggccctgccctccngccgcccacgcagccactangccatacnngcctccntctttccgtcatcngtnggccgcngccntgaccaacctgcagccagtngctccaaatgggtgtcccagggccagagatccccccccgtnattaaacttctcccaaggcggcaatcccnccttggtttttcnccccctgtagttttcngccaacccctccgaatccctggcnttaaaatttgcccccatctgccccgcgacagcttcctgcaattccnnagcctccctctccttcatggtccctcctgccttttctagcccttttggcgtcgcctcatgtnggtccccgtcctcgttgctcttttggctcctgcgccccctccctcaaatccctccaatctgcctncggcttctcccccctggcccgccgccttttcctccgcccngcttccccttgccgcngccccctccgtcccgcccccgccagaatttgcagctgtcactgtgccgtaggccttgatgaatgcaggttttagtttggccatctgctccagtgaggaaggacggatgccattatctttggtaactgtatcttttcctggtactttgaagggtancacatcagaaaggagtccttcatcctgtgccttcttggctagactgtgagancgccgtgcataattcatcctgttccagccgagaaa

SEQ ID NO: 604552 - DNA, 277 bp, Homo sapiens
tgggtaaacccattttttttaaaaccccgaaattcctgggggggggcctttattctggaaccccttgaaaaatcaattttttccaaaatgtttttgggttaaaagctttttttttgggtacaaaaaaaaaattcccccttttggcgtttttttaaggtaaacccggcccgaaattttttgaacccgggggaacccctttttttaaaaggggccccccccggggggaaccccaatttttgttcccttttagggggggtaattttaaacttggggaaaa

SEQ ID NO: 604553 - DNA, 102 bp, Homo sapiens
gacggtgtctgtgctcctttctgctgcttgagtttttaaaatcgagactcagaatgctttcccatgccctgaatgcacctctctgtacaaacaccgtcgaag

SEQ ID NO: 604554 - DNA, 229 bp, Homo sapiens
aggattacggcagctatccggttcactttcatatggttttacaaatgacagtaatcttaagtaggttttaaaaattcaactcttaggcccaggtgtatggctcacacctgtaatcccagcactctgggaggccgagagaggattgcttgagtccaggaggtcaaggctgcggtgagctgtgatcacaccactgcactccagcttgggtgacagagcgagactccgtctc

SEQ ID NO: 604555 - DNA, 1038 bp, Homo sapiens
  misc_feature (85)..(85): n is a, c, g, or t
  misc_feature (111)..(112): n is a, c, g, or t
  misc_feature (118)..(121): n is a, c, g, or t
  misc_feature (134)..(134): n is a, c, g, or t
  misc_feature (136)..(136): n is a, c, g, or t
  misc_feature (141)..(142): n is a, c, g, or t
  misc_feature (145)..(145): n is a, c, g, or t
  misc_feature (164)..(164): n is a, c, g, or t
  misc_feature (441)..(441): n is a, c, g, or t
  misc_feature (454)..(454): n is a, c, g, or t
  misc_feature (490)..(490): n is a, c, g, or t
  misc_feature (522)..(522): n is a, c, g, or t
  misc_feature (546)..(546): n is a, c, g, or t
  misc_feature (564)..(564): n is a, c, g, or t
  misc_feature (582)..(582): n is a, c, g, or t
  misc_feature (597)..(597): n is a, c, g, or t
  misc_feature (711)..(711): n is a, c, g, or t
gctcgactgaggtttccttattcatcctctagtagttagctctgcagcagcctcctcttccagttcttcctcctcttcctctgcntcccccttcccagcttcccaggcatnnccagcnnnncccactctttccntnccccnncangcctctctgtctccaatcngcccccaagtatactcagccttctctcccatcccaggctgtgtggagccaggtcccccaccacctcctccctatggccgcctcttagccaacagcaatgcccatccaggccccttccctccctctactggggcccagtccaccgcccacccaccagtctcaacacatcacacatcaccaccagcaacagcaacagcagcagcagcagcagcagcagcagcagcagcagcagcagcagcagcagcagcagacagcagcagcatcacggaaactctggngccccctcctccntggagcatttccccacccactggagggcggtagctnccaccacgcacacccttacgccatgtctcccntccctggggtctctgaggccctanccaccagggccagcacanctgcccccacctcacagncaggtgtcctacagncaagcaggccccaatggcctccagtctcttcctcttccaactcttcctcttccacttctcaagggtcctacccatgttcacacccctccccttcccagggccctcaaggggcgncctacccttaccatcggtgactacggaacaccagctcttcggctaccttacaaggaacatgcaaccgtggcttccatcgccagcacggctacgagaggcctcaccacctgggcccaacgtacggcaaagagagcccgtaccgggggactacaaacagccgcacgagcagaatacaagccgggtcgctcctcatcggaaggcgcaccacgggcaacgagcgacccccaccgcgccggactgaggcagcccgcacgggactggccgcaacgggcctcaggtcaccgccccactgccccgccggcgcgaaccaaaagcgtaatacacaac

SEQ ID NO: 604556 - DNA, 136 bp, Homo sapiens
tcgagctcggtaccggctctttgtgcagctggaagtagatcaacttcttagaaagcaaaagggctgtgttgttgtcactctccaggagccccaccacgcgccacacgaagagccaccccatgcgccacccgatgcg

SEQ ID NO: 604557 - DNA, 1064 bp, Homo sapiens
  misc_feature (85)..(85): n is a, c, g, or t
  misc_feature (111)..(112): n is a, c, g, or t
  misc_feature (118)..(121): n is a, c, g, or t
  misc_feature (134)..(134): n is a, c, g, or t
  misc_feature (136)..(136): n is a, c, g, or t
  misc_feature (141)..(142): n is a, c, g, or t
  misc_feature (145)..(145): n is a, c, g, or t
  misc_feature (164)..(164): n is a, c, g, or t
gctcgactgaggtttccttattcatcctctagtagttagctctgcagcagcctcctcttccagttcttcctcctcttcctctgcntcccccttcccagcttcccaggcatnnccagcnnnncccactctttccntnccccnncangcctctctgtctccaatcngcccccaagtatactcagccttctctcccatcccaggctgtgtggagccaggtcccccaccacctcctccctatggccgcctcttagccaacagcaatgcccatccaggccccttccctccctctactggggcccagtccaccgcccacccaccagtctcaacacatcacacatcaccaccagcaacagcaacagcagcagcagcagcagcagcagcagaatcacggacacacctggcaccccctcctcctggcaccatcgccacccacacacctggaagggacggaaagcatcccacaaccacgcacacgcacttcacgcccagagccatcacccgtccccatacaggctctactgaacagcccctaaccacaccagcgaccacgaccaccaccctgacccccaccatccaccagcacagagatgtcacctacacgcaccatgacaggaccccacactgcacgctcacacaaccaccaacccacacaccacacactcctgaccccacataccacacacaccacagcaaccaccacaccccaaggcacaccacaaccccaccccactacccacagcccccccaaccagagacccaccggacccgatcgccccgcccgatgtcccctccccgatcaccaactagtacaccgcacacacccccatccagcgagacactgaccacgagcaacacccacacccccagcgaggacaacaacaccggacatcgcgtctccctgcaaccgccaacgcaccagcaacgcaacacagcagacagagagcgccacacaccacgcactacccggcaagcgaccagcctctccccacacgcactaactgctcctgacccccaaccacagcaaccctgagcagtacggccaaacaagcccagcagagcgtcac

SEQ ID NO: 604558 - DNA, 352 bp, Homo sapiens
taaacagcggcttcgatacaaggtcaaatctaaacaagttctacaatccagtgctgatatcagataccatgcttcaagtgacaatttcttttctgaagggttattccagtttcgtgaagggtagcatgagggtggtgttgcctttggcaggggccaatttctattctcaattaacccatggaggaaatggtacgcatttggtgagtccggttaaaagcatttgggggtggacgatggagggggcccgaatcgtcgtactcctggttggctaatccacattttggtggaagggtggacaggtgagggcaggatggagccaccgatccaaaccgagtacttgcgctccgggggt

SEQ ID NO: 604559 - DNA, 887 bp, Homo sapiens
  misc_feature (135)..(135): n is a, c, g, or t
  misc_feature (218)..(218): n is a, c, g, or t
acatacccagggccaaccacctattcctcattgtatgcaatctaatcgcaatggtatgcctaatgctgttactcggaaccgaaaaataatatactaggcttgtgataacatagtatcgacaagagtgactcccanagggtttgttaggactcacttgtaagggccagatctaaaataatctgtatcgattgtagcggcactagttgaaaaaagtactntacaacacgaagagtagggccacgctaattacacacgactacagttggagatcatttatcgctgctaacatgcatcgtcccgtagcttagggtcatacgatccggcctcatttcgttatttatgtagagctccgtcctcgtacgcaagggatattcgccacaaaacaccctgtgttctaaacttcaatccataaggccgctcggatccataatagcttaagactggtcattttaaggcacctcagctcgggtaaattaccatctaaataacatcctagattagtgagcgtagctgttattggctatttcatccaaaaatatttttggctccacttgtgatttcggccagactataggaagacgaaagttgtaatccctaacaaagggtatatcttcagttatggaatcggtacaaccacgtaacgtcacattaccgatacaccaaatctcctaccattttctaattatctcaccatatacgatcgagaggccccatttttatgccacctttgtaccaacaacctttttataaatggccttatattccaatattgaaaacaggtcctggttgggaattggtcttccctggaaccggttactccttgaaacacctttatggtgtacgccagtgaacattacgtggatttataaccttgggcggtccccttg

SEQ ID NO: 604560 - DNA, 232 bp, Homo sapiens
agcagctcatagcaattcataaagttgcatcaggcaaatatcatgcaaccatttcatgccatcactttgcatcaaatgcaaatggaaaatttctgaaaaaaacaagtccatcaaaactaacacaagacaggcagataaaatcattaatagccctatgtctactcaaagcacttgaatttgtaatttcaatttgtacctttcctgcaaagcaaatttctgtgcccatttcaag

SEQ ID NO: 604561 - DNA, 167 bp, Homo sapiens
  misc_feature (19)..(19): n is a, c, g, or t
  misc_feature (46)..(46): n is a, c, g, or t
  misc_feature (93)..(93): n is a, c, g, or t
  misc_feature (95)..(95): n is a, c, g, or t
  misc_feature (112)..(112): n is a, c, g, or t
  misc_feature (125)..(126): n is a, c, g, or t
actttttaaaactatttantgatgtaatgtatcagagaaactaganctagttactagattacaagcacgagtccatttcacaacacaagttgnanattactacatgagacantattttgccacanngacacgcacggtcaagcattggacaaattatatagatatta

SEQ ID NO: 604562 - DNA, 228 bp, Homo sapiens
cagctcggtcccggagcacactgcacaactgcaacatcttctctttgtcatataaaaagtaattgaggccgggcgaggctgctcatacctgtaatcccagcagtttgggaggccaaggcaggaggatgactttagctcagaagttcgagaccaggctgggcaaaaatagtgagaccccatcactacaaaaaaaaaaattagtcccagctactggggaggctgaggtgg

SEQ ID NO: 604563 - DNA, 375 bp, Homo sapiens
aggccgccctgtcatcagcacattcaagcagatctccgtggcggcattccgtgtgcactttggtaagatctgtcactaccttgacaacttctgcaaactcagctttggaatattggagcctggcacacttgagtctctgtttggcagaggagcgccttccattcatcccgaagttcatcgagctttggccacaggcaggcagcttatatcagcagcttgccaccattctttaaaagcagctttatctttttagcaaagaaaaggagttccgggccataaaagtaagaatgtcttctggcaatctcatataagtattttttcaaaaatgtctcttcagtgtcatgaagcgcagtgcacatcacatcactctctgct

SEQ ID NO: 604564 - DNA, 474 bp, Homo sapiens
cgtgcagctgaatctgttgtctctggctcctgcgagttcgccgtgtatcattggcatagtgcacttaggcttccttctgactgttcgttcaggggtcggtgagccggcatgggacaagccggcgcgtgctcctggatcaatcaccacccgagtctgtacatctagataccagtgacaatattccctatggctctatagaggcagagagtcacaaatgggaaatcaaaagctcctagaagcttcacaagtaggggcacaactcctgtttacaacaacatgccaatacgtacatttggaccatcagtacggtaggaaataacccaacaagtatcatgctaacacttctggatacatcatagatgccgagagccgaactacggtaggacgaatctgctcaacagcatctatcgcgggtgcaggcttcttgtagcggcaaagattagaaagtgtccacgagtaagattacgtaagtag

SEQ ID NO: 604565 - DNA, 688 bp, Homo sapiens
ggtctcaacggcactttcgttgcctattcgggtgatcttactaattggctcaactgtcaggtcatgggctgctttaagtggctccacaagtgtagtgtgtgcctactctgccaatctcgttggtggcacattcattcactgggtcctataggctcctccactatctgttccctctctgttggcgtcaggaaggctttaccttgtgtggggtatactcatacggaattcggacaatgccctctcaacatccttggtcccacaatttgcaacgggtagatcaggccacagcatgctgcgcatctatgctgcttggtatctgcactcaattccactgcaaccacaggggctacatggcactcgtctctctgcacctggtgcactaatgaagtctgctcatgatgtgcatggtactcgattgatctgcatacacactctagccacaggggctgacacttgccacccttgggcaacattcgcacaaggccaccatttgatgcacattgtctaagacactacagctacctgatcccctcgacctcgtggaaggtagactgtattcacacaagtctccctatcaggagttcactgaccaccatcgtcaagacccacaccagagtctccgtgcagcggatatcaggctgccagctgtggctacaacatatcaaccgtaggcagaatcttggtttgc

SEQ ID NO: 604566 - DNA, 1239 bp, Homo sapiens
atttcggcgtgaagtctcgatggccacgccattccgcccgcgccgataaagttgttggtgtgggtgtccttgtcgaagaacgccttgatggtgcccatgttctggtaggcgaagttgcggcctaccacaccctcgttggtaatcgggtcgtagggtttgccgatgccggacagcagcatcaggcgcacgttatggaactggaaggcgccaagaatcaccaggtcagccggttgttcacactcgcggccctgggcgtcgatgtaggtcacgccggtggctttcttcttggtgctgtcgaggttgaccttgagcacgtgggaattgggccgcagctcgaagttgggcacctggcgcaaggccggcaggatgttcacgttcggcgaagccttggagtacatgtagcacacgtagccactgcaaaacccgcagaagttgcacgggcccatctgcgcaccgtaggggttggtgtacggccccgacgtattggccgaaggcaggttgtaaggtttgtaacctacgtcggtcgccgctttctgaaacagctgggcggagacagtatttttctgcgcctccagcgggaacgggttggagcgatccggcgcgtaggggttgccgccacggccttcaccgaccagttggcccttgaccgtccaggcttggccggaggtgccaaagactttttccgcatagtcgaaaaacggctccagctcttcgtagctgacgccgaagtcctggatggtcatgtccttgggaatgaagttcttcccgtagcgctcttcgtaatggctgcgcatgcgcagctcaatcgggtcgacgcgaaaatgcacgcccgaccagtgcaaccccgcaccaccaacgccattgcccggcaagaacgcgcccaactgacgattgggcagggcgacgtcattcacgctgtggcgaatggtcaccgtttctttggagatgtcctggaacagcttcttacgcacgctgtaggtcaattcgtcgatgacctggggatagtgactcaggtggtgtgcacaccacctgagtccccctataccacaaggcctggagacggagcccgggcaatcccttgtctacgtggggctttcattacatcgtcaaattttataagtaagatcacactagtagacgctgataacaggcaaagtgagggaggtgatgacagagggtatgagcgggtgtcggacccatcgggggggcgaggggggcccggggagccgcggaacggcg

SEQ ID NO: 604567 - DNA, 672 bp, Homo sapiens
ttcgtagcaccggtcagtcttctgcctgccctgtcttggctgctccagacccagggcagagaagcagctcccagccctcatcagccatctgctcagcccctgccaccctgacccccaggtccccacactgccagccgtaccgcccagctccccactccagagctgcactcctcagtctctcaccccgtagcacatgtccccagtactcacaccaggctcttgtgatcaggccccagaaacctagcctgtagttcaaggagtttgtagtggtttgccctgcatgaatctgtcgccttttcccagtgaccggagctaccaggggatcccatggagccctgctctgtctgggtgagcatagtccccttctgcaggctggacgggtacgaacaagtgaacgccatgaggtacgagctggcgagtggatgcgactggtgtagcctttggagtggagtcaggggtccgttgttagcctcttccccagacaccaataaccctttcaggaacacccctaaatgaggcatcgtgatggttctgccttccatgtatgagtatgagccaccctgcacgtccctctgtgctcggatccaagctgtcaggcattcctccccagactcatggcctgggacttgcactttctgatggatgcacagccagggtctgagccaactccga

SEQ ID NO: 604568 - DNA, 371 bp, Homo sapiens
  misc_feature (334)..(334): n is a, c, g, or t
gcacgagcctatctgcatatttcgttgttagcaccatccctcatcccggtgggcttggaactttccatcaattctttcctgtctcgtttctctttcatcctttgcctggttgtgcctgtctcagggagaaatcagtcacctgcaggccttgcagggctcttaggctctgggaaatttgtcatacgggtgtcaggtacttcttattgctgtccaaagggaaaaaaaaaagtgagacaaagaactctcccggacctttccggctgcactcagaggctctcgagaggtgcagaaggacctggaaaggcagctaaataaaagatgccctgggcgaagnccaacctggctgttgctcgccttcctgctggtgtttt

SEQ ID NO: 604569 - DNA, 901 bp, Homo sapiens
  misc_feature (126)..(126): n is a, c, g, or t
  misc_feature (283)..(283): n is a, c, g, or t
  misc_feature (404)..(404): n is a, c, g, or t
  misc_feature (417)..(417): n is a, c, g, or t
  misc_feature (499)..(499): n is a, c, g, or t
  misc_feature (530)..(530): n is a, c, g, or t
  misc_feature (556)..(556): n is a, c, g, or t
  misc_feature (576)..(576): n is a, c, g, or t
  misc_feature (636)..(636): n is a, c, g, or t
  misc_feature (638)..(638): n is a, c, g, or t
  misc_feature (665)..(665): n is a, c, g, or t
  misc_feature (705)..(705): n is a, c, g, or t
  misc_feature (797)..(797): n is a, c, g, or t
  misc_feature (855)..(855): n is a, c, g, or t
gaccttcccgtgggcaacctcctgctcctcatagtggccatcctagtctcgaggggttaccgaatcgctaaacgaagcaaggggattgctacgtctgatttccctgctctctctgcaggtccccanatgtctgctaaggacacttatagtggcattactcatctgctcgtctcgactcgcaatgcctattaatactcatataagcctatctgcatgcctcttactatacccaagtctactctctatccgattcgaccacgcgtacataatctatccaacccgngcccccgtacacttctacgacattctacaatcgcattacagacttacatatgcttaacttagttgatattcccacaataccacgcaataattctaacacctcggcgtgtctccacatactnccagatcgattangaggcgctctctcatacatatatactcaaactcaagcgctcttctccttcgtaccactcgtagggcacctgttgtcttcctntcatagtcgccctcacgtagaggttccaacngagattaggcaggacaaattacagancccatatctgggaacttttntgaaacccctagaaatatctggacctgttctgacaagactgatacgggtcgaggcgaccntncaccggaagcatagcgtctatagaaanggctcagcaacatcgagcctctgcgcggttttcgtacaanactattgacgttatttgtcattttaaggctagtgtgcttctgtatagaagcatactctccttacactgaattacatgaaaacaacaattaanatttgactcttagggtgtacaacggtagtaggcttgctagaacaacctgtagaaccangtgacataggtaagagacgagggcgagcagcagatgggacaacggg

SEQ ID NO: 604570 - DNA, 198 bp, Homo sapiens
cgagataatgaggtgatcacgagttgcggacactcctttgatgcagcgagtgcagcggaactgggagagcgagcatcaggttttgaagttcaccaaagcagtcttcggatgagaaaccaagaagaagcgggcagtaccggggaggctcaatctctgtccaggtcaatactattaagtttgacagcgagtgacctgagg

SEQ ID NO: 604571 - DNA, 1080 bp, Homo sapiens
  misc_feature (302)..(302): n is a, c, g, or t
ggctttttagctgatttcattcttgttctgttattttgttggtctagtatgttatacagggcaagccctagaaaacgtgtcctttggagtgagctttccaagattccttttcctcagatgttgtacgacagaagctttagtgtaggttaatgggatctggtggaagagaacagcttagtctcctcttataagcttcgggaacactagaggatggtgtggatgaagactgcctgtaatagatgactcctgtttaagcactagccgtgaacagatgagacctcactaccactatgctcgctagnactacgatcgagcatggtggagagactgaccaggtgactcaaggactcacaacttgcgcgtagtgtactactagtagatgggaacgacagttagctgctcttgtcgatctaaactaatgtataacaggctttgtaggtgagttgtactataaggtcactattgtaggcgaattgggaataatcagggaatactttataggattgtgaatagaagttcttccaaatatatgctaagtaagtctggaaaatagatataccaagagaggtcggggcatgtggggtgaggatggtttatattattactcatctttgacagagctcgagtgcttagctaaatgctggaaatggacataggtggagaaatggtcagagcagcagtgggagcgtacccagaaccatgagtagacggcaagcgagctgtctgccaagccagggatggaggtgtgaggcggctggtgtgggtagaatatgtggaatctagttagaattcctggattgcaatcctgtcacagttcgttcatcagaccaattcaacttgccttttcctattattattcattttttttggagaaaagtctcaatgtttggccagggtgggggtcacatgggtgacaacttggctcaagtggaaccttaggctcccgagtcgcgcgggctaacgggtgcttgccactatggccaatcatatgggattcacgaacaaggggttacccattgttggcaggcaagcttgaactcggactccgtaaatcacggtctgggccccaagtgtgagatc

SEQ ID NO: 604572 - DNA, 220 bp, Homo sapiens
aaacctggccccgtattccttaacaacatgcatgtctttccttaccatgccagccggatagatagacagatggaaaaggcaggcgcggccttcgttgtcagtagtctttgatgtgaaaggggcagcacagtcatttaaacttggtccaacctcttcgcatcttacaaagttaaacagctaagagaagtaaaataagaaggcaatgcttgtggaatgtaca

SEQ ID NO: 604573 - DNA, 834 bp, Homo sapiens
gtgatggtgggaggctcagtctaatttctgcctgtaacagggatcagcgaatcttttctgtaaagagccagatagtaaacattttaggctttgcaagccacctggtctgttacaactatttacctttgtcccctctaagcagccatggatggtatgtaaatgaaggggtgtggctgtgttccagtacaatttatttacagacgccgaaattagaatttcacatgattttcatgtgtcactaagtagtagtaggattttcattttcccccagccctttaagagtaaaaactagctcactggtggcaggttggatgtggcccacgcgcctatagtttgccaagccccagtctggaagaagattgggaagtagtggcgaggaccggccctttgttcccgctctctggtgtttctgctcgctcacttgctcttcggtttctgatgaaataataatgtcatcagtttttatttaatgcttatcttgagacaggctgttctgcataaattattgatttagagtacaatttagtgaggtccttcctttacttaaataaaaagacaaaaaatattatctagatgtaaaaactgaggttcaggtgaagagtgaactgaccagggacgacacgtccaagacgaaaagtcgacttgaaaagtgacgtaggctggcgtgggggtcacacctgttatcccgcactttgggaaccgatgggtggatgctgaagctcagggtcgggaacagcggcactaggggagcctttttacaaacaagaacgaaaaaaaatttgtgggcccgccaaaatttaacactttggccgcccgaataaagtcagtcaaaag

SEQ ID NO: 604574 - DNA, 693 bp, Homo sapiens
aggagcttgatggtaccattcattcctaacattttcttctgaatggcttcgaaccaagcggtgtcgctcattcctttgggctgcggacagatacagttggctcggtcctctttggtcaatggagacagctgctgtgatcttttggacctgggtggtacgatcgtgtcgcttaatcttttcaaaaaccggcgttcttccacgagtttttccagttttgcatgcacatcaccatgtaccatatgccattcactgtccacctgcgccagtttggcttccaattgcgccctggattgtccataggaggcatcaaacttctgcctcatctccgccacatatgcatcgatcatgggcttccttagttggtccaattccttagaaaacgcggtctttctcaactgtacatagtaatctatctggtccagccaattgcacttagcacggtcccagggcgtattcaattgggtcctggcatccagaaacgcctccacacagcccgcgatcttgccgcttcctgttcggtccttcactaatcctctgacagagagcgtcccactacttagttttgttgccaaagcaccggtattaccgcttctggaacgataacggtggcctgcgccgttattattcctcctctcccaatggacgcttttatcgctaccgttattactgttatctctcaccattttttgaacc

SEQ ID NO: 604575 - DNA, 144 bp, Homo sapiens
  misc_feature (4)..(4): n is a, c, g, or t
  misc_feature (46)..(46): n is a, c, g, or t
  misc_feature (60)..(60): n is a, c, g, or t
  misc_feature (73)..(73): n is a, c, g, or t
tgtncactagtcagattcgtgacatttgcttgtatttgggaggctnaggtgggagaatcncttgagcccaggngtttgaggctacagtgagctatgattgggccactgcactccagcctgagctactgagggaaacccgatctc

SEQ ID NO: 604576 - DNA, 150 bp, Homo sapiens
gcggaatcaccatggcggctggaacccaggacacgaaccagaaaactggagggccttcaaggtctcaacgctgctcagtacagtggggctcaggtccgcgtgtctccgcaccaccccacttccatttagggcagaccaaccgatccctaa

SEQ ID NO: 604577 - DNA, 179 bp, Homo sapiens
cgtcgacatactttcttttttatatttatttagtttgatttttttgggacagtttctttgtgtagccctggcctggaacttgctttaaaggccagattagcctcgaactcagaaatctgcctgcctcccaagtggtgggattaaaggtcgacgcgccgcgtcgaagcggccgcgaattt

SEQ ID NO: 604578 - DNA, 395 bp, Homo sapiens
ggtaccatgtagtttggtggcgcatgcctataatcccagtactcaggaggctgaggcacgagaattgcttgaaccctggaggtggaggttgcagtgagcctagatcacgccactgcactccagcctggaaaacagagtgagactctgtctcaaaaaaaaaaaaaaaagaaaaaaaaagaggaaaggaaaggaaaggattctgattgatcacattcaaatacaattataatttccctgtaactgcttatcccctttaagctaccacgttactctccttggcacagccaatcatttttagagtgggtctacactcacggccatcacttcatcactgcctgttcattctccaatcactgcaggcgggcatccaccgacaccatagcaacaaaactgct

SEQ ID NO: 604579 - DNA, 500 bp, Homo sapiens
  misc_feature (23)..(23): n is a, c, g, or t
  misc_feature (266)..(266): n is a, c, g, or t
  misc_feature (459)..(459): n is a, c, g, or t
  misc_feature (479)..(479): n is a, c, g, or t
  misc_feature (494)..(494): n is a, c, g, or t
tcccacacttttattgtagcatntttggagtagtagtaatagataagtaaaattaattatatgaaaatttaaataataatctttattttttaatagagattttattagaaacttgcttgagaataggctttataagatacatacctatatgataccacttattgtgtgtctgttaaaattaataatgaaggctgctaactaggggttgagtcatgattagtagaataaaagaagttataggctcatgcctgtaatcctagcacttngggaggccgaggcaggcaaatcacctgaggtcgggagttcgagaccagcctgacaaccatggagaaaccccatctcaactaaaaatacaaaaaattagctgggcatggtggcacatgcctgtaaatcccagctacttgggaggctgaggtaggagaatccatttgaactcggggaggcagaggttgccggtgngccaagatcgcgccattggnctcccatcctgggcnaacttt

SEQ ID NO: 604580 - DNA, 215 bp, Homo sapiens
ccaagtatatagccggtccatcgttcactctgtgagttgaatacacacaacacaaggagttcctgagattgcttctgtctagcttttatggaaagatatttccttttctaccataggcctcaaagcgctcttagtatacacttccaaattctacaaagagagtgttactaaaccgctctctcaaaggaaatgttaaactctgtgagttgaacaca

SEQ ID NO: 604581 - DNA, 918 bp, Homo sapiens
  misc_feature (60)..(60): n is a, c, g, or t
  misc_feature (302)..(302): n is a, c, g, or t
cagtcacagtgttatactattctgggtttttctgtatacttaactgttaccagtgagttntgtgccttcaggtgatttcttattgctcactaacatcgtttactttctgattaatgtactctgtttagcatttcctgtaggacaggtctagtgttgatgaaatccctcagcttttgttgtctgggaaggtcttcatttctcctttatgcttgaatatattttccttcagcactttaaatatgtcatgccactctctcctggcctataaggtttccactgaaaagtctgctgccagacgtatnggagtgccattgtattttattggtttcttttcttttgctgcctttaggatccttccttttatccttgacttttaggaatttgattactaaatgcctgaggtagtcttctttgggttaatctgcttggtgttctacaagcttcttgttcttggatatcgatatcttcctctaggttgggaagttctctgttattatcctttgaataaactttctacccctgtctctttctctacctccactttaatgccaataactcttagatttgtttttaagtctattttctagatcttgtaggtgtacttctttcttttagtctttttcttctgtgtcctctgaccatattttccaataagcttaccttccagtcactaattcttggtccacttaatcaatcctggtattaacggtctctgatgcattcttcagatggcggtcgcatttttcaactcggaaattcagatggactcttttaatatgtaatctctgatacattatctgatggaatctaactttacgggtggggtggaattcttgaggttctcttggaagttattgaaaagtcggagggtcacgggaactggagagtggagtctcacagggaatggatatgtcgaag

SEQ ID NO: 604582 - DNA, 756 bp, Homo sapiens
  misc_feature (537)..(537): n is a, c, g, or t
ttgactccatttatgactagactacatttctgaaagatctttggtttacgattcttaagaatattgacaatgcctataaaactctgaagataacttttacttaaaattgaaaactattgttgaaaaccgttgaacagatacatattctgaacctttcttttggctccaagactatctctattatcatgttacttccaaaagctcttattctaagtctttaaatagaaatttgatctagtctcatagataaaaccatcttttagcttttaactgtgaataattgtcataattgatttttctgtttgctttgctctctcatgaggttttctgaagatgcctgacaaactgtcctgtgctcaaattttaaaataaggcataaaataattaatcagaggttctgtgctcataggcggagcttgtcaactttggggttctgtgtatggcaatcttgctagataatttacacaggaaaccttcaatatcattatctctgggtccttacaatttggcagtcagattccccagagaagaatcttncattctgacccttgggatataaatatagcctggctacctgttcatgagaagaaagctgaagacttacattcagaatcctttttttcatcagaatccctgtcctgtctgataaggcccctgtagaggccccttgattgctgaagaacaaatgaggtttgtcaacaggaaagactgccctggtattgaatggaggggaatgaggctgactcgatttccctt

SEQ ID NO: 604583 - DNA, 269 bp, Homo sapiens
tggatcccatctttaacaacctttctaggagacatgcattatcccttctgtatcttaattttctcgttccctactgaacattacacattggcattataaatttcttcaagtttctgtagtcaataaaatactctctgagtctgaattcttgatccagttaccaatgtatttcttattccttttacaaccttgtcattctttacaaatttgttgagagcctggatgcagtgtgccagtgagcctgggtgacagactgcgaccctgtctca

SEQ ID NO: 604584 - DNA, 402 bp, Homo sapiens
ccggttactgttactgggagcagctaggccatggtatcacgcacgaccctgccgtcctatctgagcattaccgcatgatccccggcagatatagcacacctgttatcagctagtctcgccgtggacctgctggggccacacggagatcctcgccgaaaggacgtacaggctcttggatgacaacatggaccagctcatcgagtacaaagcgtttgtgagctgcctcgatattatgtatactggagcacatgaatgagcggattcaactattatacaggcttcatatccctccagcactcactgaaaatgaccgagacaaccagtcgccgttgaaggaatcctctgttgtcaacatcgagacccctggtttacgggaaacccaatggtgatgcagttgactat

SEQ ID NO: 604585 - DNA, 332 bp, Homo sapiens
ggctatgacaagctcagcacgtgacttcatgcctaagactgttggaattgatccaatgtccatttacttgtgctgtaaaccagatgaaactggaaaatcagtattgggaaacaaaagcaatagagaagaagctgtattacagcggaaaactggcagccagcgcccctgccgccccccagcgaggaggctgtgtccagcagctctgaggatgactctgggattgatcgggaagaagagggctctgagtacatcagcgctccactcccgtgaagatgcacgatgccggagacagtgccaaagtgaccgaagaatgaggaacaaaccatgaaggc

SEQ ID NO: 604586 - DNA, 331 bp, Homo sapiens
  misc_feature (263)..(263): n is a, c, g, or t
aatttccggtgtgtggagtcggcggtggagtcctgctatgcgctcagactcaggccccctcactgctcctcggagttcctttctcttccgttagcttctcactctgcatcagttcctgaactccatctagaacgctagctgggtcttcagtttgaaccacttcctcatttggctcaccccctctagatttagctcagcgtccctttctgaatgcaggagcactctggttttcagactagttccttttcatagcagctagtttngtttaatagacatggtgttcttttgcaactctctgaagaaactatttaaaatttctttaaaagtgttt

SEQ ID NO: 604587 - DNA, 2879 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacaggtgagtaatgttttcagaacatattaaatggtgttttttcttttaattaatataatgactttatgtttttcttctcttaaattagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604588 - DNA, 508 bp, Homo sapiens
ttttggggcggggccggccggctttggctctctctctttttctgtccccgggctctctgagcgcaggtagcacgacatgcgctctcctgcaccgcgtgctggtccatgccaagtgttgtcgtctatttgctgtgcccttctatttgcgcttcctcgctgttggctttagtcctgccggctccccgcccttggcgtatgctgctcattctatgaattcttttctgttccactggcttggtccgttactgtgtctccggccgggtccgcccagtctctcgtctccctgtgcctcccagtgtcgcccactccagcggccagtatgcgcaggtcctgcctatgtccctagcccgcctgggtggcagggcccagtcctgggcgcaggatcgctcctggcctcatcctctgcgccgcctgtggactaccccccacaaccaacagaacagaagaatgtcacaagatccataaggcacataccctacatgatgctataagcaacaaaatgaaatca

SEQ ID NO: 604589 - DNA, 135 bp, Homo sapiens
atcatagcacccactagatgcacccactacttctgctgatactccattagctaatgcatgcttaccagcttattcaccttttacatggttagcatctgtttgctcagtctctgctctcttatcttctacgttaag

SEQ ID NO: 604590 - DNA, 2868 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattccttccttggtgttcaaggagtgaggtacagattccccttcctgaccctcagaaatttcccttctgaaggaaggactgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604591 - DNA, 741 bp, Homo sapiens
gccgccaacacgggtggagggacaggaaggggggagacaaaaacgggggcgccacaaaaaagaggggcgagagagacgccgagggaaacagactgcgggccccccgggggggagaaataggacccccgagagggagatgtgtgagccacacgagaagcccacccgggggggcaccaccccgccgtgccggggtagctcgggtccctcactagctttgtgtgtccaaagactgagtggagagaactcgcgcgttagggggcactcacatataagatggtgtcccacccgcgggggggtgtggttcgccaccccaaaaagaagatggaatgaggccccccaccacccgctggggcgggtgacccacagggaaggcggcggggaggggcacacgccaccacacacgcatccgccacgcgcaccacccccaggtgggaacaccaccacggtgtatgcacccccacaacacaccccacacacccccgcgcgagatgaggtgtgggggcccacgcacaaccccacacaacccccgtgattgtggcccccaacacacacacacgagggggcggggccaccaagaggggagaggagacgacacacaccaccagccccccccccacgcaagaaccacccccgccggggtgtgggtgggaaatatgtgtgtgtgtgtgtgtggtgggtgtgtgtgtgtgtgtgtgtgtgtgtggagaagaaaaaaaaagagtgtgttgtgcgcgcccccca

SEQ ID NO: 604592 - DNA, 2498 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604593 - DNA, 970 bp, Homo sapiens
  misc_feature (702)..(702): n is a, c, g, or t
tggctccgtctgtggggtggcgatcccgccggggtcctcgccgtgtgccgtaggaactctgctacagaggaaaatggatgctccatcatccatcctcctcagctggtggggtctggtgtgcaagttcggatcagtggatcctggctttcggccgttctcagagcttgcctccactcatctggaaagctcctttttcacgcatactccataataggatgctggtagagcattgtgacgcatcgaatgcgcctctgagagaattccctcgtggcgattcgtgttccctagcgtactcaatgtgtgcatcctacgttgtgatgctagggtgaaaaccttgattcggcgatagctgctcgtgctggcatcaatcttagcttgctggggtacgaaagagcgtggatggcttgacggatgtgtggaggtattattggcaccgctcgaagacgagcgttgcatggtgatttcaccccccactcgttcagggttttgtactacttgcccttgggatggtcatccgtctgggtgcgcaaggaaaggtgccgtggtccccgttggggcgacatttcttcttgcaggcttatcagtaggcctttctcggagatcctaccagctacgttgattgaatttgttcaatggcgccattatgtatctgtgggttcttctgttattctatgcacgtgggcaactacatagcgttagtantggtggtgacctcttcaggggaaaatggtacgcgacttgtgttctcaaaaagtattggcggaatcagggtttcgtataactgtgttgttggagagcccagggtggtttgggggctagaggaggggtccaaaaatttttaaagcccagtggggagtataaaatttgggcgcgaatggagttggctggaaaccatgggggggggaaaattacacagaaaggcgaggcggcactgtgggaaaaattttggtccaaaatttgggaatgttta

SEQ ID NO: 604594 - DNA, 3111 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattccttccttggtgttcaaggagtgaggtacagattccccttcctgaccctcagaaatttcccttctgaaggaaggactgcgcggccactgcctccctcgccaggtccctcagcccagagcccgctgcggggagcgcgtgtgtcgtcgccgcgaaggcagctgagggcgcccacgggaggcggcgtgaggacgaggctggagcgctgccttctcatctaaggcgggcggtggggtcgccggcgagcgaacccagggaccgggcacactcgaaactggagattcgcctgcgaggccccttcccgggggcgagcacaggtacctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604595 - DNA, 437 bp, Homo sapiens
  misc_feature (58)..(58): n is a, c, g, or t
  misc_feature (82)..(82): n is a, c, g, or t
  misc_feature (92)..(92): n is a, c, g, or t
  misc_feature (94)..(94): n is a, c, g, or t
  misc_feature (165)..(165): n is a, c, g, or t
  misc_feature (183)..(183): n is a, c, g, or t
  misc_feature (188)..(188): n is a, c, g, or t
  misc_feature (203)..(203): n is a, c, g, or t
  misc_feature (239)..(239): n is a, c, g, or t
  misc_feature (305)..(305): n is a, c, g, or t
  misc_feature (311)..(311): n is a, c, g, or t
  misc_feature (321)..(321): n is a, c, g, or t
  misc_feature (369)..(369): n is a, c, g, or t
  misc_feature (423)..(423): n is a, c, g, or t
  misc_feature (431)..(431): n is a, c, g, or t
gccatccccttgttcatccctcatccacagtaggacaccatccttctgttcacttganagttttccacaataattacaaaanaaaacataanangttttctaatgacactgtgaagcccaaactgatcttctctcaaccccattctatgtagtcagcaccagtgnatggtgggtttggggttnggggngggggttggcgtttnagtggggagctggggggggggttgcggcagcaaggnatccgtggccgcattcagaggctggctcccctccttgcctttactctcgagtcttacttaaccttngagacnaactgggtcnacttggtaaatgggcacagtcaaagacttagccataagaggtaagggnccagtcaatactcccaaggctggttaggcccttcaacatgtaggtgggtgtgtntatgtgtncgtcgc

SEQ ID NO: 604596 - DNA, 1449 bp, Homo sapiens
tatccgctccccgcaacggaagaccgagggcagggaagcagtgagggaggttcatgaattaccctccataaaggaaagggccgaagagttccgccctggagaccagcgaggccattttttttgtgttttttgagattacaagtaaatttattttcttcttgaaacccttttgaataaaataaacatttcaaaaaaatgattcaggctcttaaaatactgaggcttatggtgcattagttttcaacttaacataggtcacattaaaaatctgtttaggtgggtcaccacaaaacaaatatggacacaagacaaaaagtaactgaaaggggagaaagtttcaagattaatttaactcatattgttggagtatataaattattatgtatccccgccagaaaggactgactagagctcagtaaacaacatgcataaatctaattctggcatattactaaatcataccttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604597 - DNA, 2164 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctagggtctgttgtgttggaaaaagattcggtgctgaaaggggataaagacgttagatg

SEQ ID NO: 604598 - DNA, 1527 bp, Homo sapiens
  misc_feature (329)..(329): n is a, c, g, or t
  misc_feature (507)..(507): n is a, c, g, or t
  misc_feature (860)..(860): n is a, c, g, or t
  misc_feature (1421)..(1421): n is a, c, g, or t
ggcaacatgctaggtgttggatgagtcgcggtggccgcgtgggtcggcgccgtcaggcggtgttggggcgatagtcatgcgcgcgtataccggcgtctgcgtgttcccgcaggatcgattcttcgtgtacgttgcgcggttccgcgtcgcgcagcgggctcgtcgcgatcgctggtacaggggactgagtgccggcagcgacaccagcagtcatccctctcgggcagagcagcaggggcgaccgataaccgaggtgcatcgctcggtcggtcaatttgtgcggccgtgtgtgggtcagtgcacgttagagtgtacagggatctactganacagattacttataattgtcctcttgtgcacactgtgcccagtgtcaaggaagtacccagacttcggttgtatgtgacctgctgcgtgccaggcacttctgcgtgctgagggagtcgacgggttaagggaacgtaatttagtcgtactggtagtgggaaacacgaagaagggcccctnttgggcctcctggaggcacgaggccgaaccgaacacaaggggatcttcgggaaggtccatttgtgttgggcctaggccctaaaattccgaggagaggaacttcttacctagattgtgggctccacctggtacgggagcttctttgggggggtcgattaaaaattgcttgtccggtaccccttgcttgcgaattgttgggtggagggcacaaacccctgaattctagtacttcggaataggagggggaggcgcatcttcccaaattcccattagagaaccccaaaaaagacctacaatttccaggttcctggctcccaactctgtcttagtcggcgccttagagaaaggggctnttaccattggagcggtgtgcaattcgagaaggcaatccgagggtctagagatgtcggcaccccaaacgaggcaataggattcccccttgtggtcagaaacgtggttggaaacatcgagagacccggtcattggcccggggacttcctttggttgaccgtggtgtcttcacccgtgactcttccaaaatacgcgcgattttgcgaaccccaccagagggttgggccgaaccttgggggtgcaagattccggtgtgtcatagctcgttgcggaacagcctttgtgtggcccattgaaagagaagagaccctgtgcctcaccaatggtgaagtggagcgacatgagagattacatacgcgaaatgtggagtcctgggcgttaaacaagacgcctttccaaagttggccctggtgtgtgacactttgcgatagcgtttgcgtccaacagcgctgtggggtggtaaaagtcggttttccggcaaccgagagggggcccgaatgcccttttgtgggcacattgcaccaactttttatccttacagccgaaatgccttaaacataggnttaagcaccttgtatatgcgcctggcgtaaagctccttcctgggggaaaacagaggacgaaccgttcgcgtaacttttcacacacaaagggttctttccgccttag

SEQ ID NO: 604599 - DNA, 971 bp, Homo sapiens
  misc_feature (19)..(19): n is a, c, g, or t
  misc_feature (153)..(153): n is a, c, g, or t
  misc_feature (247)..(247): n is a, c, g, or t
caaatttacctgtccacanggagcctggtttgtgaaataatttaaatgtattaaggatgttttatatttagatcaccgattattaatgggacccgataggcaaatagcctaatattcccaaaaagcaaccttcctaagatgcctgcctggaantcttgaaagaactgagtttaggtctttgtcatatatacacattatttaggccatgaacaagttttcaagtatcagttgatttatgatataggcntatccatttggttataaaatcatatgtttattacataatcattgacaaatagtttctgtataataactggcagagtagctctaaaacatatgcaaggaaataaataaagaaaaaacttacaataaagagagtaactcatattttaacagttttgtgaaaaaaatagaaaatattttatgtagcttatagtacatatatttttttacaacagaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 604600 - DNA, 1860 bp, Homo sapiens
  misc_feature (1)..(1): n is a, c, g, or t
ncgttgcgcacggagtggcaaagcagtttcaagtaggacggatctggattaccctcctacaggaagcggcgcgaagctcccgcctgtaggctgagagggccattttattttttttggttataaaatcatatgtttattacataatcattgacaaatagtttctgtataataactggcagagtagctctaaaacatatgcaaggaaataaataaagaaaaaacttacaataaagagagtaactcatattttaacagttttgtgaaaaaaatagaaaatattttatgtagcttatagtacatatatttttttacaacagaagaatcgcattctgattttccatatggatcatttccctatgttgctagaccagtacactggcaacctggtcatacaggtgagtaatgttttcagaacatattaaatggtgttttttcttttaattaatataatgactttatgtttttcttctcttaaattagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604601 - DNA, 211 bp, Homo sapiens
tcggccgtagcagcgagctataatcaacaccccgctccgccataccaccgacccatgagggacacccggaacagggccaccctcctactctcccgagacatcccaacagggggactggacgtaggctcccctcccccccctaccctctccatgatatccagcgccttctgacacccttttcaccatgaaaggcgcgcgctaacggcgacaa

SEQ ID NO: 604602 - DNA, 1729 bp, Homo sapiens
tttttgggagaaccccccccttcgcccggtttccttgccctcccgtgcctcacggggccccccccccaccttgtgtttaaaacttttcgggggcgcgggcccccaaacatttttttttttttttttttgtgaaaaaaatagaaaatattttatgtagcttatagtacatatatttttttacaacagaagaatcgcattctgattttccatatggatcatttccctatgttgctagaccagtacactggcaacctggtcatacaggtgagtaatgttttcagaacatattaaatggtgttttttcttttaattaatataatgactttatgtttttcttctcttaaattagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604603 - DNA, 219 bp, Homo sapiens
  misc_feature (195)..(195): n is a, c, g, or t
tcggccgtagcagcgagctataatcaacaccccgctccgccataccaccgacccatgagggacacccggaacagggccaccctcctactctcccgagacatcccaacagggggactggacgtaggctcccctcccccccctaccctctccatgatatccagcgccttctgacacccttttcaccattgatgtggntgcgctgaaacggggaacccctca

SEQ ID NO: 604604 - DNA, 1564 bp, Homo sapiens
  misc_feature (1)..(1): n is a, c, g, or t
ncgttgcgcacggagtggcaaagcagtttcaagtaggacggatctggattaccctcctacaggaagcggcgcgaagctcccgcctgtaggctgagagggccattttattttttttggttataaaatcatatgtttattacataatcattgacaaatagtttctgtataataactggcagagtagctctaaaacatatgcaaggaaataaataaagaaaaaacttacaataaagagagtaactcatattttaacagttttgtgaaaaaaatagaaaatattttatgtagcttatagtacatatatttttttacaacagaagaatcgcattctgattttccatatggatcatttccctatgttgctagaccagtacactggcaacctggtcatacaggtgagtaatgttttcagaacatattaaatggtgttttttcttttaattaatataatgactttatgtttttcttctcttaaattagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 604605 - DNA, 208 bp, Homo sapiens
  misc_feature (184)..(184): n is a, c, g, or t
tctgtaatgcgtgcatttaaatcacaccccgtcgcctacacgacatgaggacacccggaacagggccaccctcctactctcccgagacatcccaacagggggactggacgtaggctcccctcccccccctaccctctccatgatatccagcgccttctgacacccttttcaccattgatgtggntgcgctgaaacggggaacccctca

SEQ ID NO: 604606 - DNA, 256 bp, Homo sapiens
ggatcttagcgggcgcctttttttgggggggggtggtgggtagggggacaggtcctgctccgtcacccaggctggagcccagttggtgtgactgtggctattgcagccttgactccctgggctcaagcaatcctcccacctcagcctcccgagtagctgggactacaggcacacatgtctagctaatttttgatttgggtagagttgggatttcaccacgattggccagtgatgggtcttgacactttcagggctc

SEQ ID NO: 604607 - DNA, 548 bp, Homo sapiens
  misc_feature (357)..(357): n is a, c, g, or t
  misc_feature (375)..(375): n is a, c, g, or t
  misc_feature (390)..(390): n is a, c, g, or t
  misc_feature (423)..(423): n is a, c, g, or t
  misc_feature (495)..(495): n is a, c, g, or t
  misc_feature (500)..(500): n is a, c, g, or t
  misc_feature (531)..(531): n is a, c, g, or t
gcgggttaggagtttgtgcctgctgttgaacagtcactctgatttggtgtcttttttggccaagttacagaacagagtttccaggactgagaatgatagactcacctctccctttgtctctggctatcctcaggaatatttctcccttcaggaactcacaatgtttcctgtggcttaaggcagagacaggtcctctgccagggaacccaatatgttggagaagctggttgtccaccttgatctttttctagtgtggaaactctgggtcgaggggaaattttctgtatgcctggggcagattgggaggggagggacattgtataacatgggaagtgtggtttctcctactcttctggntcagagttgttttttaanttcccctgtggtccngggggaactgcctcattctcatattttgagttnctgttgataatctcagtgctgtccgttttgtttttgggtttctgtgttgggagaatgaagccagcttctatngccgncatttttgaaaccagaaatctgaatcaagangtaaattctcttttttt

SEQ ID NO: 604608 - DNA, 931 bp, Homo sapiens
gagtgaccggagccggcggggcgagcggttccttgtgggctagaagaatcctgcacaaatgtctctctatccatctctcgaagacttgaaggctcaaactgctttttctgcaaaccctgccaatccagcaatttgtcagaagcttctgttcctatccctcacgatggaaatctctatcccagactgtatccagagctctctcaatacatggggctgagtttaaattgaagaagaaatacgtgcacattgtggccggtggtttctgtgcaccacttcaggggcagttggtagcaagaccttccagtataaaccttatatggttggctcctgtaactggtacatgatgtttgcaattcgtagaggcagaaattaagcaaggggattcgtgaagtcatttggtgtaacggatcaagacttggaacaaaccttgacttcaggcttaaactcaatagcactcatgtatatttgttcagtagtccaggctaattctcccagcctcattgtctgtctgagattgggaccaagtacttcacatcagtggtgaaaactgtgcagggatggcacctctgataaagcggcaaaggttctcaaacaggctctggagaagagattaccatgaccattcgtgacaaggcccttggaaggcgataccatgcatacgagctgccctggcatgtgggttcatcttaacatggcagaacacactcccagtgagaatagtctgcgagcagaatggtttcaggacttaagcttgggatcaatgacgagcatggtgaggtcaatggaacacggcaactggggtggcatatcacacgcgtcgttggacatctcagaggcgccagtttaaacgtgcacacgtgggctacgcgaagggatcactatgaattaaacccgcgcatgaatcttgctgaaggccgtaagatctaggtgt

SEQ ID NO: 604609 - DNA, 384 bp, Homo sapiens
  misc_feature (99)..(99): n is a, c, g, or t
  misc_feature (212)..(212): n is a, c, g, or t
  misc_feature (283)..(283): n is a, c, g, or t
  misc_feature (305)..(305): n is a, c, g, or t
  misc_feature (318)..(318): n is a, c, g, or t
  misc_feature (359)..(359): n is a, c, g, or t
agaaataaagttttgcctatagtaaaagatgaaataagccaggcatggtggcatgcacctatagtcccagctactcaggaggctgaggtaggaggattncttgagctcagaagtttgagaccagcctagccaacatagcaaaaccctgcatcaaaaaaaaaaatggaataggccgggttgcggtggctcacacctataatatcagcactttnggaggccaaggcaggtggatcacttgaggtcaggagctcaagaccaacctggccaacatggtgaaaccctngtctctaccaaaaatacagaanttagctgggtatngtgtcacatgcctgttaagtcccagctactccagtggcttnaggcagaattactttgaacccgggg

SEQ ID NO: 604610 - DNA, 217 bp, Homo sapiens
ggcccgactcatccccttcgggctgctatatatatatttatttgtaggtatttatatattgaaatataaaaacctagatttatggagtttcctctagatcatgttatattctatatcagacaaactattttcttttgacctctcctccttttcttccagtattccgcttcatttcattttctcccctttttctgttttcaacgaactccactaccag

SEQ ID NO: 604611 - DNA, 1211 bp, Homo sapiens
tggacaattctacaaacacttttattaccaaaaggagctatagtgcagcatgggaaaaagaggggctccctcctttccccctcaaaggcattcagcgtgcccctttcccaaggggcaggccagcagggaacaagaggaccccagggtttgcaagcaggcgtggaactcaaacaaaaggtgactccgggctccggggaagtcattgtgacctgtgccagaacattgtgagccttccttcattatttcatctccagaagccgcctgtggaacgtgggccgggtgtgttgaagccgaggagaattaccacagaggcgttgcttcgtgcctctcagaagaacaccggactattttgcggcccccgtggagaaccagttctcacggaagcgggggacaaaattagtcaacatttgtggcgggtctcatcgggagactcctagcgcgtgttctgtgcccctttggtctctcctataaaaaagcagaagtccccttgttggcaaattctctccattatagcccgtgagtgcgcttctcatgttcacaattcttctctttgtcgtccaccgcaccattctcaccattctcctccagaagcggttgtcccaagaaacgcgctgtggaaacaggggcgcccaggaaaatagcccgagccaggggttctcccggggccagaacagtttatatagggggtgggcatttccttttaccataggcccacaaggccttctgcggccttcattcttcccacgtataattggcgtggcgtcgtgaagtgctagctcgaggcccaaaaggcatttcctggccaccaaggggggcctggcttttcctccgggggcaacagtggctatatgttaaacggccttccatagagcctctcagttgtcccacgaaggtttcaacacttggggcagcggcggggcttgcaccggcttgagtcaggggggggccccaataggggcggaatgcgggagggcgaccaaccccggaaggacacatgggcctcggaacgcgggccggtccctgaaatttaagccgaaaggagggctaaaacccgtggaaacgcatgtgccaccaggtatccctgatttttccggccccaaagaactggacaagcgtttgaaagccctgacgaacgcaatatttgtgctcaccccagactagtcacccgggacatgatttgtgaaaaaaacccgcttcgcaaccaaaggtct

SEQ ID NO: 604612 - DNA, 408 bp, Homo sapiens
gatgagggagtcaccccgtctccctgctgaagccatcatctggttttacaatgccctccaagtgatttcaagcctggcacacattggtcagaccactgtgctaatagatagtagatgttatcaccataagcaatttggattcccttctgaaaatccaccagttggataagctcaaacccaaaattacacataaaagaatgaagggtttcaaaagaatcattactatcctcaaaaaagcatacaagagaaatgtaaccatgtagcccctcttaataacagtacatttgctgaacacatatgcaaaacagaggagataggatcacgacatataaattatgctccacttaatttacagccacatgggtcatttggtacactcatagcttctaatgccggtgcccattccag

SEQ ID NO: 604613 - DNA, 313 bp, Homo sapiens
acgcgtggtcatccagcagagaagccacgaaggaagcctgactcttggccgggccgcgaacggctcgtcgctgccccattgctgacacgccttgagggcatcctggacatcgccgcgcttgagctggatcctgtaggcggcttcataggcgtctcggcgagcaccgatgaggttgtccagactttggattccatcgcccagatgcttggcctctttcgcccacaagacctgggccaaggtgttctcagtcggcgcaatcagcgcccgctgcaccaacttgcgcgcctgcttgcgctgcccgccctccagttcc

SEQ ID NO: 604614 - DNA, 659 bp, Homo sapiens
  misc_feature (309)..(309): n is a, c, g, or t
  misc_feature (381)..(381): n is a, c, g, or t
  misc_feature (502)..(502): n is a, c, g, or t
  misc_feature (518)..(518): n is a, c, g, or t
  misc_feature (542)..(542): n is a, c, g, or t
attctctctccacctccagcattcccatgctccttttccattctcatgggaagtctttaagttggctttggcctttccctccctatttctttctctcctttgctttgaagcttcagagctaggaattcagatatcttgctacagagagtgaatcccaggtgtgtggggcttcagcctttgttagatgcatcctggacggagcacagacaagcagtttctgatgccaaaggcaataaggccaagtgtcagaaggaagtagaagtgggtaggaaggaaatggaatcattgagcatttcacgatagactctntcttctctcttttggtcatagaatggacagagaagaacatagtgggccacaggttcaagacatggtcacttntccaagagcattgtctcatatatttctgcttctctttcatagtatggatcagaaagtgaccctttcccaatggaccacttgagcaccttaatacttaaggtcataccttaatccctaagtncttagtacctaagccntgtgccatcttgaatgacatggantgaagtgaagcttgagggagtggccgagccataagccttggtcttaaggggccttaagcctggctgggggaccaggattcctcattaccccttgaaagggggcaggccacttccacc

SEQ ID NO: 604615 - DNA, 152 bp, Homo sapiens
ttttaaattcctttccttcagttttcctcatgaagatgtttcagatactgaatttgtttagacattgaatgactttgttaaaggcccaattaatcccattggttgtcttctgaagccagccttctttaaaaaaaaattacccattttaacca

SEQ ID NO: 604616 - DNA, 159 bp, Homo sapiens
  misc_feature (49)..(49): n is a, c, g, or t
agttagtgatattaggcggatcagacgaagaggggcgttggtattgggnatggaggggtttatattgataattgttgtgatgaaattgatgtgccctaagatagaggagacactgctaggtgtaaggcgaagatggttaggtctacggaggctccaggc

SEQ ID NO: 604617 - DNA, 93 bp, Homo sapiens
catctgtgcttgtaggagagatggccagggtggagccctcatgcaggttgaagtatatgtagccatcagcctgatattcttggtgcgaaggta

SEQ ID NO: 604618 - DNA, 925 bp, Homo sapiens
acaggaccagctggacgtggcgttgaggactatgagaactggttcccctcaccacccaaccgtacccacctatgtcatactgtctcctcgccaagttcatccttaattccaagtgaagcagcacagtgctgagaaacagttcatccatggtgccatgttagagaagttggaacactatctcttgaaaatcctatcttccttttaggcttgaatatgatgctgaacagtaagttcgttaaatctaggaacttaaagacaatcctgcgtttctcaagtactattctaacattgcgctttataagggatgatattgctaccacctcactcatatttttagctgcaatgattttcctggtatgtctgtcatttcgtggaaacaagacatatagtgtacaaatgggtgctgccaaaattccaggccattttgcagggactctgaagtgaccgtttagtagtaatagtctcatgtgcagtaactataatggtaccagcaatgtcaaagtaatacaatttaacattatccaaatgctatagggctgccctccccctataagtccaatagctgggtattccaactgtaatcagtaaaaactattactgtcctagagctacaagggttcaagtgcctgctttccagtaatggacgcatgcgtcactactaatttgataacaggtaagctccagtaggcactcgacttcctagatacacaggccataggggaccagcgagcttctacgcacggaccatcagggcgaccattacaggacaacggcttgactacgttcaagacctacatacaacacttggccaacctggatcgggcaataccgaaccaggcctcatctgaacctaacccgggcacagggactttcatcttgccccagtttagccaagcgcacgttcctaagctaacacatgatagcg

SEQ ID NO: 604619 - DNA, 679 bp, Homo sapiens
tagtattctgcaataaatataatataaaagtatgatgtgaatacatacttatttttaattaattacagtttcctttgtaattcttttggcccggggcttttacatcaaaacatgctttgacttttctgactggaataatgaatcaataaacaatgaattacctggccattctctccttcaactatcaaagaagaaggagagaatggcaggtaattcatgtttattgatagttgaattatctgctgggcaagtagcatctggctaagactaatgatgccaacacttagctaaataccaacacttcccaaccgcaaagccaaatttctggccaatggaagatgaatataattgatgtggacagcttctgggtggtgcctataagaggagggtaaagccccttcatttttaattgattattctattttattttgacgatggagtttcgctcttgtcgcccaggctggagtgcaatggcatgatctcggctcactgcaactccaactcccaggttcgcaatgattctcctgcctcagactcccaagcagctgggattacaggcatgtgccaccacacctggctaatttgtattaaagtagagatggggtttctccatgatggtcaggctggtattcgaactcgtgacctgaaggtaatccactgcctcggctccacagaggtt

SEQ ID NO: 604620 - DNA, 223 bp, Homo sapiens
ttacaggtcaggggcatggatgaggctggaggccatcggtctcaacggactatcacagggaccgaaaaccaaaccccccatgttctcacccatgctctaacttgaactttatacctttattggaaggatttttcaatttgatcagactgatataaaagacagccggcgggctttaaaactcgaaacacctggtttgaaaacctaaccctgggatttactaact

SEQ ID NO: 604621 - DNA, 218 bp, Homo sapiens
gcggccgcctactactactatgtgggcggccgcgtcgactggagtccgtttttccaaaaattaccggatttagcccagtgtggtggcccttgcttgtaactccagctacttgggaggctgaggtgggaggatcacttgaatgggggacgcggaggttgcagtgagctgagatcatgccaccgtactccacactgggtgacagagtgagacttcatctc

SEQ ID NO: 604622 - DNA, 504 bp, Homo sapiens
agacgccgggtatcaggttctccagagccaaagatggataggtagtgggcaggcaggcataatatagtgtggtagcaggcctctgtcatggacgtgagatttctgcgtgtgagcttccattaggatttgtccatccagggcaacccttcaaagaaagtcaccatccaggcaccttctgaatgcaccttcctgtccttcttccccgctcctccccctttgtctgggggctcacttttgcactgaacactcacatgtgtttcctccttcagtttcgacttgcagaggaatctgaagcaaaagtgaaggaaggaaggtatcctgggtgtcaatttcctgcttcatatccgagtgatccaacaaaggagcacaccttcatttgtatggagagtgatgctctgatcctccctctggtttctccgaaatagtattaccagcccagcccagaagtagaaactctgccagcatttccattagaaacctcatttttcagggtcttttaactga

SEQ ID NO: 604623 - DNA, 482 bp, Homo sapiens
aaatctttctagacacattgctgttgtgggcgcgcgggccccgagtatggtatgtgaatgttgcgtcatatgcgtgtcctccataggatgatccgtgcgtcatcgtacatagttgcttgtgattctcgggctaataaaaaacgcccggggggaacagcagaggcgtcttgcttgaacaatactcgcagtatgagaatgtttgctggaggctcaatcaggtggtactcctaatcaagcgaggatgctccaacgagaagtccgtccgaaatcatccaatatttttacggcccgcccggcccgtgggggggatgtgcatgacgccgccgaaacggcaacacaacacaaagagacataacataccacaagcagataacatacagcagacaacaaagagatcaagcgtgcaagatacagggagaagcaacacaacagctagcccgaacaacgagggaaaaggagagtaaccacaccagaaccgcaaa

SEQ ID NO: 604624 - DNA, 356 bp, Homo sapiens
atcctgacagctagcagtattgtcgtcgtttagaaggttcctcatatactcttaccctcagccaacccaccatgtttatcaattcaaattgtagaactttcttgacccaagacattctgtaggctgctgatcttactgaactttccatcaatggctaacgaagaaagcatgcatgattccaatgagttcttctgaggcactttgactgtgacagtagtcactttagtgtatgctttcagcccgtactcgcacaactgtgggccactcaccgacatctgtgtagcccacaaagggtaactgggctccatacacatcatagcagttgacccacacagtgcccgcctggagggcctggg

SEQ ID NO: 604625 - DNA, 475 bp, Homo sapiens
tactttgctatcgatttgacctccaatgttaccacctgtccagctgaaagaggaacccatccgaggctgtctctctttgatggaatttctacagggctcgtggtgctgaaagacttgggcattcaggtgtaccgcataattgcctgggaggtgtgtgatgactccattacggtgggcatgttgcggccccagtggcaagatcgtgtacgtcggggacatccgcagcgtcactcagaaacctatccatgagtggggcccattcgatctggtgattgaggggcagtccctgtagtgacctctccttcgtcaaccctgctcgcaatggtctctactagggcactggccgtcttttctaagagttctaccgcctcctgcatgatgcgcgacccaaggagggagatgatcgccccttcttctgactctttgagaatgtgatggccatgaacgttagttacaagagggacatctcacgatt

SEQ ID NO: 604626 - DNA, 152 bp, Homo sapiens
gaagtgtaaattaaaaatattgctaaaaaaagaaaaaatacatttagaaagaatgggttacctggtcccccattgttgcccagtttgtgcgcattgccagtggacttcattttgttaaattgattggggcgttcccccccttttttcctttt

SEQ ID NO: 604627 - DNA, 108 bp, Homo sapiens
ggacgtcaacttatcaaggaagatgggtgacactgacccaacctccacaggcgtgggtgtgcccggaggctgggcgagggtcgattatctctgtcgaaaggctcactc

SEQ ID NO: 604628 - DNA, 805 bp, Homo sapiens
ttcccttcatttctcaagggctggttgaactggttggaaacacatgtttttctccaggaatgtcctttttttctatatctcaggaaaatgtttgatttttcctcaatcgcagattgagtagtactaatagagcgcctatcaaagcagaagaaatttgcggtatttgccgtagtccaaattatgtactgtctggtgacgaaagtagagcgtagagaaaaagaaaatgatttgagacagtatgattgttactgtgaactatacaaatagctgagtctgatctccttccacgtgggttcaatttgcgtccaatctttcgccctcccagtaatagtattatatattaatcaagccgacaggattgtagtttacctgtcttcctggcagtctatctattatggtcagcgagtttatgtgttgaccttatggagaaagtgctaggatgtcagatagaatactgtaaaagcaatatgttcatttctcctctcaaagaagacgaagtgcgagacatcaaacacaagctcagtgggggagaccgtcacggcccgcccagaaaagttacttacaaacagacctttgagggggccggagcaacacataatgcattcgtaaacagggggcccgagttggagcatggaggggacccccgggcgggcagtaccgacggcggaggttacatgcacacatgaaaaaaggcccgggggggggccacacgccggtgtttcgaacaaaaacccccagacttgggggcgccacggagggccccaacggggactcactgcacacggggcccacgggcgtcgaatca

SEQ ID NO: 604629 - DNA, 218 bp, Homo sapiens
acatcattttcggtttggaaccagcatgcaagggggaaggagcggtgctctgctgccaagctgtcagttaacccttttccaggcaagtctcttaacctgggaacctcagtttcttctgcgcgatgggtccagggatgttgattatagcaactaaacaaacagaagcagaccaagaataaggaaggctcaagggtgagaatgtaccaaaggtttatgat

SEQ ID NO: 604630 - DNA, 266 bp, Homo sapiens
gagctttgggggcagcctgaacacctacaagcgatttgccatcaagctgccggatgatcagatcccaaagaccaattgcaatgtagctgtcatcaacgtgtgggcaaccccgaggctgggatgaacgcggccgtacgctcagctgtgcgcgtggtgcattgccgacggccacaggatgctcgccatctatgatggtttagagggcttcgccaagtgcccagatcacagaattcggctgaacagatgtcgggggcccggctgtctga

SEQ ID NO: 604631 - DNA, 832 bp, Homo sapiens
aagtcaagctatgttaaataagataggatcacattttataatgaagattaccagtgtagtaattctgatattgcaaatgattgaggaacaaacaaagaaactaatagagaaagtcagtctcagaggaaatcccatttaatgttagactgtttggcttttgaaattacttcttatagaagatcgcattaaaaaaaaaaaaacaacttggggcttctggcatagcaatttatccattcagaccttttcttttagaataagggaaacttaaaatctactttctaaagactggaacaaagtggctagctggcaaattatctgggaaatcattgggctcttttctaagcatggtgtggtaatcatggttttcttctggattcctggaatggaccatgggtagcattagtggtttcaagaaattggtccaggggaaaattggagctattttccatagtgggctagcaatgtgctacacatccttagatactcctctctcccataggataaatgttcacagcacacaaaagaaattttctcaatcctggatttggaaaatttcacaggtgtcattatccgtatatctaagcaataattatctgaatgttgggcataaaaaattataatgttctaaactggttcataacgttgaatgactttcagtccctggatttaatattgtggagtgataatcagactgatagtagcaaaatctggtcatacttactgaaatagatgggggatggcctataccgaaaacagtgggtaccatttaaatttttgattcaaaaatttttctaattactttgcagaaaaacttttaaagcctttccatatg

SEQ ID NO: 604632 - DNA, 1976 bp, Homo sapiens
tgtacaagagatcattgtcatcctgggtgttctttgtattcttcatactagaaatccataacacgccaaatgcccttagaaccatggacagcacccaggttttacaaatgtcttctccaggcttcagaaggaaggtggtggacattctttccatcatgacacaaaccaacaattacataccaggctttgttggtgagaaagcaaggtggcccacctggagatttatgccgaaacaaccactttacaacacaacccacggagtccttgacgttggcttggtttgtcaatcccaccacctcataccatttagaaacttatcagctatttctagataactgggtgttttagtttcctgtagataaaactgaaggctaaattgaatatatgactaagttatttactatgaggaatcttagtccaggaaaacctctcaaaatacacaaatgtctgagagatgtaatatatttaattaatcccttactccttttatttttattttttattttttcagagacaaggtcttgctttgacacccaggctggagtgcagtagtgcaatcagaggtcattacagcctccaactcctgggcttaagtgatcctcctgcctcatcctcccaagcagctggagctacaagtgtgcaccatcatgcctggcccctttattcctaaacgtttcttcatgaaggaagatacaaatttacatgagcccatgctcttcacatgggtaaggggaaaacagagagaactcacagggcacccacatattgtgctttatcatttgacctaggaacagtcttgaataggcagcttgggtttctactcccagaaaatactttgacatacattaatttattcacttaaaactcattatttcctgggtttccatgcagtgtctctgaaaaacattctcaaaatctcactaaaaatgggatccgttagatcaattcaagaatagataaaaccaaaacagaacaaaaataccagcagaaccaaaggtaactcaaagatgctgcaccagtgtagttagcacactcaattcagttcaattcaatttgtaaaaataaagttagaagggttcttaaataactttgaccttaaataacaacattcagtctttaatccagtttgagtgtttgtcgaggaatcctgccataaaaatgtttgactctctgtaattggtggttgggaagattagaaagagaaccaaaatgtgaggaattcaaccaaacatcaagataaatcaactcagggccaggagtatttgtgccatgcctgctcagagccgctatggacaagctcagtttgttagttcagctctttgaagcatgatatgtagacacacttgcatgttcacacacattgtttgctaaactgtgggaaggtaatcagaagagaagagccacgaggttgtcaatctagcatcagaaatttggtggcataggatttctctacaatgctgtccactaaaactttttgtaatgatgaagatatcctatagccaagctgaccaatacaatagacattagtcatatgtgactgttgagcacttgaatatgggtagtgaaattgaagaactgaatttttatttttagattttaattattttaaatttaagtagctgcagatggctaaaattgaatggtgaacttccaggacaaaggatgtttttgccttcaacaatatcggaaaagcaggggtgagtggaatgtcagattgcaatgcaattgcttgtgtttctgcggagttcatggaagaaactcattatactcatttgtaatgcttgatggtaaatttgattttctctttagaatgtagagattaaatcttggtttaaaactgcctctctgtgagcagtttctccatcagtgaaacgggtgtaatttcaactcgttgagagtgctcagttatgcaatatatgcaatgtttcttatctgtgtctgaaaacagttaataaaaggttgctgtgcttgacgct

SEQ ID NO: 604633 - DNA, 172 bp, Homo sapiens
gagtcaagagctttttacatctataaagcagagttcaatatagacaagtctctagacacagagttgaagatgtcttgactgtgaaaccctgtggcggtgggaggccgaatccaaattgtcctttgccacttgtaaaggctgaactctagtctgtgtcctcactacatgccat

SEQ ID NO: 604634 - DNA, 167 bp, Homo sapiens
atacttctggatgagaaggctcttctttgggggtttctccatcttcaaagtgcattcgtccgtcctcctcctcatgcctgtgcgttgctcttggccttggatttctggctgtgcatgtcgtgttcccgcggctccccgtctggccgcaaagactgagcactcgctgt

SEQ ID NO: 604635 - DNA, 377 bp, Homo sapiens
agaggatccccctcctacccacgagggagagtctgggccgcgcgggagccgcagggcgccctagccttcgcagaaacgatggcggaggaagaaggaccacctgtagagctgcgccaaagaaagaagccaaagtcttcagaaaataaggaatctgccaaagaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcaggctgacagtgccatttatta

SEQ ID NO: 604636 - DNA, 380 bp, Homo sapiens
aagataggctgtgacgatgatttcggtttcagtgtccgacgtagtacatcgaaaaacttcagtgaccagagctcccgttggttgaactcggctgcgtggtctgaagctttaatgccagtttccttaggaaacatacatgtctgtattccctccttcatactacattctgaagaaggattactgaaaacaattgtgttttgcagtgtgttttcttctttattcagtaagtttttgggaagggttaaattcttgtgcaggttgacatttatgccacttgcatatctgaggctgatccagttctcacgcatggcatcagtgcaaatgtcctctctagcagcaggcagtgagctgcccaggggtgaagcctgtttttcctcagt

SEQ ID NO: 604637 - DNA, 370 bp, Homo sapiens
  misc_feature (53)..(53): n is a, c, g, or t
gggggtttggggacttacgcctttggaattgcttttcattcaaaaaaggaacncaaaggaagccccccaggaaggaagcacaaagctgggggctttggaaacgccctgtgtttttgggtacagcaagaccagcccaggagccccccagcacctgcctttcaggtacttggtggccatttcctgcttttcaaagtgcaaaaaagctttttatttccacccccacccggaacctccccttgcctaacattttccctttatgggaacatttttgacttttttacctcctttggggtcaggtgctccacattttttgccccagggtgtccccccctttcccagcctgtatacccagattactttggtggactga

SEQ ID NO: 604638 - DNA, 154 bp, Homo sapiens
gacagtggtggggctgggaagaaccaagcagtcattgtgattatcagaccgtctggttgcctcccccgcctccagtcattgtactaccccagccatggggtgcatccccttcccccatacccaccactgcctcttgccccaacactgcctcgtg

SEQ ID NO: 604639 - DNA, 159 bp, Homo sapiens
  misc_feature (35)..(35): n is a, c, g, or t
ggaaatccaacctcaaagaagctaagcacattgcncagaagaggcaggataggaaggtattaaggagaaggcctttgaagaataaggaatcaattgaagggggacttggaacccacagagggaaccaacttaactggcaaaatccccgttccccacaaa

SEQ ID NO: 604640 - DNA, 120 bp, Homo sapiens
tggcccagcattcactccgaaatgcccactgcatctccttcagcatccacagatgaagcacatggttccgcttagctagatctctgtggtggcacacactcgctggcacgctgacgctga

SEQ ID NO: 604641 - DNA, 967 bp, Homo sapiens
gcgttgtggcgttgcgtttccttcctctttcactccgcgctcacggtggcggccagagcgggggcgagggcggcgcgagaacgatccggcggcagttctcttcctcctgcgcactcgtgtgcccgctcggtcagtcagttcgggggccggcgcccggcttgtgctcagtatctcgcgcttgcggtgcccaggaccagtgggcgtaactagagtactgggctgagaacctcggcgctccggaggctggcgggcaccacgagagcgcaagcctcgtcagcaggtgtccgagagtgagggcatggcgaggtgaaccgagtccagaaagggtgtgccggaggcaggtgtgatggcgcctgcagaacatggtcgaacaacgctagaaggatccgtgatggccaacgacaaatgcacaggaagaacatcagccagcgcgaaagatcggccaagatctcgaggaaatggcccccgtaaagagaaggttgtctgctatgagaccctgagtgtattgggctctcctttggaatagtgtagtcggtggtctctgctagatttagccagattcattcaaaggtactcaggatggggccatgtgaagtgactagagctgtaagatgttatcattcctcctgtgaacttgaacttgaaactgcattcctgatgtatgatacactggtttgaaaatacataagtaaaagcaacctgactcgagaaatgactctcctaaatcagggttcagtgtgtcagatccgaaggtctcttcatgacgtcattcccaggttggcttaagtacataccacagtgctttgcaaaacaccacatgaactaacgcaataaaattgattgtcacccagacaacacaacggcaggtgctacagcgggggggaacagagttgaagggcgtggatgcgttggcccactttggaaggggaaaggagctctaaaggcgaaaaaacgaagactgcctaca

SEQ ID NO: 604642 - DNA, 316 bp, Homo sapiens
cccgtaattcccacgccacctctctgggaggcccgaggcgcggccgcgactcaccgaggtccacggagatgtcgaagacccactccctggccccaacaccgcggggaaaccccgctgcttctacttaaaataccccaacacaaatctagccgcggcgtattggcacggcgcctatagtccccactactcgggaggctcgagccacggagaatggcgtgaaacccgcagaggcacgagcttccacctgccctgagatcgggcccctgcaactcccaggcctgggccacccgagcgacgactgtctccaaacaaaaac

SEQ ID NO: 604643 - DNA, 307 bp, Homo sapiens
tctaactctgtctgtgctcctgagtgatccgggtccgggcaagtatgcaaacagggcagctttgcacaagacagacacgtaccatctggccactggacctgaattgtctgtgcacctagagggcacgccaaaactgtgtgttcaccgtgatcaggaaggatgttggcgctggaggtccactctaaattcctcaccatccttgaaaccatccagatggatgggcttccctagggagcccacagcagaaccctgaaagaccctactgtgcatgggcaagtggagaagcctcctcagcaagaccctggga

SEQ ID NO: 604644 - DNA, 1558 bp, Homo sapiens
  misc_feature (399)..(399): n is a, c, g, or t
ggcttgagcagagcccgggtattgtggtgacagatcactgcctgtctggtacaaactcgtgcgctgttcatatgaatcgtactatcttcctgggctgagtcggacggctagcacgtgtggctggaagatttcttggagtgactcctctatcgagaggagctgggcagaaactatgtgtcacactctcggtcgccaacctacgtggaactacaggtctgatttcgagtgtacctgttgcagggccgaagcgatgctacctgctagtgctagcgagactacgactactgagatgctctcaccatattatagtgcgtctccgtatggcctcatcagtcactgctcttaggcccagaatctcttgatggctacgagaccgtatcacgggtatgaatccatggnccttctagtgacccaccttccttcgaagggatggggatcgcgtgcaacaaccgtgctgtaactgagtttaacgcatagaatgggaagttcgcggggattgcattcgcgcgatctcctgggtagacacccaaatggtgacgccgcaaacgggctccaattgccctcgcaaccatttgccattgcattgttgggagcgcggaagcgcacttaagcaatggtcagttaggaaagcgccaaattggggcgtacgcctgcacgtttcggaactcgaccaattaactatttccagaattgcgacccagttggaacttaaaccataagtgctaggcactatcacgagaaggagaagggaacccctggggacaacgacggctcacggagaaaggttttggcggggtctggccttacgacccaagaggttttatacactctacagggagcggaagcctctaaatttttaaacacatgtccaaacacgtgtgagtcgaattcccagaaaacacatctctccacacttaggaacacgtgggagcacatttcgttacgagggtcctgcgttagtacggtacataaaggccttgcatggcaaactgggcgcaacacattcctgggaaacacaactcgccaacaggctctatggcagaacccacaaggcggaaccacccgaattgaaaatcggcgcaagcaacttccccacatcgtgaaacaacacattgcggcacagcggcactgcatctgcgacccagggagaacaccaagagaaaaccactctaaagtcggacaacggagaacaatgcgggagatgggaaatccccaacaagagtagacaccaccaaattggaccgtatcaaaccctggggagggagaatagaggcgcctagatagagcacttggggccacggcacaggactagcggcgtcagaagaacaacgaggatcacccaaaggagactaggaggagcggacacaacaagaaagagtccaggggcgcccacaccagaggcgaacacacaaacacaagagaacaccaaaagagacacacaacgccgtcaaacaactcacaaccaccacagagacagaggagagaaccaaaagacaaacagcccctcaatcacagaagaacatgagtagagagagagaacagagagccgagaaatata

SEQ ID NO: 604645 - DNA, 532 bp, Homo sapiens
tatcagctcggtacccattctgttcttcatgatgtcataggtcacagtaacccactggccatctggttcaactcactccgggaactcacgcgccagtataagcggtcctggtagaaatatgctatctcatcgagttactggaacacctagtagctgtgtcctagaaggcaccccgggcgaacatcctggtccacctcgctggcgctccggggatccaccatctgcgccttcacgtcgaacctccagaggcgccgcccgctgaacagcagcatcttccccctgccactccggagggccccggtcacctgggccacgtcggctcccaggcccagcttgtccagacgcctcgggcccagcaccgacgcgcctgtgtacacccacacctggcgcccagagaagaagaaaagcttcttggagagcggctcctcaaagaccgagtccagcttgcggggcagcgcgggccacttgtcggcgataaggaaggggccctgcggccggctccccctgccctcagagaatcgccagtacttcc

SEQ ID NO: 604646 - DNA, 797 bp, Homo sapiens
  misc_feature (582)..(582): n is a, c, g, or t
aggaggaggaggaaacccttccgagaaaacagcaacaagctgagctgctgtgacagaggggaacaagatggcggcgccgaaggggagcctctgggtgaggacccaactgggctcccgccgctgctgctgctgaccatggccttggccggaggttcggggaccgcttcggctgaagcatttgactcggtctgtgggtgatacggcgtcttgccaccgggcctgtcagttgacctaccccttgcaaacctaccctaaggaagaggagttgtaccgcatgtcagagaggttgcaggctgttttcaatttgtcagttggtggatgatggaattgacttaaatcgaactaaattggaatgtgaatctggcagtgtacagagaagcatattcccaatctgatgagcaatatgcttgccatcttggttgccagaatcagctgccattcgctgaactgagacagagaacaatttattgtccctgatgccaaaaatgcacctactctttcctctaactctggtgaggtcattcctggagtgacatgatggactccggcacagagcttcataacctctttcatggacttttnatcttcaagccgatgacggaaaaaatagttatattccagtctaaggcagaaatccagtacgcaccacatttggagcaggagcctacaaatttgagagaatcatctctaagcaaaatgtcctatctggaatgtgagaaattcacaagcgcacaggaaattttcttgaagatggagaaagtgatgggcgttgtgagatgcctctctctgaactctgg

SEQ ID NO: 604647 - DNA, 269 bp, Homo sapiens
  misc_feature (16)..(16): n is a, c, g, or t
cgattaagcaccgtgngtaaatatgtagagcggagtatagggctgtgactagtatgttgacgtcctgtacatgctaggagagtgatatttgatcagtgagaactgtggttactagcacagagagttctcccagctaggttcaatacgtcggggggtatacggcgatggttagctgaggcttgctcagaacgtcatcaaacaacgctattagatggtgagatagacgttctgaacgtccctcttcagagaggcattatgcatgcgtactg

SEQ ID NO: 604648 - DNA, 380 bp, Homo sapiens
  misc_feature (50)..(50): n is a, c, g, or t
  misc_feature (73)..(73): n is a, c, g, or t
  misc_feature (75)..(75): n is a, c, g, or t
  misc_feature (172)..(172): n is a, c, g, or t
  misc_feature (179)..(179): n is a, c, g, or t
  misc_feature (312)..(312): n is a, c, g, or t
  misc_feature (336)..(336): n is a, c, g, or t
ggcacgagcggcgctccagcctcgccatccccgcgccggcatcatgctcncccagaaagtggctgcaacggcncngcccactgtcagggttggggggacagagaaagtgatgtgcgccttctaaagcctcgcccagcgccgccgaagcagcttcacctctccaacttttttncacccancgactgcttgtcttgaccctgccctccacccttccccagagccactttcgggtgcgcgctcttgggtaaagggggggtcaccggctgtctgggatggcttccaattttaatgacatagttaaacaagggtacntgaaggatccgaagcagacccctnggggatttatcagcgatgctggtttaatattcaagaaagctttc

SEQ ID NO: 604649 - DNA, 528 bp, Homo sapiens
ccagctttttcagcagagcaaaatcaaagcgctgttattacaggcatgagccaccacgcccagcctttgtgggtatattttcgtgtgtgtgtgtgtgtgtgtgtgtgtgtgtgtgtgtatagtgtgtatatatactatatattctctttatatagtgtgtgtgtatatatatggctgtatatataaatggcttgacacaaattccactcaatgagctttacataccataggtgtaattggtgtggcctactaatttctctgtggggaggatcatcacgtataccaaaaggtattgagagtcatgttcttctcattattcaggggtgcaccgaaaatttttacagtgcttttagaatgcttttaaaatatttttggccataaaaaaaaaaaaggaccccccttttctttggaatatccctttttggtcccaggaccatctttttaggaaaacacaccatttcttttttttttttttttttttggggggggggtttcttttttgggccccctggtaaaattctggggcct

SEQ ID NO: 604650 - DNA, 643 bp, Homo sapiens
  misc_feature (576)..(576): n is a, c, g, or t
  misc_feature (578)..(578): n is a, c, g, or t
  misc_feature (580)..(580): n is a, c, g, or t
  misc_feature (583)..(583): n is a, c, g, or t
  misc_feature (594)..(594): n is a, c, g, or t
  misc_feature (608)..(608): n is a, c, g, or t
  misc_feature (610)..(610): n is a, c, g, or t
aaacaaatccctacaatttcacctcctcccctaaatttaaaccaaaaattaccccctttcaaactcctccatataaacaacaacaacaactttttttctcatctactttctcctcctaaagctcatgtttccaattctcaccatcaatacttatttttctaaatcatacagtcccaatttctcatattcttagccacatcccataacccattattccatttcctccttatcccaatccctttgtcaaccattatttttccctttccagatccatttatatttagctcctcccacctctcaatagcatttcaaactcctttttttatctctactcctcacacgcaagtatcacattatctccctctctaatttaattttcacttctcatttaactttatcctctttcattttaatatttcttaacctaatctatcaagactctattttctttaatccctttccccattttttagacctatctttccttaataccctttatccctctaccttttttatcaatcaccctctgcctatttaaacaatccttttttttcccaccgaaaaaaaaaatactcnangnggnccgttctacgnattcaatcaaaggngntccaggttatacactacaatacttatataatat

SEQ ID NO: 604651 - DNA, 298 bp, Homo sapiens
tttttcccggggttcgggattttggggggtcggcccgggcggctttttcccttgggggcccggatgggggggggggggtcaatccccgaggttgttgggggttggggcgggaaaaggggggggttttttttgggggggggtttcctttgggggggggggttttttttttttggccccgggggggggcaaaagtttttttggttggcccccggggatatggcccggcaattttggggcccgggcgggggggcccccaccccccccccccttttcccccttttttattaattttttttta

SEQ ID NO: 604652 - DNA, 484 bp, Homo sapiens
  misc_feature (150)..(150): n is a, c, g, or t
  misc_feature (178)..(178): n is a, c, g, or t
ctcgcaaaccactttctcttcacaggttacttgggttgaagtgttgaccaatcccagtgggcacttaggcagacatttgggggtcccaaaaaggcttggggggggtcccccctccccagtttggtggttttggaacccctggccttttcntggcccttgtagggttttccccccaaanccccaaacaagggggcttttcccccaagggttttttttggaatttaggccccccccggggggggccaaattgggttttgggttgggcaagcccccccggaaccccagggggggttccaaccccgtttcccccccccttttttaaggggggggggaagtccctggggggccttttttttcccccccaagggggaaggggggtacatttgggttgggggggccctccccccccccccttcccccaaaaggttttttttttttttttttttggggtttttttttttattttaacataaaccctttgcca

SEQ ID NO: 604653 - DNA, 196 bp, Homo sapiens
agcctgactgaccagccttagagcatcttatcccgaagttaggatcggcttgcgatatcctttactacattgttccacatgcagaggttgtcactttgagacctgttgcggatatggggtaacggcctggtgcgagaatttacaccctctcccccggattttcaagggccagcgagagctcaccggacgccgccgg

SEQ ID NO: 604654 - DNA, 281 bp, Homo sapiens
gatgttgcgccaacacagaaacattccaagcctgtgatacactctctcaccctaaaaccaataaaaactcttagtccataggagcaagcactcctaaccaaaaaaaaaaaaaattggtccagaagcccctctcaggtttattctccaaaataaactggtcttggagggtggagccacttttcaggtttcttttctctttctttacttcttacatttgggggctggaaaccgggggatggggtggtagggggataacggggtcaccggagctcggaattcgg

SEQ ID NO: 604655 - DNA, 729 bp, Homo sapiens
ataggctagtagaggcctggtgttaatcaggccgagggactgccgtacaatttggccaacaactgccaggtgcgcatgctggctgtctgagcctggtgggctgctacaacctgtccttcatccccgagggcaatgctgggcccagctgctgctcgagagctgccatgaagaacctgctgtgggcatggccttcttcggcctgacctgagttccagctgcaatgactgcagtacctgttctgagcggactgttcaacctcaatgttcatcctggcccttcatgcagtacaatagcacgcgggctgggcgtgctgtggagtgtggatgaatgacaccatcctgtgctgcattctgagtgtgatgctcaatctgacactggacagtgcagctgtactgactacgccaatggacctcttccagcatgcgctaccatgtacaatgctgtgcaatgtttggaggctgcaggggagcagctgccttgatgagccgctgagtgacgcgtcttgctagcacctgtggccaatgggaggcaacttgccatgcagcgtgatggattgccggacctgagcctgggccgcgttgcccaacctgatggacttacatgatgccacatcatttgagaagtggtagtggcgcgtggtggaccaacggagcagggctctatgggcggcagctgtggagggataacaccagtgacagacgacagggtcaatcgccaagattgtcaagg

SEQ ID NO: 604656 - DNA, 712 bp, Homo sapiens
gagttagtatgcatgaagtgcctggcgacacaataggtatcatgtggttataatctgttttaattatcattaagatagtttaacaactggccaggcgcggtggctcccgcctgtaatcccagcactttgggaggctgaggcaggcagatcacttgaggtcaggagttccagactaggctggccaacatggggaaaccccgtctctacccaaaatacaaaaattagttgtgcgtaatggcgcatgcctataatcccagctacttgggaggctgaggcaggaccatggcttgaacccaggaatcggcggttgcagtgagctgagattgcgccactgcactccagcctgggtgatagagtgagactccatctctaaacaaacaaacaaacaaaaaccacatagtctaacactgaaggggaatctaaagaagagggtgacagactgtgacaataacaagggcccacgatgtcgtcatgaaactgcaaacagttcgtaccaaattcaccacaacccatcaccacgacaggcataccttgctaatcatagcgacgttgcagatacgtgcacttttaacacgctgcacggtatgcagacgaccctgcactgcaacaagaactatacacaagctggtatccacagtgcatcgcctcacttcgcgtcacagcataactcgcgaactcacacaggaccaattctcgaataccacgagcgaca

SEQ ID NO: 604657 - DNA, 1542 bp, Homo sapiens
  misc_feature (642)..(642): n is a, c, g, or t
gatagcacgctctgtgctggcgtctgcttgcctgcctgtgatgtttcccagcaccatgtatggcctggtgatcttctttactgcctttgcctgtgcgggaggtgcttgtgttagccccgtcgatctatacgaaggccctcgtcttgcatgagcacgacgagattgttggtgcgtatatgatatactagtcgcgaacgtaaggttgcactgagcgtatctagtggcgcacgtcttagcttccgtcgtctcaagttggagacagtgtcgatcaatactgattgattggtgctctaggagtcactgggacagaactgttgtgtcgaaattcctcccaggttctcgaagctaggctacgtgacatcaacacggcgtcatgggctcgtggcggagcttgggtagtgaagacaactgatgtcgctgaatggtgcgatagtgtcatggaccacaacacagaatctgcgagccccctagttcggtcgatgatatgtagaaacggtgtgccagaaaaaatcgaataaccgaacgatcccctttttgcatgtcctcttgcttgtgccacttctactttctgtacacaagacaagttgggatcccccttgtcatgagagacgagctccatcagtggtgtcgcagcggaagctntcccattgctagagtttctctcattgggtgactttggaacgattaacaggtttcgccccggttgacccttggaaagtaactgaaaggcgatagaacccgaatatttttgccctctttgtcagagcgaatgccgttgtagacattgcggcttcgaaagtagacctggtccattggtcgagctcctattggtcacttgcagtacgggcgcattggatggaggacagctagagcccttttcgtttgaaacttgatgggagaagccaagccaagccttgcccgtgtagttccaaaggcagacgaattccccactcgcaggaagatgatggaaattcgtggccctttgggaagcgtcttggaggtttggtgtccatcctcccccgatgggcaacgtctttgctgttgaggaccctgggcgcacattgtgtaccagttacactgcacaaggtctattaatatggttgttgccatttctttggcccctggttatctagctaggggccttgtttcgcggtgcagttggtgggcaatcgtgggggacccgctgatttgctagcagtgttttggcctctcttgcacaaagtagccgtaatgcgcggtgaatcccaacatatgtgaatgttgtccccccgtcaatactcgcgatggttaaacgatttggctatcccccccgcggattttttttcgtgagcaatccgtggtttcaccctgtgcacacaagtgagagcacagttatacattccgcggcccttgtgatatgaaagatgtcgccgagaaaggatcgggggaaatcaagcaagcaagcgattttgtcgaacaaggcgatcatggagaaaacctcaaaatcagagtcttctgtcagagaagaaaacgcggacgtgatcctaaatataagacaacttc

SEQ ID NO: 604658 - DNA, 154 bp, Homo sapiens
gatgctcctgcagagacagacgatagcccttatcagtaaaccgtgtctgccggaaccatctctgcctggtactcaaggatattctttcggttaccattgtccacagaagccctaaagcaaaaagtgccgcttaatcactagtcgagctggattg

SEQ ID NO: 604659 - DNA, 889 bp, Homo sapiens
ataccattatactagccatttaacatctcacttctatgacatattattatatcgctcacacctcatatcctccctagctatgcctagaaggaatactactatcgctgtgcattataggctactctcataagccctcgaacacccactccctcgttagtccgaatattgtgcactgattgtccggatactagttctttctgtccgtactgcgtaacgccagtcgagttggtccgctaggcctctgctagtcgcaattctccacaccatcaatatgtgccgcgtagcactacgatactagtaagccctaaaccctacttccacatgctaaagacctaattcgtcctcaaccatacttcatcatttactaaccacctgactatgactttgccaataaggcgacatactgtgaatcaacaggttcacccacagtactatttattagcaatcatccccccctactattcctgtaagccatacatcaaacaaactaaacctattttacgtctgtttccacacatagctttgttgctcctcgcatcctcactcctatagagagcgcccactcttcacttaatatctaaacatacacttgaatctacctatcacacacatccaccacatgcactgtgcaaacgcacatacgccaactgtcactcctgtgcagatctagatttcgacgataaatcactgctagcctctattatattcctttttcttacagaattctaagttgctggtatcatcctaagtactaagcagatcgtcatctctatatcatccttttcgtcgaccccgtggtgcgccggcgttgggtattcttttccgatgaggtccgagtcgaagggctgcctgcagggactttcttctattcacggctggaggacccttc

SEQ ID NO: 604660 - DNA, 919 bp, Homo sapiens
acccctgccctggcctgcctgccctgcctgccctgccatgcccttctccaacagccacaaggcggctgaagctgcgcttccctgggcctgattggactgatgttccccctgacctgagctgcccacaacaaccacatgtgccaatgggtgcttgaccccctgagctgtactgctgtgagctgctgcgccaagagcactgccgagctggcttcactgctggacgactgtcatccagacagtgctgtggacaaccctgtgtgccaccctgtacatcatgacctgtggggctgctgttggctgggctgacagaggagtcctactgaagtgttcaaggatctcttcgaccccatcatctgaggaccggcacgggctggctacaagcccagcgatgagcacaagaccgacctctaaccccgacaacctgcagggcgggcgacgacctggaccccaatactgtgctgagctcgctgggtgcgcacgggtgcacgcagcatccgtggcttctgcctcccccgaactgagcctgcggggagcgccgagccaatcggagaatgctcggctggtggcacgccccttgtccatgcctgcgacgtggacccttgtcgtagccgatactactgcaggctcaaatgaatgcattgaaactggacagcgtgaacaaagcagcaagcttccattggaactgaacacagttatccctcctatcgacaagtgcccggttttgtcccatgcttcatgagcctgagaatgtcccggtatgttgtgcccaagcccctaggtacacggggcacaaagtacctaaagaaactccggtcgtgtggccacgcgggatgccagcggttgggtctcttccctgcaaggggggcacatttagtggtatacccgaatgacgcgtgatcacaaaatgacctagtgcata

SEQ ID NO: 604661 - DNA, 496 bp, Homo sapiens
  misc_feature (35)..(35): n is a, c, g, or t
  misc_feature (49)..(49): n is a, c, g, or t
  misc_feature (139)..(139): n is a, c, g, or t
  misc_feature (271)..(271): n is a, c, g, or t
  misc_feature (443)..(443): n is a, c, g, or t
aacagctatgacccatgaattacgccaaagctcgnaaaattaacccctnacctaaaaggaaacaaaaaactggaagctcccaccccggtggcggccgctcctaagaaactaagtggatccccccgggctgcagggaaantcgggcacgaagcaaagaacttggctcaactgcaaaccctcccaccctccccaggttcaaagcaattccttcctgcctcagcctcccgagtagctgggattacaggcatgcacccacccaggtctggctaantttgtatttttagtagagattggggtcacaccatgctggccaggctggttttgaactcctgacttcaggtgatccacctgccttggcctcccaaattgctaggattacaggtgtgagccactgtgttgggcctaagctttttgaatctctgggtttatagttttttttgaantcaaatttgagaaaaattctctccaacctgggcaacagagtaaaactgtctca

SEQ ID NO: 604662 - DNA, 461 bp, Homo sapiens
acccagcctatatgtgttatgggacctcactaactgaacaccacaggcagctccggccgatttcagaaagctcttccttacttggggccaagctgaccgacagggccctcgcaggtggccatgcaggtggccctgcgtagcagccctaggtcacccgtgtcatctgtgcacttctgtgcttaagttaccttgtgggcgccgataatatcagggaagcagccaaggaagcctttatattcatgattacattccatgaggaaatgaagatctttctttggctaaaacaagacacagggtggttattcctggcagagaaatccagaccatcaaggccaagaaaacagttgcccagaggacttgcatgagccaagcccctggggtactagttaccataccaagggctatgcaatcagcctagttttcctgcaagaaaacaggccccaagactactacattctcaa

SEQ ID NO: 604663 - DNA, 192 bp, Homo sapiens
gaactgacctatttcgatcctgacgtttggacaaggcccttcagccagaagacatgacaagagtacattcctccgtctaccagagcgtgcactttgtgatcctaaaataagcttcatctccgtggctgtgcgcctatgggtgcaaggggcaggattctgcagctggttttgcatttctcatccctgcaattt

SEQ ID NO: 604664 - DNA, 386 bp, Homo sapiens
ctctgaggatcttctatacaccccatacacccatctcagctcaccgtgctgggattacagtgcgtgagccactgcgcccagccccaatatgtcttaaaggcggtttgggattacagcacagtatccgccgaggacaactaaggtcttaacggggttttgggatcacgtgtcctgttgaggaaaaccaggtgtcaccatgcattagtcttccccgtattaaacaacaggcaggtgtgttcccagaacaattaaagatggtcttacaagaagtacaaatgtgccaacaccaggactttggggaccctatggatctggcccatgccacttgttacctctattacttaattccacaatgtcaatctgatactttgagagcgggtctacgt

SEQ ID NO: 604665 - DNA, 301 bp, Homo sapiens
  misc_feature (19)..(19): n is a, c, g, or t
gggggaggaaagggaaggnttgggaaagccccaaagcccagagccagcctcagggccaaaagattccagttttaggcctttttccttttaagtgccccccccccccatagcctgcatgtcccctcccagacgatggccaagaacagaaacccaagctggagccagttttttggtttgccagcatgttcaacgagggaaccccaaggggggcccccccaggtccccccccgttgggggctgtattcccggagggaagtggttgcccccttaacccccctttaattaccagtttccagcccca

SEQ ID NO: 604666 - DNA, 216 bp, Homo sapiens
tgccgagagaggacagtgatcccccaaaacccggagatggaggaggaggaggaagagcaggaaggacatggaggagccggggactcgcccgctgaagctgctcctgtcacgacaatgagtgagaagcagccgtgcgcacgcctccggggtgaccgcgccccatggggcggtgctattctgggcccgccatgaaataccgagctaccgttgcggccg

SEQ ID NO: 604667 - DNA, 605 bp, Homo sapiens
cccgggggtaaagcggccgtatttgtccgccgattgtgcgagactcacccccggttctttgtgtggcgcccgcgtcaaagtagctccacacggaatttcttggcgccgccccccatggcgcgcggacgggtttatagtggttagaaagttatataagacgggacgaatatatcgtggagagggacctatttgggatgcgatacgcagaataacaaaggtggggtggtgcccgcccctccccccctcatcagcagaaaccctcgtttgtgctccaccccccaagtagacatcagaagagtatttttaatattaggaccacctggacaccgatacagacattaaaatttattaaggtgagaagcttgatgagcatctatatgtataaagagcaatatatagagacaaacatatcacaccattttctacaacaaacatatttatacacactggcaaaatcacttattataacatgagataatataatcaccccgcgggcccttatcaacacgtgagaggctcacccacattctggtgacacacactatcaaaaatcaccaataattattattatttgtgccacccacccacatcaattaacaaaacaa

SEQ ID NO: 604668 - DNA, 327 bp, Homo sapiens
agctggagttacagatgtgagccacggtactcggccacggtcttcaatttctagtatttccttttggttttggttaataattaaagaataggcagtttcaagttaataatagttaggctcttaaaactggtaaattcagggtttagaattcaattagattttcccatagaatggggggcaagattcccagattagtccacataaagctgttaaatccaggtaatttatgtacctgatacaaggctgggcactgggaaagtggctcagtaaaggtaagtttctttcaatatagaacctcaccatgcggttaaaccatatttatatgag

SEQ ID NO: 604669 - DNA, 393 bp, Homo sapiens
  misc_feature (272)..(272): n is a, c, g, or t
cacgaggcggcgagtcgatcttcatcgccaccggcagccccatctcttcggcgtacaccatggcctcggtggcgctccgcgcgaccacggtttgcgcgatcggtatgcggaaggcggcgagcagcgctttcgattccatctcggtcagcacggtgcgtcgctcggacagcgcggtttcgatcaccagccgggccgattccaccgacggcggatcgaggtcctgcgccagcgaggccggcgcgtggcgcagcagctgctggttgcggtagtangaggagatgtggtggaacagctcgaccgccggctccggcgagcggaaggtcggaatgtgtgcggcctcgaacagcgagcgcgcggcgcgtacctggtcgcaacccatccagcaggtcatca

SEQ ID NO: 604670 - DNA, 176 bp, Homo sapiens
gcaggtccaggattgacagtgtctctgtgccactccagggaggaagagtatcctgagtaagcagggaagctgcatgtggatccacggggaagttgctctggcctcacatccagctcctccatgtgtacagctcccagatgggtgggtgttgtcggagaattgctcgcaagggcaag

SEQ ID NO: 604671 - DNA, 255 bp, Homo sapiens
  misc_feature (142)..(142): n is a, c, g, or t
  misc_feature (233)..(233): n is a, c, g, or t
  misc_feature (250)..(250): n is a, c, g, or t
tttctctttctagatttacaaccagtcaggttagactatcagcacatctgcagcatctgtgaaccttctcatctgatgacaaagaaggcctcagacgtaaaatgttgtaaacgcaaaggtggggcccacggtactgctccangagttcaagttctcagttaagctcactgttacaagtccgatgcacccatggcatgagctccatgagaggacgagacagacacgggtgttcnggggggtcccccactcnagcag

SEQ ID NO: 604672 - DNA, 734 bp, Homo sapiens
cagactttgttacttgtaaattttttctggtattacaagtgctctaattgtgaacttttaaataaaataattaaattagaaaaaaaaaaaaaaaaaaaaaaaaaaaaaaaaaaaaaaaaaaaaaaaaaaaaaaaaaaaaaaaaaaaaaaaaaaaaataaaaaaaacttgaagtacgatacgtgaaaatgacattgaacttcaggaaattttaaaaatgcggccaaattaggggcaaattgggcaatttcgcctaaaaggaagtggattaaaatataattgtgaatgatttaacaagtacggaactggaaaaaccttggagttaccaaattaaactttttagaaaaaaatcccctttttgaaaattgcagaatttggaaaaaggcccccaactgaactttataacaacaattggccagcctgaatgctaaagggaatttacaagcgtaaatattcggaaaaattgacggataaaatattgaaaaatcacctatttttaaaacaaatgtgcaaaaatcggaaaaatccctaaaaatcaaaaagatttccccaaaataggttttatgtttcacaaatttgaaaaaggacccattttaagaaacggtaactaaattcaaaagggaaaaaacccttaaaaagggtgggggcccaattcggaaaaatataccttaaaaaattttttggggccaaagtgcctaaagcctaaattggacccttaaggggaccccttatttaa

SEQ ID NO: 604673 - DNA, 135 bp, Homo sapiens
cactttgacacgtactgacacgaacgacttctgcttctgtttattcaccatcatttggtctgaaacagacagataagttccaagtaaaacggtagctgctaaaaagggaaaaccgtcttcagaaaccgtcgaatt

SEQ ID NO: 604674 - DNA, 105 bp, Homo sapiens
acaccatgttctggacccatagctctggcatctcagggttgtgatccagctccatatattgtttaccttcaaagataccattaaatgactttccgtatggatgca

SEQ ID NO: 604675 - DNA, 103 bp, Homo sapiens
gcggccgcctactactactactgctcgaattcaagcttctaacgatgtacggggacatgacctcaggaaataaacgtccttgactttataaaagccaaaaaaa

SEQ ID NO: 604676 - DNA, 1469 bp, Homo sapiens
cagactggagtgcacctgcatggcatttatctcggcacactgcaacctccatctcctgggcatcaagccatcactcccacttcagtctcccaagtggctgggactcacaggctacacagccaccacaccataggcctaattatattagtatcttattgtagagcacgaggttctcagccatgttagccccaggctggtcttcacactcctcgagttcacagtgatcccaccgtgcctacacccatccctaatagtgcatgcgcgcattaccaggccattgcagccccactgctcacccgcgcccccatcaatcaagctctttcccacatcacacccaacatcatcttccaacaaatatactcgacatcactccacatcagccacgtcacacatccaccgccctggccttctccaaaccttgtcatcatcaccacgagcccaccacccgggactgctactcacgtgcagacacaccccctcgcaacttcgactcccccacactccccctcgcacctactacacgcgcacgcaccccccacggcacctctccgcaacacgtcactccctacccccccctccagcctacacaccccctggatcactcacagcacgccacccaccccccatcaccctggcacaaccacgcgctaccacgacgcactcacgaacacctaccccataactcgcctcgacctacctcacaccccacacacgtccggcaatcaatctacctgactcatactcccaccactccaccccccccataccccacccaatacatgctcaccacacccacattaccaccaactccaccaaacccatccaccaacccccacaaccacacccacaccacccccctcacctcacacatccctcactaccctacccaccacacaccacacccacaacaaccccgacaccccccaacacacatacacacacacacaccccacccaacactccaccccacaaccttaccactcactctcccacactccaacccatccactatacctctacccaacaacaacaccacatcctcatacaaccaacaccctccactccactactcaccacacaactcaaccacctacactcataccctcccataccctaactccctacaccacccaactaaccctcctccgctcacccccaccagtccaccactcctccactccccacctactgccctaccacaaaacagggcgcatggcgtgcgcagtgttctaccctatgctcactcctccacccacaccgcgccccgcccatctacaccctcaaccaccagagcgtctccagtcttctcgcgctgccagccctcaccccctccagcccgccccccgcgcgcgtagcacactcaacccgccgcccccgacgccggcacaccgtcaccctccccggtgtcgccgggtcgcccacgccccgacggccgcacgctcgccgactggaggcgtcgcacccgccac

SEQ ID NO: 604677 - DNA, 887 bp, Homo sapiens
cggggatacccccgccggtgcaccccacaagtggtgttcctgccccggaccggccgccgcctccccaccgtgtggagaaccgttcccaaggcatcgcgcgaaagacaccgtggaaccaagtaggcccgagacggcttgtctaaaaccgccccgccggtaatgccacccccgggccataggcgccaaatcattcggggcgccaagacaacgagctctaataggagccaccccttccggccacaaagccaaggtggcgaggccccaccgtcattggctccacaggcccaccaaggatgtcccccgtctccctctacccccaccatggtgcttcgcggataacaatggcccgcaggaatattgcctgcaagaggcaaaaccggcagacgaggaaggccccacaagcacctgattggtcccccgcaagacaccttgaagtctaccaagcacccccgcgccccaaccgcgaaggcccaccaaccgcatgtggggacccacagagctgggtcccctgagagttacaaaccacaggaagaacagttgttacccatccgcaaggcacacccgcctcccctatatctccagaaagtgcaccacccccaacatcttgttatacgggtcttcctaatataagcgaacacttctccacaccctattcaggcatcacacatttttcgagtttaaccctcttctatatcccctaccaccctaagttattggcacgcaccacacatctttctccccaaaaaaattcaaaacaatacaacgtaaaatgagtagtaggtttcaaaaataccaccccctgccgtaattactccccagtgtgtttctccagaacaatgatgggcccaaaagaaaagccctcaaaaaatttcttcaaaaacataaca

SEQ ID NO: 604678 - DNA, 225 bp, Homo sapiens
gcttggcctcccaaagtactgggattgtagtcgtgagccactgtgtctggcctctcttttatttattttgtttttatttatttataaatgagacagtctcgcccaggctggagtgcagtggcgcagtaacggctcacttagaactcctgggtttaagtgattctccacctcagcctcccaagtagctgggaccacaggggtgcaccacatgtctggctaatttta

SEQ ID NO: 604679 - DNA, 103 bp, Homo sapiens
tcattgtggggttctgtatgacccttcatagtaaagtgctggggacgataagtgttttgcctgtaattttggttggttaaaaaatgtggtgatttagttgcta

SEQ ID NO: 604680 - DNA, 139 bp, Homo sapiens
aagcagttaatacagaccaacaaaatctgattttaaccagatactaagaaatatcctcaaaattactgtgtcatgtaggggccaaagaaagctacctagaaagatagaaaggaggacataacaataccagggtagtaca

SEQ ID NO: 604681 - DNA, 914 bp, Homo sapiens
ttacccatgtcatagtatgtatatctaggttgagacatatactgagatcattgaaatcttccttgttctcgaaatctcaagttgtggaatatatattgaaatcattcaatgtggaaactcttgagtaccatcttaataatgggcttagaagaccaagtaggcctctactgccggggagtgtgagtgttggtaaatcgaaagagattgatctatactataggagatcactcttgtaaagcgtagataatacttccattgagcattgaaataagactacgtaataaggtaagattatatgattgttccgctatttgtccatatgtcgtagtttagtgactcctttagctcaactttagtgcagatctagttgtgtcctgtcatggtgatcgtcgtctgtcgaagaattccatgaatatgccacgtcacgtaaatatctatgtggaacgctggctccttcagatgtcacgtttctgttcttcttgttctcacatagttaccctcctgtcttatttgcgaggccgtgttcgggtccacgggacgtcgtttgtttggcccgccatccttttgccatttgtgcgccttaggccctgcttattcgactagggccacaagggccttgtggtgccttcttttattcattttgtgagttggccatatcctagtcagggaattgcctctgtgtcaaagcaaaaatcggtacagtggggcttagaatgttcagggttaagaattatgtccctgccaaggggaacgtaagaggtgcgtgggaatgtattccgataaatcctaaattttcaaaccggggccatggtcaccggcggtggtaaataacgaggcggatgcccgcgaaaaatttagccgctccacacacctttacccccacatacaaaacacccacaaagatttactccctt

SEQ ID NO: 604682 - DNA, 383 bp, Homo sapiens
  misc_feature (20)..(20): n is a, c, g, or t
  misc_feature (113)..(113): n is a, c, g, or t
  misc_feature (116)..(116): n is a, c, g, or t
  misc_feature (370)..(370): n is a, c, g, or t
  misc_feature (375)..(375): n is a, c, g, or t
  misc_feature (379)..(380): n is a, c, g, or t
gtgggagggatcacttgaanccccaggagttcaaaacccagcttgggcaacatagtgagactccccatctctcccaaaaaaatttaaaaaccagcccaggtagactgggcgcnagntgtcacgcctgtaatcccagaactttgggaggccgaggcaggcagatcacgaggtcaagagttagagaccagcctgaccaacatggtgaaaccccgtctctactaaaaatacaaaacttagccaggcctgtggtgatgcgcacctgtagtctcagctactcaggaggctgaggcaggagaatcgcttgaacctgggaggcagaggttgcactgagctgagatcacgccactgcactccagcctgggcaacagangtgcnatcnnctc

SEQ ID NO: 604683 - DNA, 194 bp, Homo sapiens
  misc_feature (24)..(24): n is a, c, g, or t
  misc_feature (27)..(27): n is a, c, g, or t
ggaaaactagcgacgcatagtganttnataaaaaacaagtctggtatataactcaccactgggatccttctccagcaatggagtagttacttagatctaattgttagtgattcaatgcttaattttatgttttgtctttttagggctgaacctgcagcatatggaagttctcaggctaggagtggaattggagc

SEQ ID NO: 604684 - DNA, 316 bp, Homo sapiens
  misc_feature (21)..(21): n is a, c, g, or t
  misc_feature (28)..(28): n is a, c, g, or t
  misc_feature (47)..(47): n is a, c, g, or t
gccaatgtaaatgagatgccntcctganttcctttttccagattaantccacccattgaccatatataaagcctacctaatttctgtatgttgagtttgtatcccagcaacttaactgaattagtttacccagttcctagcagttttttggtggagtctttaggtttttctaagtgtaagttcatgtcatctgtgaacaaggctatgatttctttctttccaattttagtactctttatttttttcccttgcctaattgctcttccaggacttccaatattatgttaaataaaagtggtgaaaagtgaaaaaaaaa

SEQ ID NO: 604685 - DNA, 518 bp, Homo sapiens
  misc_feature (184)..(184): n is a, c, g, or t
  misc_feature (302)..(302): n is a, c, g, or t
  misc_feature (373)..(373): n is a, c, g, or t
  misc_feature (407)..(407): n is a, c, g, or t
  misc_feature (434)..(434): n is a, c, g, or t
  misc_feature (462)..(462): n is a, c, g, or t
  misc_feature (465)..(465): n is a, c, g, or t
  misc_feature (482)..(482): n is a, c, g, or t
  misc_feature (494)..(494): n is a, c, g, or t
gacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagngctcagaggaagtcagccccatgcagctgatcaaacagaacatctttgggccttctcagaaggtgccgggtggagagcaggaagatgctgagtcccgctacttactcgtgctgaccanaactactggcctgcagatcctgcagcagacatcttcgagggggaccagcagccggagattatttttggttntggtttccccaaggaccaagagtacacccagctntgcagaaacatcaatcgtgtgaagatntgcatggaaacaggcaagatggtgttgnttntcaacctgcagaacctntacgagagcctntacgacgcactcaaccagtactac

SEQ ID NO: 604686 - DNA, 142 bp, Homo sapiens
aaggagctggaataaggcaggtgcagacaggcttcgccctcagaagcacaggccactgaggcaggagcacacaggcagcatcgaggcagggggtggcaaggctgcacatccagaggcctgtctcagtgcatgaaacggccat

SEQ ID NO: 604687 - DNA, 245 bp, Homo sapiens
tatacggttttagaccaatgccttatgcctaggagatgctctgttaggaatagaaaacgctggccaggcgcggtggcatcacgcctgcaattccaacaccctgggaggccgaggcgggcagatcacgaggtcaggaaatcgagatcatccttgccaacacggtgaaaccccgtctccactaaaaaaaaaaaaccctactccactaaaaatcttaagaacagaaaacacaaaaaaaaccaaacaaa

SEQ ID NO: 604688 - DNA, 1105 bp, Homo sapiens
ggtccaatacatgcctcctcctcgcactggccagtcgagtccatcttgagagagttatgctagattcatactgtctacttgaatcaactgctttattgataggtctcgttcttctcacttctgcatgcagttgagccaatgatactgacgagaaatgtcatctctcttctatcttgtggttagcttgtctggtaacggcacgataaacagtttactgtgtagtaagttcaggatagattcttatggatggcgtcgtgaagttatttgccatttgtcacaatcacactatagtatgcgtgggagccccgatcatggacatggcttattaatgtaatcaagtcttgcgttcacttgtgattgcagcacacagtagtaaggtgacacaacgcatgagagcgaccggagcatcttatcccatgtaattctgcctcatcgtaaccaggtgtggtgtccagatctccgcagaatccccaggtgcctgctatgatctgtcgggccagagtgaaacgagttaaggtgggcccatcgctaaacggcatgtggccttgaccaggttccgacccaaggggcgatactttatgcataaattgtgagtggaccatgagattgtggaggcgtcgttcccaggttactaaccagcaagattccatgaagctccgagaagagtaggtaacctataacaaagaggaactctgcgtgtgattcttgcgcagggggcacacagacccctacgatctctaacgaatttggacagacctcggagatgggcggaacggcactaaattcccattcctttcgcccgtgtcgtttcgatttggagaaccacattcctttgccgtacagtaaaagtggggagggcccgaacggccaaccttcacctctttgacacgcaattccaattagggttgcgcaacggaaatcaccttctttgtggatcccaacaccgtggctgtggtaggagaaaactttttccccccgtgagcggccctacagcgggaaagacattggacaccaagcggggcatcgcagtgcgctacgtgtacttggattgtggcacaacacgccaacaaaggaattcgtcggttcgcacttgggggaatcgccc

SEQ ID NO: 604689 - DNA, 1165 bp, Homo sapiens
  misc_feature (595)..(595): n is a, c, g, or t
agcggggggcttcccgaacctcttcagaccgcccggtagccgctcccggagcccggccgtataggctgcaatcgcatccgggagcctcggcaagactcgcgccccagagcctcgccgctcgtccattcgagggctccccaaggccgtcgccaattggtgaatgcgtgactgttcaacgtccgtgtcttggctcctatgaattgggaggctcaatggaagggaacagagccacaagaagactggatgagtgagagcggctcaattcattccgcacaccacagtatccgaccagtccgtagtgtggtgactggctagaggtggatctcctacgaattggatagtagagtaacccaagtatggacgcataaggaacgatgacctagtgtgattagggtgctatgttgctttatgagatctaaggcgatttattgctatgctatgttgtaatacttaggatggagcaattctcgtggctagacaatactagattatttgtgatacttacaacacgcacgacttgaaaccgtagatactctaaccttgcttggacaccttatccactggctaccccgttcacaatggattgcaattgttncatacttatacaaagtgatagcgccctgcatggcagaatttgacctccagggaatggcatacttcctagtacaggaaacaaattttgacacggaaagaaactaagtttaaaacccaccttcgtattgtacagggaaaggaaaaggaaacgctttggacacgttatatatttcaccttggtagaactgtgtgttcccccctgggaagattattggacccttaattagggctggacatcccttggcgcataaccaagtattgctgtgcccatagggaggggtctctaagagccaaaagggacaccaacgttataagcaatggccccgtttactgtataaggcaattacttggaaaccctccttggaggaaattacacagggattggcccataaagtggcgtggaactgtcaccgcttcccttgggaaaaacacacacttaaacccaaatgtggtttttatttgggcccaaaacacccaagtaaaacaactccattaactttgtgaaagggtttcaccgtctgagttttcaccaacgagtttctaaaagggtggctggagaagaaacaccgta

SEQ ID NO: 604690 - DNA, 1090 bp, Homo sapiens
attctagaggccgaggcggacgtgctgtttctttttttattttatttctcttgaaccagaaaaaagaattggttaacctaccatttcatgggtagtatggcccacgggtgaaccattttttggtggtgtacaggcgtcatataggccttggccttataatggatctctttacgggttcaaaaacacacaataaaacacaaattggtgtcgggctcactgggacagtgtcggtatattcaccaagatcatcaactacgcagattgtcagttggccacattgagaagtccttaatgagacaattgcccataactctacaagaacatttggtcgcatctcctattggcgggttatcacatatacagagtgttcaaaagaatcttgtgtcacacagagcgtcttctgtaaccgtggtgccatttacaactatactcccctttaaaaaatatgagagctctgggttggaccgtggtacacccgcttttgggaacagattatttgcactttagactgttacagatgtgggcctaaattccccaagcctcctacttcttcgaggggaaaactgtggccccaaacaaagggctatttccccaattgtgagggcggcaacctgtggggtgggcccgtctgttataaccagaggggtgttgtcaacaatgttttgtgtgcacccactccgctagttgtactaccccattgttgtggcgcataacatatatattccagtgggcaccgagcaacgacttatttgctcaactataaattccccccaattgatgtgatggagagcggccaagtagagatgtgtttgggcaacctatggaacgtatatattttaaccaagtctcccttttttaaacaaaaacccaccgtgtctctcccccgagtgtgggctcataatttattagaccccgttttaatcaccacaaatcaaatattaacgacgaagcggttgtttctacccacccggaaccttacttctactgggtcctccagagacctatcacaaaaacacatacaacaagagacaaactcacacgacataacaacaacataacagaccaacaaaccaaacactaaaacaaacac

SEQ ID NO: 604691 - DNA, 422 bp, Homo sapiens
  misc_feature (1)..(1): n is a, c, g, or t
  misc_feature (6)..(6): n is a, c, g, or t
  misc_feature (107)..(107): n is a, c, g, or t
  misc_feature (122)..(122): n is a, c, g, or t
  misc_feature (131)..(131): n is a, c, g, or t
  misc_feature (156)..(157): n is a, c, g, or t
  misc_feature (179)..(179): n is a, c, g, or t
  misc_feature (333)..(333): n is a, c, g, or t
ncgagncacgatccccttaccatcaaatcaattggccaccatggtactgaactacgagtacacgataggcggaatatcttcaattcctactattcccccattattcntagaaccaggcgacngcgactctngacgttgacaatcgagtagtatccnnttgagcccccttcgtataatanttacatcacaagagtcttgcattcatgagctgtccccacattaggcttaaaaacagatgcaattcccggacgtctaaaccaaaccaccaccgctacacgaccgggggtatactacggtcaatgctctgaaatctgtggagcaaaccacagtttnatgcccatcgtcctagaattaattcccctaaaaatctttgaaatagggcccgtatttaccctatagcaccccctctaccccctctagag

SEQ ID NO: 604692 - DNA, 253 bp, Homo sapiens
cggggatcgcatacggatgcgtgcgggcgatatgagtcaccagattaaggattccttttgtgcccacaaatgatctttctcactttgcacaacttgtatcttggcctcctcaggtgtaatacgatgtacagcatagcgacccttggtgtcatatatctcacgtgtattctctcccgtcttgtcaatgctgatgacatccatgaatccagcaggttaggttatatcagttcggaccttgccatcgattctaaag

SEQ ID NO: 604693 - DNA, 431 bp, Homo sapiens
acaaagatggtaaagcagtcattatatggctccatgtgccacacagagcaaacgtgaacatgatgagaaaaatgggagatattaaaaaatcttcatagtctccaatcttcaggcaagagcaatatgactaatgtgtttctgtagcctgttgaaacatctaggcagaatgtggctgtactgccctgttaacaacattctccatggagttgggagaggaacgaagaagcctgcagagaactgaatgtacacagggagctgctgagatgtggctggtctggggccaaacagctgagcaggatcagttcagaaatgagggaaaacccgggatgttcctttaaaaagcacatcattattggtggccttgtgcccctaattctggttcgcacacagaaaaagtgacaaattccatgattagctaaaaagaatcagag

SEQ ID NO: 604694 - DNA, 218 bp, Homo sapiens
actagcacgcgctaacaagaagcaatggtgcaatccagttaaaattgttgctgttagaaaatgctttcgacgagactactggacattatttcagaggaggggcaacagtgatggaggtatagtagttgaagactgtttgatttagctccaaaacttattataaaacaacaactcccatcaagatttctttaaagaaggctcatatattccaacgtatg

SEQ ID NO: 604695 - DNA, 612 bp, Homo sapiens
  misc_feature (2)..(2): n is a, c, g, or t
  misc_feature (4)..(4): n is a, c, g, or t
  misc_feature (15)..(15): n is a, c, g, or t
  misc_feature (604)..(604): n is a, c, g, or t
gncntgccggggccngtcagaagcaatatctggatggaatgaaggagaatgagacttcgggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgcgttaaataatattatagcatttcatatatggtataagaaacttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgngcatctga

SEQ ID NO: 604696 - DNA, 341 bp, Homo sapiens
gacccctcataatgagtgcccagtagctcatagatcctgagtcagagaagatcttggtatgttgaaagatctggagcctaatgagggcaaatgatgctgctgatgagatttgagtgacacatatctgggcttcaaaaaaaaaatcaacggtgaccgggtgcgtggtggccacgcctgtcatcctagcactttgggaggccgaagctggccaatcgtttgagctcaggagttcgagaccagcctgggaaacatagtgagacctcgtctctaaataaaaaaagaaataagaaaaagctccagggtccttttcttcccttgatgttggatagctaagatactac

SEQ ID NO: 604697 - DNA, 928 bp, Homo sapiens
  misc_feature (93)..(93): n is a, c, g, or t
  misc_feature (105)..(105): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (144)..(144): n is a, c, g, or t
  misc_feature (151)..(152): n is a, c, g, or t
  misc_feature (154)..(155): n is a, c, g, or t
  misc_feature (158)..(158): n is a, c, g, or t
  misc_feature (163)..(163): n is a, c, g, or t
  misc_feature (167)..(167): n is a, c, g, or t
  misc_feature (175)..(175): n is a, c, g, or t
  misc_feature (178)..(179): n is a, c, g, or t
  misc_feature (185)..(185): n is a, c, g, or t
  misc_feature (187)..(188): n is a, c, g, or t
  misc_feature (207)..(207): n is a, c, g, or t
  misc_feature (215)..(215): n is a, c, g, or t
  misc_feature (217)..(217): n is a, c, g, or t
  misc_feature (222)..(222): n is a, c, g, or t
  misc_feature (226)..(227): n is a, c, g, or t
  misc_feature (234)..(234): n is a, c, g, or t
  misc_feature (243)..(243): n is a, c, g, or t
  misc_feature (251)..(251): n is a, c, g, or t
  misc_feature (253)..(254): n is a, c, g, or t
  misc_feature (256)..(256): n is a, c, g, or t
  misc_feature (267)..(268): n is a, c, g, or t
  misc_feature (270)..(270): n is a, c, g, or t
  misc_feature (277)..(277): n is a, c, g, or t
  misc_feature (284)..(284): n is a, c, g, or t
  misc_feature (289)..(289): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (301)..(301): n is a, c, g, or t
  misc_feature (307)..(308): n is a, c, g, or t
  misc_feature (311)..(311): n is a, c, g, or t
  misc_feature (318)..(318): n is a, c, g, or t
  misc_feature (322)..(322): n is a, c, g, or t
  misc_feature (332)..(332): n is a, c, g, or t
  misc_feature (336)..(336): n is a, c, g, or t
  misc_feature (359)..(359): n is a, c, g, or t
  misc_feature (363)..(363): n is a, c, g, or t
  misc_feature (366)..(366): n is a, c, g, or t
  misc_feature (371)..(371): n is a, c, g, or t
  misc_feature (373)..(373): n is a, c, g, or t
  misc_feature (375)..(376): n is a, c, g, or t
  misc_feature (379)..(383): n is a, c, g, or t
  misc_feature (385)..(386): n is a, c, g, or t
  misc_feature (392)..(394): n is a, c, g, or t
  misc_feature (396)..(397): n is a, c, g, or t
  misc_feature (412)..(412): n is a, c, g, or t
  misc_feature (418)..(418): n is a, c, g, or t
  misc_feature (429)..(429): n is a, c, g, or t
  misc_feature (436)..(436): n is a, c, g, or t
  misc_feature (451)..(451): n is a, c, g, or t
  misc_feature (455)..(455): n is a, c, g, or t
  misc_feature (474)..(474): n is a, c, g, or t
  misc_feature (476)..(476): n is a, c, g, or t
  misc_feature (478)..(478): n is a, c, g, or t
  misc_feature (482)..(482): n is a, c, g, or t
  misc_feature (486)..(486): n is a, c, g, or t
  misc_feature (488)..(488): n is a, c, g, or t
  misc_feature (495)..(495): n is a, c, g, or t
  misc_feature (498)..(498): n is a, c, g, or t
  misc_feature (504)..(504): n is a, c, g, or t
  misc_feature (506)..(506): n is a, c, g, or t
  misc_feature (565)..(565): n is a, c, g, or t
  misc_feature (576)..(576): n is a, c, g, or t
  misc_feature (580)..(580): n is a, c, g, or t
  misc_feature (582)..(582): n is a, c, g, or t
  misc_feature (590)..(590): n is a, c, g, or t
  misc_feature (597)..(597): n is a, c, g, or t
  misc_feature (627)..(627): n is a, c, g, or t
  misc_feature (646)..(646): n is a, c, g, or t
  misc_feature (883)..(883): n is a, c, g, or t
gaaagtttttagatgaccaatattttgttccagaaacatacagccttatcagctaattcataaaagagctattttacaaaggtacatctgganaattagaacaanaaagncntntaggcatttcaaaatgtgatcagtaaaaanacatgannannaanaaagnattnaaaaaganagnnccaganannttaaaaaagcaatttcggnaaaagagnanatgantgannggagaanaaggaaaanaaaaagtncnngnaggaagaggcnnanaaaaaanaaccaanagtgngcananganagnaaccannttnggaaaanatcngcttagcagnaggnaccaggaaaagggggggaaggcnaccnacnaggangnannttnnnnncnnaccaannnannatcaaaaccctcaanaccagnggggaaggcanaaggaanaaggcaaaaggaacncttntcttgaggaaagaaaaatntngnagangacncngaaaagnggnggaaanancaggaaaaaaatgacttaaaaaacaaaaaatgaaaaaaaagggggaaaaactagccatnaggaagctgantgtnangccctgcnaaatttngtattttgaagagtcctatgcaacgcagtntctcagtgggtgccctctngtgacatatagaggaaggaaatactgaccaaagctctagtaattcaaaaccatatatcgacttcagagaagaaagcttccactttgaaatatggaagccccacgtattacaccaaatttactaacatcaaagaggaaaacaaagatgccagtaaaagacaattcacaggaagcataattactttctttagcttctaaaataatttttaaatgggcttctctattatccctcctaacncaaaatcatataaacaacaacaaccacaactttttaaaaggggat

SEQ ID NO: 604698 - DNA, 113 bp, Homo sapiens
gggtcgacacggccgtgtattactgtgcgaaagaattacaggggaagcagcagctggcgccgccgtactactttgactactggggccagggaaccctggtcaccgtctcctca

SEQ ID NO: 604699 - DNA, 125 bp, Homo sapiens
  misc_feature (20)..(20): n is a, c, g, or t
ctcttttagttaatgttacnatgctgtgttgaacctcatagagattaaattgtctgtatatgagttcttaatgcgtgattctgttctttatctctgatatgtctttttatatttggcccattata

SEQ ID NO: 604700 - DNA, 459 bp, Homo sapiens
gctctcagcgctgggaggtgcgacagataaagcgagacagaccaaggagtaaatgccttggggtctgctctttgcgaaggaagaggatggaagtactaacagcagacgggtctctccaagtctgggtcctacgcagggcgcaggtgggaggggaagggagaggtaagagtcttcgctcacctcttgctgctgcaaaggcccaagtgctgtctaacaaggccagcaggttctccaagctgtatctagcccagagcattcattagcagtactctaccacgcctgcttcaaaaatgatctaagtaactacagtaaagacagggcattaaagccttaaaaccagaagatggagggtcttcctttccacttgtgctcctctagccagagggctctaggggcgattctattcttcttttccaggcacaggcagtcggacacacgaagggccgatcgggggcgtgg

SEQ ID NO: 604701 - DNA, 162 bp, Homo sapiens
  misc_feature (10)..(10): n is a, c, g, or t
  misc_feature (50)..(50): n is a, c, g, or t
  misc_feature (84)..(84): n is a, c, g, or t
gtttttcatntaggaacaaagctcattgatttaaaacgtgggcagaaagncttttgcataaaaggtgatttgttgatatctatncttcccggatcagaagtttcaatagattaaaatttatcagctgttttcagatagatttagtgctctaaattttataaa

SEQ ID NO: 604702 - DNA, 861 bp, Homo sapiens
ggcattttcctgcataaccctttcaaataggagacaatttcctggccgggcacggtggctcactcctgaagtcccagcgctttgggaggccaaggccagtggatcacctgtggtcaggagtttgagaccagcctgaccaacatgatgaaaccccatctctactaaatacaaaaaattagccaggtgtggtggcgcatgcctgtaattccagcttcttgagagactgaggcaggagaatcgcttgagcccaggaggcagaggttgcagtgagctgagattgcaccattgcactccaacctgggcaacaaacagcaaagactccgtctcagaaaaaagaaaaaaaagaagacaatttcctcagataaagaaaatggaccgcttatacactaaatacaaattatggatcagctaaccctagttattgctctgtggacggaaataccatgtcaggtattatcaggtatatgctaacagataaaagctgcataacaaaaccaatcaagcaacaaatagtttacaagcaaacatgcatcttacatatgactgtacaggtaccatatttgcgggtgagttatgcggtgagcatggacagagttggaatccagcatcagcacaggatccaagatcagccacaaccagtcacatgggtctagccccaaatactgtgggaagagatgtacaaaccccttaatgaaaccaaaggaggaaacagcaggatggacatgaggattgaaacatattaataacaacacagaaagatcatagcacataaatggacgcaaaccaacgacaatcaagatacaaagtggaaacacagaagaaaaagacaaaaagaaccaagacgcaagaaagaaaaagccc

SEQ ID NO: 604703 - DNA, 190 bp, Homo sapiens
ggagagacctgccacttggctgtagagtgcttaactaatagatgtagccactcctggctgctgttaaaagtatttgaatagacatttgattgattgagttgattcactttatgagatggagttttgctgttgttgcccaggctggagtgcaatggtgccatctcgggtcactgcaacctctgcctaccgt

SEQ ID NO: 604704 - DNA, 383 bp, Homo sapiens
cccggaggtagtcccgtttcccggaaatccgaacccttgagggtcagcccccagactgcgttggaagaaaacgagactcagaaaaaagttccccagggccagcctttggaggcccctgcagaccagtcgaaaggtttcttgcctccctgaaggacctgtatactgtgtatgcgggcattccccctttactcccgggctgaatgttgagctatttttaaacagttgaactgggtaaatgttttttgatctttaaggtattatgtttgcctttttttagttatttttggggtgtcccaaagctcagtttcatggtttgccaaaagcagttatgtgaacttttatgttaggccctttctaaataaaaaattccctagctgcttata

SEQ ID NO: 604705 - DNA, 176 bp, Homo sapiens
gggggtttttttttcccccgggggatttttttgtttttaggggggggctttccccccccccaaggttttttttattggggaaaaaaatgggcccccttttttttaattttccgggtttaaagggggggttttttttttggggggtttccttccccaaaaaaaaaccctttttccca

SEQ ID NO: 604706 - DNA, 1208 bp, Homo sapiens
  misc_feature (852)..(852): n is a, c, g, or t
  misc_feature (931)..(931): n is a, c, g, or t
  misc_feature (1065)..(1065): n is a, c, g, or t
gatatgtgtaagccacgcaagttgccttattcgtggctgattatactgcctttggtcattcctctgcaactcaatggtattaatacgaacacacggtggtaggcactatgatgcgcaagcataaggcgggtggcctattgcagcactgtgattatacgtaccacgacagatatggactgcgattagtcttgatcttcggcaaagtaagtagaggctgctggaatccatgaaagcaaacgttgcaacgacacttccaacatttctctccagctgactttacggtgaacgtacgaataggttcgggtgagcaaggtcacctgtcctcgactagctcgccattgcgcattttttaggacagtatgcctagatgttatctgggttcccaagcgtaattgaagtctgtttcattaaactacggagtttcatttatgctccttttcgacatgtattgcacgccgatgtgattcccatgagagaaccctatgtcgatctcctaaatatagccattgtgtaaccggggcttcaggtgtcaagcttatgggcaagcgtaagtacttagggacgtctgcaagtttgacgggttaacttacaacaagtgaaactgcgggaagcaaacggcaaactgctttcaggaagttcttggaaacctttcaatgcccaaaggattgcttctaccatactacattattctccagagcatggccgtggggccaccctgtggaacacattaggcccatttgcgtgcttggagacattggttcctagaacggggactcaagagacgagggggtccaccccgttgagtattctagcagaagctctttaacagcaacggttacgcttctattcgtngccattcaacgttggtgtcgcacaggactcgaacctcctatggtttggaaagccattcacgcacggcaggctaaaaacntggattaagccttgatgaagaactgaagttatcccaaagttgcccaacgcagatttcgggagggtcacggcttaacaatggagccttctttacaacttcttaacgaaccaggctaagcgaaaacagccggacanagccacaggaactcctacgtgaaacatctctgggggttggcaagtcacggtctccttaaaggtgcccttattcacttcactttgcccacacgactctactttggacatggcaattctttccacggctgagggctggaatcccg

SEQ ID NO: 604707 - DNA, 272 bp, Homo sapiens
ccatacgccttcacttgccgaatgtttagagactgacctgcctaggcccgtcggtctgccctaggcgcgagtagttgtgaggccatcagcccaaaatcaccagcaaggcaaggcggtgaccaggttcagaaagccttgacctctgtgcttgtggaacagagggaccaggggatggaaagctagctttctgggtagcacagtgtcaggggagccatgcaggatggggctggaggaagaaaaggcagaaagagctgactgaagtttgagttggg

SEQ ID NO: 604708 - DNA, 196 bp, Homo sapiens
gccttgggggggggggggccccttttttaacccttccgggggtttttccccccccccgggttttttccgggggggggggggggggcttgggggggccctgggccctttttggtttttccctgggtttccccttccccccccccccccccccccggggggggggggggttccccaattaaggccctttttcctttga

SEQ ID NO: 604709 - DNA, 769 bp, Homo sapiens
caaatgttctcgttgcgcccaaattgtggtgtttcccatctcgcgggggccactccccgggcggtcgcccccctttgtggccgcctgcgcgtgcttttccgcaggggtacaccccttccggggagcccgggtggcacccggtgggcccccgaccgagccccgtgtctgcggcacgccatctggagttccgcgcccgtttcctcctgccggggccgcgccctgtcccttgccgccggactcttcccttcaggccgcgggcttgcccccgtgtgtgggaggccgctttttcccgcgcgttgtcaccgccgtgacttcccccggggcatccccccagagcgggcagcttcacctgctgttttcctgcacacttcatgccgagcgccccacgcgctccctacgtggggtctcagagtcctccgccccagagcgctctcaactccccccctggcccggccccccgggaagttctttaacgagtctccccccaccgatttttgtccccgggccccacaggatcgggtcacttctcgtcttcagacaccgcaacttcggggtttacaacaagccccatgacctccctgcggtgactaccagctcacagtgcgttccaccgcgcccccgcgggttctgggcccacagctgtagagcagccactcaatgtgcccaatacagcgcaatagaggagaatctttctcttcatccagacgctggtgtcctgttcattctgcgaaaaaacccctttgggggcgccaaaaaagcaaacaaaaca

SEQ ID NO: 604710 - DNA, 310 bp, Homo sapiens
  misc_feature (14)..(14): n is a, c, g, or t
  misc_feature (60)..(60): n is a, c, g, or t
  misc_feature (143)..(143): n is a, c, g, or t
attcggaacgaggnggtgattctcctgcctcggcctgacattccaggcaggcgccgccanctcctgactggtttttgtatttttggtggagacggggtttcaccgtgttgaccgggctggtctccagctcctggcctcgggtnatctgcccacctcggcctcccgaggtgctgggattgcagacggagtttcgctcactcaatgctcaatgttgcccaggctggagtgcagtggcgtgatctcagcttgctacaacctccacctcccagccgcctgccttggccttcccaaagtgctaagattacagcct

SEQ ID NO: 604711 - DNA, 103 bp, Homo sapiens
gcggccgcctactactactattgctcgaatttaagcttctaacgatgtacggggacatgatattacattctagcaaaagaaagtcatcatagctgataaaaaa

SEQ ID NO: 604712 - DNA, 195 bp, Homo sapiens
tatgtatagcatcattattatttggtacttgagtcaagacgacatttagattcttcagcttagaagcattagtacatcattgtctagtcaggcgaggaaagaaattcaaaaccctttcttttttcttctgtcagttccctttgcagtaaggatccatatttcgcgacgtggagggtacctgaggctcgagattcg

SEQ ID NO: 604713 - DNA, 117 bp, Homo sapiens
ctttcccccccttcggccataaggggccggaactgtttttttttggccctcccctccccgtttattttcccgggtttaaggatggggaaatgggcctttccaaaaaaaaccctttga

SEQ ID NO: 604714 - DNA, 418 bp, Homo sapiens
  misc_feature (92)..(92): n is a, c, g, or t
  misc_feature (265)..(265): n is a, c, g, or t
  misc_feature (358)..(358): n is a, c, g, or t
ggctgcggggaagtatccagaggcagcagcccaggtggtgcagtgggtgagctttgctggattccgactatacgtggcccccaaggccaagntaaccttgtggtggttccccaccttgggcatcatgcaccacaacaaacagggccactgagaactgcaaacggaggaagtgaggcgaattctggggggctggctgggattgctttaccttggaagacgaggacttttctggtgggcgaacgagtgacattggctgacatcacangttgtccttgcaacccctggttggtggggctctataagcaggttctagagccttctttccgccagggcctttcccgaataccaactcgctgtngttcctcacctgcattaaccagccccagttccgggctgtcttgggcgaagtgaaaccttg

SEQ ID NO: 604715 - DNA, 500 bp, Homo sapiens
  misc_feature (69)..(69): n is a, c, g, or t
  misc_feature (471)..(471): n is a, c, g, or t
  misc_feature (486)..(486): n is a, c, g, or t
  misc_feature (498)..(498): n is a, c, g, or t
gaacatgttgcaagccttcctccacctgacttgccaagtccatacaggctggggccttagatcaacaanttagaaagggtgcccacactcctgttctttagaagaaagggacggcaggagtctgatcatctgtccgatgcccacacagtggctgtgctgagtgacgtgttgttttgaggatgtccctaccccctggtcttgccgtcggtctccagtacccagcgaagcaagctgtgggctctgaggagctcacaccagggaggagctgccctggagtggagcaacagcatgtcctctcccctgtgtgactgcagtgctataataataataacagaaagctggcatttcttgagctcttactgtgtgccagagacaccgctctaagtgcttacacatatgtattcgttttctgtagttgctgtaacaaattatcacaaactttaaacattgaacttatggcataaagcaganaaaaaaaaaaatggnctcgttggcctnaa

SEQ ID NO: 604716 - DNA, 110 bp, Homo sapiens
gctgctctagaggatctcgagaggtgggacactgggttaaaacgagatccaagcagccagatcgcaggaggtgcgggggcgtcgtcccccttctgttctccccccgtggt

SEQ ID NO: 604717 - DNA, 101 bp, Homo sapiens
cttcaaccatttgtggtgcaacaagtggaccatctcagaccaccatacacttactacctacagctccaactaccgtgaatgtaacacatcgtccgagcgga

SEQ ID NO: 604718 - DNA, 359 bp, Homo sapiens
gcaaggatgacatgacggggcacagccttgcggacctctggcactcaagtgatcctcccacctcagcctcccaagtagctgatctacacacgttgtccaccacatgcagttaattattttttggtacatatggggctcccactatgtccccaggctgatcttgaactcttggcctcaagaaatcctcccactttggcctcccaaagttctggattagaggtgtggcccactgcacctggccaattctatttttaaagggtttaagaaattagaacaatacccatgccaccagcacagtttagggccttgcagagctttatcccagagggaatctattatctggaggtaacccgtgaggg

SEQ ID NO: 604719 - DNA, 221 bp, Homo sapiens
aggaacttacactcttctggaataaggactgaatcaaactgacctatgagccagcaggtaacaaactaaatagttacttgcctattctcacccagttcaatcagtctctgtacttgtaatccctattattgaaacaacgtgtcctggcttacactaattctagtaattatggtatgtagctaacattccatcagccaggtgcctatattctattgcttatt

SEQ ID NO: 604720 - DNA, 224 bp, Homo sapiens
acacatgtttgtgtgcaagaatgagtttgtgacagctttgcttggctgtgcgctctatgcgtaagtgagctagtgttgtccggcagctctcatctacccaactttgacactatgtagtttatgagtcttctgtctactctggaacatcatgacccaaggtttcataacaaccattcccatggttgcaaccacattctgtccgggttgctttcatcagcccatgc

SEQ ID NO: 604721 - DNA, 256 bp, Homo sapiens
  misc_feature (44)..(44): n is a, c, g, or t
  misc_feature (56)..(56): n is a, c, g, or t
  misc_feature (61)..(61): n is a, c, g, or t
  misc_feature (71)..(72): n is a, c, g, or t
  misc_feature (82)..(82): n is a, c, g, or t
  misc_feature (124)..(125): n is a, c, g, or t
  misc_feature (128)..(128): n is a, c, g, or t
  misc_feature (140)..(140): n is a, c, g, or t
  misc_feature (164)..(164): n is a, c, g, or t
  misc_feature (169)..(169): n is a, c, g, or t
  misc_feature (172)..(172): n is a, c, g, or t
  misc_feature (198)..(198): n is a, c, g, or t
  misc_feature (236)..(236): n is a, c, g, or t
  misc_feature (239)..(239): n is a, c, g, or t
ggcacgagctttcctttcgcttgcattccatctctattctcttntactgcatacantttcnctccattccnncccattccantcaattccattccattcaattccattcccatttgtttccatnnctnctccgattccanttctttatattccatgccattcgnttccnttnctattggattgcattacaattcgggntcattccattccagaccattacatttgactccattccnttncgggccctttcaatttg

SEQ ID NO: 604722 - DNA, 197 bp, Homo sapiens
tcattatgctacagtcgcaagctaatacatgtaaatgctatatcaatggttgctgggccaaggaacttacttggaatattgtttccaaatattattgatccacagttagttgaattcaaaggcatggaacccagggccagagggctaagccgtcactttgaactcaggtaggatcgagcgggtaggcatgaagactt

SEQ ID NO: 604723 - DNA, 127 bp, Homo sapiens
ctatgttgtgctggtctgtggctgctccgcaggtttatgcctgttgaactccagtaactgatccccatactcgaggccagcctggtgagcgatgctccccacggtcaccttgtgagacgtagatgct

SEQ ID NO: 604724 - DNA, 134 bp, Homo sapiens
gtaggatgatggtcctgggcccacccagccctaaaccttgcagccttaggaaaagaggtgtgtcacaggcttcctccctctctagacaggggctcagcactcaggcatggagctgcattccagctgagatggca

SEQ ID NO: 604725 - DNA, 312 bp, Homo sapiens
  misc_feature (42)..(42): n is a, c, g, or t
tgagaccgagcctagctctgcaccccaggatggagtgctttngcatgatcatagctcattgcagcctctaaggcctgggctcaagcaatcttctttcctcagcctcctgaggagctgggactaggcacatgccaccatgctcaactaatttttgaaatgtttgtagaaacagggtctcactatgttgcccaggttgttctagaactgttgggctcacatgatcctcctgtctccacctctcaaaaagtactgggatcacaggcttgagccgccactcccggctattcttgggctttttatgatttgtcagca

SEQ ID NO: 604726 - DNA, 181 bp, Homo sapiens
ggtcctatttaggactctagaaagaattcaccttgtgggctattcttgcaccaacctagtgctttgccacatttccttgatattctatgagacttgagagaggggacccttaggcttaactttcttagtcgggtttccagatgttcaatgtgtatagatgagagttgagagcaaagctcct

SEQ ID NO: 604727 - DNA, 1032 bp, Homo sapiens
  misc_feature (518)..(518): n is a, c, g, or t
gcgcgcgtgcgtgctctccggtcatgtagggacgaaggcgaacaacgtatgtatcagagcctaggctgtggagggtccgcgtgtactcagacgcgtggcaagtgacctatagggcgtgacggagtctgacgcgtcccgaatgccactgagagccaagtatgataccgagtcggaggacgactgtaagagaccctttatcgcacgcagtaccgtacttggagttactcttagaagcgcattgcattgcactagctgcgtgtgcacagcgcatactgaggcctcttggggacggcataagcgctgagatgctgtgtgacagcattgtattcgtgtcacaggccacgcgtatttccagtggcgcgcttgacctgttggaagcgcttcgcagcgttgaccatatagtcaggccgactaagacgctgtcgcgctcgtgatggactcatcgattgtttgtaccgacattgtttgcagattcgtaccgtgaccgtagatccataagaggatgtcagtcttgtggncctcttgagctgacacggggcacgtagaatctgttgtcatgagcgttcctacagtaaggtgcctcgtactctggcaccgaagaacgatgaggtacataaacgagctagaaacccccatggtctgggtgggccgcttgggtcggcgggggttgcagcggcccatggaaggtggcctggactggtgcgcgggcagtggcgtcctagctaatctggccgcagagggcatctcttgcgagagtgtgaagccgtgaggggactttggcggggaacgcttgtcattgatgtgcccgtggccccctatgcgtggctccccgcgtggttggacggagcaatgtctgcaggcgggggaaatttgccttgcttgggtgccccggcggttggttggtctgtgggcgcgttcccaactcccccccacccttggtcgagccgtggttgaacctgccgtgttttgggcggatgggggccgtgggaccggatgttatggggctttattggattgttccttgagggggtg

SEQ ID NO: 604728 - DNA, 175 bp, Homo sapiens
cctatggagacatatgtgcatcttatgagtgtatcagttgtgcgcatgctaatttggctcttcgtataagcctggaacttgtacgaccatgaagatttaatttttttttctaggacgagctatagcaagagctattgagagtatctagttgatcagtgcagtagttggacacctt

SEQ ID NO: 604729 - DNA, 311 bp, Homo sapiens
  misc_feature (33)..(33): n is a, c, g, or t
aatcattattagtattcacatggtttcacttgnctctgtactaatatagtctctccaaatggaggaagttagatagatggaataagttctagtagttgatagtacaatggggaaattatacttaacaataattcactgtatattccaaaatagctagaagagaattgtaatgattccaacacaaaaaagatgaatgttagtttggatgcatatcccaattaccccgatttgatcattacacattatatacacgtatcaaaatatcacatgtactacaaaaatgtgtataactgtaatatgtgaaaaaaaaa

SEQ ID NO: 604730 - DNA, 132 bp, Homo sapiens
agtcatctagaggatccgtctgagcaagcgggaaacttagctgatcctggtctgggctgtaataatttcttgagggtgccctcagcagcatcacagatgacacacgtctcccaatagtgcacttggtgctag

SEQ ID NO: 604731 - DNA, 84 bp, Homo sapiens
gcgggtcttcgacaaggagggcaatggcacggtcatgggtgcttagcttcgccacgtgctggccacgctgggtgagaggctgac

SEQ ID NO: 604732 - DNA, 613 bp, Homo sapiens
attcccctggttaagctaagggtttttgaagcacgcggtggggggttgggacaccaggggggcccagggtttttggtcccgggtccacagggattggggtttcccgcgtctttcccggggacgccttgtttgggggttctgtgggtttgggtgggaaaggggcccttcgcctatatgtcacctgctagttttcccaaggccctgcgggcctggtttgtgtgagggtttgcccaatggtgccccccctgggccggcttgggttgccaacatgccccggggtgttgggggggggtttcagccggccccccccccttgtttaataaaggccccttttgcccttttcaaaaaaaaagggagggggggctcctgggcctttggctttttggtaagggggggcatccccaagggtttgctgggggtggattgaattctggggggtgggggttggaaactgtttggggcccccttgggcccccccgtttttgtcccctttgggtggccgggggccagcaagcaaagcccgcgggccatgaggtgggttttaaaggggttttgggttttttgttttgccctaaagtttttgggttttaccaataaatttttgttggcccga

SEQ ID NO: 604733 - DNA, 418 bp, Homo sapiens
acacctgtgcggttgagatacatgtaaacatggatgaaccctgaaaacattatactaagtgagagaagccactgacaagagatcacacattgtgtaattcaattctcaagaaatttcagaataggccaatcctggccgggcgtggtggctcatgcctgtaatcccagcactttgggaggatgatgtggccagatcacctgagctcaggagttcaagaccagcctggccaacatggtgaaaccccgtctccactaaaaatgcaaaaattagccgggcatggtggcaggcacctgttgtaatcccagctactcgggaggctgaggcagcagaattgcttgaacccaggaggtggaggttgtggtgagctgagattgcgccactgaactccagcctgggcgacagaatgagactccatctc

SEQ ID NO: 604734 - DNA, 814 bp, Homo sapiens
gttcttcaacagttgcctaacttgagatcacaaatgcgtaatctctctaatatcctaaagcttggactgaactgggcagtccctgagcagaccgcacagagcttaaatgtcagtgctttccttccagaagagaaaaagaatggtcctacacctcccaatccatgggctagatacatatgccaaggagagccggatgaagaagtgtgagtgattttaaaatagtctagagatctgcactcatgggtcaatagcgttcttctggcatgtcttgctccctctgacaagtaagctataccattcctcgtcatacctaggtcgctgtattactccatttgccactaggacccgctcgtatcatagtaataaatatctggtctctcagcatgaacttacagtttgattagtgtggatactgagtaggataataggtgacacactcgttcgccaaaggctagtctattaagtgcaaatagagatagtccaagaaataaggagagggtagggacatcaccttgtgtggagagaccattgtctggaaagacaagtcagttccctgactgtatgacaatgccgtcagttttccttcgccccaaaatgtctaaagagataaattacctcctggtagaccattaatctactctttatgcatatctttggctgtagtctttttgtattgaagctcatctttaggagtgcctaacattagaacagggtaggcagaggcccggactatgcccaaatttgggaagacctgattgggaatagtcgaaagccttgatatgtgcaaagaaaagaaaccattttgatcaaactc

SEQ ID NO: 604735 - DNA, 458 bp, Homo sapiens
tctctccctctgtctctctctccctcagtctctgtctctctcagtctctctctctgtctgtcactctctctgtttctcagtctctctttgtctatcagtctctctcctctctctctctgtatttcactctctctctctctgtctctctctctttatctctcgctgtctctctctctgtctatcagtcactctgtctctctctctgtatttcactctctctctctgtctctctctctttgtctctctctctttctgtctctctatttctgtctctatctctctctttcgctctgtttctctctctctgtctcttaattcaattccattcaattcaaaaggccactctttctcatctttctctgtctgtttctttctttgactgtgaagtcaataggaggaagacgtttgtgtttcatttatttactgaactgtgaaaggtcgacgcgcccgcgaattta

SEQ ID NO: 604736 - DNA, 348 bp, Homo sapiens
ggcggcctttaaaccaaaaccaccccgcctttaaaaaccatttttggaaaaggtggttccaaaaaaataattttaaaaaaaccccgggctttggaggtggtgcaaagttttttaaaggaattttttaaaaagttaatttcggccggggggatccccttaaaaattaatgccccccccacccccttttgaacaaaaaaaaatttttaaaaggaaaaaaaattatgaattttttttttaaacaaaaaggatttctgaaatttgtttccccaaaaaaggccaaaaggttagctttcccccgcctttttttttttaaaaaaaaagtaaaaggttgggtttcctttaactgga

SEQ ID NO: 604737 - DNA, 397 bp, Homo sapiens
  misc_feature (2)..(2): n is a, c, g, or t
anttagaggattccattgtgtctcagtgggtcaggactcaaacatgaggaggcagcaagctgagtacagttctaggatacgcagccgtcccaagctggcaagtggtaacaccattgcccgtggagctgaaggacatatccgcagggccctacacctgcccagggttcactgggatgtttggacctgggcgatcgtgtgtgctaaaagaactttacaccctcttaattgagaactattgtgaagattgatgacaacatttccgatcctgatatccccggagttcatattgtgggctctccgggccaccggttgctccccccagtgcactgtggcgtacgagtgtctcaagtcggaaattggttggttcattagcgccatcccagcaaaacattccata

SEQ ID NO: 604738 - DNA, 178 bp, Homo sapiens
tatgcagtctatccctttagtggccatgattcctcgagctattgacagagccacatgcgctaagcacagtggaggatgcatgctacaaaccacaacacagaaagcacaaccccatatgcctgggcgccggccacccagatatttcaaacggcagaatgccagacgtaccaaggtccgg

SEQ ID NO: 604739 - DNA, 326 bp, Homo sapiens
ccgtcattgatttgtaagacgctttggatctcagaacaacctttctgttagtaacatatttgtggcaatacatgccatcctgggcctggtggataaccgaacaagcatggggagagaaaaggattgagagctttatagagtggtgtgaatgctgactcttcttatttaacaattctttaagacaataacattgactgcacaagagcacctgtactttttcaagccactggagggagatgtggaaaacatgaaatactgcaatcttcttatgcttctgaataattcatgaccaatcaatttattcggggtaccgaagctcgaaattc

SEQ ID NO: 604740 - DNA, 183 bp, Homo sapiens
tgtgacatatgatgcttcgcgttcagcgtatcgcaatgctatcgcatgcgtaccccacagacgcagacaccatgtgcttgcagagctcacgcgagtggttaatcctgcgatagacctgtgaaccatcgtgatgtctgatataatatgagcgtgtgatctatctaggctttatggccgtcaagt

SEQ ID NO: 604741 - DNA, 176 bp, Homo sapiens
ccgcacaaattctcccaccaactcaagcaactggcgcatgcacccaccacccacggcaatcgcagcaaagcagctcaccaatctagtcgcatcctgtcctgtgtacgggcctgggtgcagtgtatccgcgtgctatgtggtccaacattcaagcctgccaggcgcaccgctccatc

SEQ ID NO: 604742 - DNA, 1148 bp, Homo sapiens
cgttttttttttgcgttcgtttactcttgtgtggtgtctgggttgggccacattggctcggtgtggtggtttcgtgtctcgttgggtggtcgccggggtgcgttccgctgtggttgtctcccgtggggcgacccgtggtgtgggtactggcggggcttttttttgtagtcaacccggcgttgggcgttgtgcgtatcgtggttgtgcggctccccagtttgtgtattgtagacttgtcggtaggggggggaagatttggcccatgtctcccggtgtagaggggcccacggtcctggttataaggggtggacgccgtggcttgaccctggagttatgtgccagagctttaataggccttatgttgggatttgtggtaggcctgttaattgtgtgcggcgaccatggagttttgggcagcgccctttgggggttcactatgattggagctgttgtggtgatcccatcctagttttgcaaatgtggtttatgggagttttaagaaagtgtatgttgtccaggggcagccccgtggtctaacgtggaagtttctgcttcaaccttgtgacacgttgacgagctgtagagaaaaagaccaccactgggagtaataacgtgggtccacaatttggccacaatataagtactcgtctttggtgttgggacgttgttcactgaaggctgtgtttgaagtggacttatctaatgttgggaatacttgagtattccacttgaaaatggatttgttcagccactttagcacttaatgaggcacatttaaaatgccaccacgatattcactttcacggtgagcttaaccactgagatgagatataaagtcacatgctattggattgttttttgtttgagcacagtggctattctgtggccacctgagtttgactgttctgtagtgacacaagggcattaccactttcttcacctgtttcctaatttctgatcccactagttttacactttttcctgtttattttgattttgttcactgctttattttcttaaagtttctagcacactctgtgactcctccacacttccacactttttgcacctgcttacacttaacgtgcacattttattccttgtctgcacacacatgtggaaagctagaaataaatgtttaaacttta

SEQ ID NO: 604743 - DNA, 518 bp, Homo sapiens
  misc_feature (81)..(81): n is a, c, g, or t
  misc_feature (87)..(87): n is a, c, g, or t
  misc_feature (280)..(280): n is a, c, g, or t
  misc_feature (480)..(480): n is a, c, g, or t
  misc_feature (490)..(490): n is a, c, g, or t
  misc_feature (499)..(500): n is a, c, g, or t
agggaaaaatctgctaaaaatgtagtaaacgataacccagccattgtttcgggaggacatcgggatgtgtaacttcccccnaattantccctgtaggataacgttatccgtagcaccctaagattgggtcttttgagggcatttttcaagactttccgcattctggcaaactaactgacccccaccccagactcgtgaccccatgaccccaaccgcttccttctgtccccactccctccccccaagaggcggactcagctgttgaggagtgtagtcccanacccctgtgattgcatctccaaccaatcagcagcatccattccctagtgccctgcccatctctactaaaaatacaaaaaattagccgggcgtggtgcgagcgcctgtagtcccagctactcaggaggctgaggcaggagaatggcgggaatccggcaggcagagcttgcagtgagccgagattgcgccactgcactccancctgggcaanagaagcgannctctgtctcaaaaaacaa

SEQ ID NO: 604744 - DNA, 230 bp, Homo sapiens
  misc_feature (214)..(214): n is a, c, g, or t
tcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgacttgacctgtcattgngaacaattattgctct

SEQ ID NO: 604745 - DNA, 284 bp, Homo sapiens
  misc_feature (55)..(55): n is a, c, g, or t
  misc_feature (58)..(59): n is a, c, g, or t
  misc_feature (137)..(137): n is a, c, g, or t
  misc_feature (141)..(141): n is a, c, g, or t
  misc_feature (148)..(148): n is a, c, g, or t
cttctcaccaccaccctctagcagctccctcactcggagaggcggccatcagccncgnnttccagagtctggcatgttccccgggcctccccgctgctgaccgcctgtcctactcaggccgccctggaagccgacangagngcctcgngcagcatggcgactcggcggtgctggtgctgccgccttccccgggccctcgttcctccaggcccagcatggactcggaagggggaagctcctcctggacgaggactcggaagtcttcaagatgctgcaggaaaatc

SEQ ID NO: 604746 - DNA, 287 bp, Homo sapiens
gatcatactttgaaagctctacattaggagaaaatgtaaaatttgtatcaagaattactttagaataactcagttggcacagtgtgtgtggcattaaaactagatttactaagaaagaaaattaagcattcacctcttgaaatctcaaaatgccaattaggttttcacctttaatcacatttctctatataactccctctccacagagcagtcagagagatctattaaaatatcaaccagatctcctgcctaaaaccctctaatagctttgtattacaattagaaaa

SEQ ID NO: 604747 - DNA, 108 bp, Homo sapiens
tggtacccgatctgagcagtattgtgctattgccatactagtctttgccgcctgcgagcacggtgggcctagccctactagtctcaatctccaacacatattgcctag

SEQ ID NO: 604748 - DNA, 1345 bp, Homo sapiens
tagatcgcgagcggccgtccttttttatttttttttctcagggtgtcccatttatttggtctgctcaaatttaaggaatcttctcctttaatttaacctcattcaacccttctcagtggcaagaatttggaaaaagtaaatttatactcaggttcataatttaaatagggaaggaaaaagttacagcctcagggcaccagtgaagttgaaacagagaatggagacaccttcaggccccacctcttcgtgcaacgaggaaagagtgatgtggggagggagcacaggtcagcgtgtgggaagagggctcagtgggtggacagtggggggtgggggtggtcttccccagccttccttcaaatttattgccataccatgtgacacacaagacaacatgtgcagggtgtgccttgtgcaagaaaccaaaggctcagggggtctcttcaacgttcaacaaaggggaaaggggccacggaaccaatcttctgtggccttccccaggtccgcacaccaaggggcagctggtgctacaacatcttttacaaggtctggtggaagaagacccctatccaagaggccccgggggcctctggtccagctgggctttggcgagccctgggagaaatgtaagctccccttacctatttcgctatatactggaagtcttgtttcccttctctccacaagtttccagcgaggagagggggaccacgagggtccccgaggggaaataccaccagggtccccagaggggaggaaaacccgagggggccccaaggacaaaggtggtattggcccccagcgacatgtggggggcgaaccgagaggaggggctcggggcggcaaaaacacatgggggctctccccccactcctcaccaagcggggaggaaggagggggcacttcggggggcacagagaagccccctacaaatgggccttgggacaccactgtggggggcagggggtggtcaactacatcactggaggagccccattcctcgccaaaagaaagcgggtgcaccccaaccaaagagggctgtgagcccccacccactatcctgggcggaaaaaggcgttgcccaatctaccccgcgtgtgaaaaggcgccccatggaggtcttccccaccaacaaaaaggtagcccgcagggagacacaccgagagagcattgggggaggcaccacccagcgaacatacccaggctgggaccgaacgagggcacccaagggagagaccaaccccgcaggagggagagaaaacacaaccccatcgggatgagccccacagatatctctcaaagagagggggccacacgaagcgccacaaaaaacggatgatcggatgga

SEQ ID NO: 604749 - DNA, 142 bp, Homo sapiens
ccccccgggggggggggttgggggcgcgcggggtttttttccaaaaagggggggggcccccctcccccccgggggggggggtttttttttttaaaaaccccccccctttttttttttcccgggggggggggtttttttttta

SEQ ID NO: 604750 - DNA, 464 bp, Homo sapiens
tttcattgttaacagaactagcttcactgatttagaaaaatagaggtgcataatgctctggccgctccttgaacccgtgtgtctgccaatgttttggaccgttccttgacccatgtgtgtgcccactgctaaagtccactgcccaggtgtttgtgatattggttgctggggaagagtcagaaaatctccccagcaaccacagccgggtcaatccggagttgctacacctgcaccagactctttccttgtacccctcccaaacccatttcttgagaaatcattttagaatagatattgtttagattgggaaatcccctactccttccttctcctttcccccctgagggcctataaaaactgggacccctttctcctcggggtcaactcctctacccctgcgtgggatatgagtcattcccagagctctggctttccccaataaagcctcgtgtggtttgcatcaa

SEQ ID NO: 604751 - DNA, 214 bp, Homo sapiens
cctggttaaggcctggtgaacaacttgggaccatttttgtagttgaggattgttgattctttcccaagcgacaacctctcaacacggcttttgtattgtagttgagttgcttcctcttcaaacttcatcaaatgtaagggcttcttgacaaagaaagtaagccttttaaacctggcaagaggaggagcagaccatttccccaggcaatattaag

SEQ ID NO: 604752 - DNA, 198 bp, Homo sapiens
  misc_feature (80)..(80): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (124)..(124): n is a, c, g, or t
  misc_feature (141)..(141): n is a, c, g, or t
  misc_feature (148)..(148): n is a, c, g, or t
  misc_feature (151)..(151): n is a, c, g, or t
  misc_feature (153)..(153): n is a, c, g, or t
  misc_feature (166)..(168): n is a, c, g, or t
  misc_feature (176)..(176): n is a, c, g, or t
  misc_feature (183)..(183): n is a, c, g, or t
  misc_feature (186)..(186): n is a, c, g, or t
  misc_feature (188)..(188): n is a, c, g, or t
  misc_feature (191)..(191): n is a, c, g, or t
ccattcttaaccaaggctgcctcttccaacagggcgggaatcagacctactcccctaggtcacaactctgggaaggatanaaagcccccacccttnantnanttctctggatttgttctcagtncctaaaaaaaaaaaaanctgtgcntantntgtgtaatagcgnnnagggaagnaggatcnaananaanaaaataa

SEQ ID NO: 604753 - DNA, 122 bp, Homo sapiens
catggtgtatgataacttatttatttaaccatctataaatctcagtgagacaaggtgggcactactattgcccaggcaggagtgcagtgacacaatcacacttccttgcagcctcgacctcc

SEQ ID NO: 604754 - DNA, 101 bp, Homo sapiens
aagacgcatatttcgctaagcaactaaacccaacaatattatcttttctctccaatatctaacatccaactggatgaatattattatcaggctagatttct

SEQ ID NO: 604755 - DNA, 161 bp, Homo sapiens
  misc_feature (84)..(84): n is a, c, g, or t
  misc_feature (153)..(153): n is a, c, g, or t
agactcctcttcgctgtgtgggagtaaaattacaccatagtagctaaagcagcaccattagaaggtcagctcacaccactactnaaaaatccaaatatactgaatctcacaccgattggaccatctatacctatagaagactatgttagttcntaacatga

SEQ ID NO: 604756 - DNA, 253 bp, Homo sapiens
attctggagacagagtcttactctttcacccatgctggtgtgcagtggcatgattttggctcacttcagcttggacctcccaggctcaggtgatcttcccaccttagcctcctgagtagctgggactacaggcacatgcaaccacacctggcttttttttttggtagagctggggtttcaccattgttgcccaggcccaagccagtcacaaattcctgggctgaagcaacctgcccaacttgggctcccaagg

SEQ ID NO: 604757 - DNA, 642 bp, Homo sapiens
agccagtggcattgcggggtagctatgttcggaatacataaccgctgaaagcatctaaggcgggaatactagcctcaagatgagatctcactggaaccttgagttccctgaacgggccgtcgaaaactacgacgtagataggttgggtgtgtaagcgctgtgaggcattgagctaaccaatactaattgcccgtgatggcttgaccatataacacccaagcaatttgagtcgaaaggccagattgcggtgtgtgaagacgcaatgaaccgaaagttcgacgctcacaaaacaccacgatctatcacatacccaatttgctgaagcgaggccagctggccacgactcagtacccgaatttcttgacgaccatagagcattggaaccacctgatcccatcccgaactcagcagtgaaacgatgcatcgccgatagtagtgtggggtttccccatgtgatagtaggtcatcgtcaagattaaattccgaaaccccaatggcgaaagcaagtaggggtagagtatagggcgctctaatagcacgccaacttccaaagcctgtatagcgttccattgataccttttgtgcagatatccgaataccagtcgaactagcgtgtgacaaggttcacaggtggtgcgccat

SEQ ID NO: 604758 - DNA, 1015 bp, Homo sapiens
gagcgcgggcgccagttgcctccttttaaagtttgacggggcggtgtgtggcggcggccggctaggcgcgggagaacactggtgccgctacgggagcctgcgccgccggcccatgtcattccagcttcaagtgacttcatgtgatgtcagctgaatgtaaaagacagtgatctcacgcggaggcgaagatgtttgccatcagtaatgtgacatgaagagacacgctgcatggctcgtgaacgcatctccttggtggtgggggaaagagttttcccccctgccttcttccggaatgctcgacttagacggagcagacggctgcgccctggccccagcgctggctctggctcagtctccgcgcgccatgtgcaagctcggcttccctggagaccatggtgcccccggcatgccctgcgcggccggagcgtcccccgagcacttccaagacactggccttttccatctgagcgcatcatggccaagacgtcggagcccgtgcgccctttgagccccggcctggagcgctagaggctggacggcagccagggcaagaaactgctcaaccttactgctcgccgatgaccctgtatgatacgcccctcccagcccctaggctacgaggtgccgtcaaaagacactgctcagttaactcggagctctggaaaaagcagacctaccgggactgggcaggctggcagaatcggagggcccagagtgcagcagggcaaaacacgctattgttgcagagctacccgagccagaatggaagagcgaagaccattagcaagggcagagacaagaagtaggcagggccatacacggcgccgcggaaccgagcaacccggccacagagcggtcagacactgggtgcaattaaacacgcgtcaaatgacatcgtactaacaacaacggccgtcgccgacggacttcacatagaaatcgttgggcagacgagatcacaagagccaaacgaaaataaacattgaaccataaacaatcaggacgtaccactgtt

SEQ ID NO: 604759 - DNA, 1135 bp, Homo sapiens
ggcgtgtgcgagcgggtgcgcgcgcaggggacggagtggtggggagatggaggagggaggccgggacaatggcgctcggtgcatgccccatgcatgtctccagactggcggtccccgtggaggcacggacggagaagccgagcgtgcaatggatgctgggcggagatgccgtgggacaaggacaaagaacaggagctgtctgcaagaggataaacagcttcaagatgaactggagatgcatcgtggaacgactaggggagaaggatacatccctgtatcagaccagcgctggaggaattgcgaagtgcagattcgttcttcgtacaacttccatgacttcagttgcccaagcctctcaaatttctgcgtccacactatggcaaactgaaggaaatctatgagaacatgggccctggggagaataagcgtttggctgctgacatcatctccgttttgggcatgaacatgagtggggagcgtgagtgactcaagtatcggctagtgggatcccaggaggaattggcatcatggggtcatgagtatggtcaggcatctggcaggagaagtggtaaaggagtggcaggagcttggatgaatgcagagacggtcaagcgagacagctcatgtacagtctgatgcaggaaatcgtcactataacactggacgcacaaatgcagaggatgaagggttgaggagcgaggaattatggcaaatggagcaggtggacatgggtaggagaaaggaactttgatgcagaaggatatgagaaaggaactgatgaagatataacaaaggagggaaattagatgagtgacgatgagagaaacaggactgagcgcagagtggaccggagggcagtcaagtcaaccgcgcacccgacagccacaggcaagggctatcagacacaaagacagagtgaagaagaagaagagaatacaacgcaggacagaaggaagaccaatgcaagaaagtgagacagatacaggcacgagggaccggagaccaccagaaagacacgaagcgaaagagggaaaaggaaaggacgaagaaggagagacagagagggacaaaagaagcaagcagcaaggaacaaccaaggaggacagcaagcgaggagcgcacaaaaacacaacaa

SEQ ID NO: 604760 - DNA, 497 bp, Homo sapiens
tcacacgcccttggctatgaggtgttgagaataccaaccactaatttctgtgagtttggcattataacacccaagcaatttgagtcgaaaggccagattgcggtgtgtgaagacgcaatgaaccgaaagttcgacgctcacaaaacaccacgatctatcacatacccaatttgctgaagcgaggccagctggccacgactcagtacccgaatttcttgacgaccatagagcattggaaccacctgatcccatcccgaactcagcagtgaaacgatgcatcgccgatagtagtgtggggtttccccatgtgatagtaggtcatcgtcaagattaaattccgaaaccccaatggcgaaagcaagtaggggtagagtatagggcgctctaatagcacgccaacttccaaagcctgtatagcgttccattgataccttttgtgcagatatccgaataccagtcgaactagcgtgtgacaaggttcacaggtggtgcgccat

SEQ ID NO: 604761 - DNA, 887 bp, Homo sapiens
agcgggttcggttgcatcggagcctgagcagaactagagcctgcgcctgggccggcatgcgcaggcgtacagagctgcccgggggtgctagtacactctccgatgcgccgggattctgtcgacgtatccgtcacggacaccttggtcacggacgcaggatgacccgcgttgagaccagcatcacagaaggagctgggatggcacgcggctcatggcaggacgcttgaggggctggccgcacagagaccacagtacccagctcgggacgcacgaatagccaccctccaaatcgctaccgcccatcccgccacggagcgccaacccggaatacgcacacccacccaccgtgccgcggacgccccgaaccgcactccacgaaccgtacacacgcgacaccacgcgacaaaccactgagcaacaacacacaccccaccgacaccacacgaactctccgcaacacgaggcgacacacaagcaccacctcaacacgagacgccaaacactggccacccacagacgccacaacgtagcaacgggacacacacacacagggagcgagcagaccctcgactcagtagcaaacccccacgccctggaaacacaagaccaacagagcagagcaaccaccccgcacgagaagacagcacacagcgccaagggcacacaccagaacggctagaagcccagcagcgaacaagacaaccgcgccagaagaccgcaaccccgcacgagccgacagcggaaaagaacggcagtaaacacaccagacaatggcacaccaagcgataggcacacacgacaagcagacgacccacggaacagaagagcgacacacacaacgagagacaaacgcccagcagcacacagcaaacccgagccgcacgaac

SEQ ID NO: 604762 - DNA, 251 bp, Homo sapiens
ctcaaatgcacctatgcaagttcatacatgagatgagacagctcagccccacctgctctgtgaacaggaaatgatgatcggagagaggagcaccggtcagcgttggaagagggtcattgtgcacatggggatgctgtggtctccccacctcctcatattatgcctacacgaacagagactcatgcgggtgcgtttgcagaagctatgtcagggttcttcaagtcacaaagggaagcgctcagtaaatgctc

SEQ ID NO: 604763 - DNA, 259 bp, Homo sapiens
acacggaggtatattgtggcagatcaaaagcaaactcattcctgcagagaggtcctcacctcctccaagagcctcagaaggccttcgtctgggatctgtttcccctgccctacattcatgcaggacaccaggggttgatggagcttctagaaaaccaccttgtgagggggtctaggctgtaccttgcccacgggatacctggagcaagatgtgaggccccaccagactataccactaggcccctacttgttgcctctgg

SEQ ID NO: 604764 - DNA, 1437 bp, Homo sapiens
  misc_feature (379)..(379): n is a, c, g, or t
ctcaaatgtgtgctggcttttctaacctttgcccaggaagatttatttaaatccctggagattccttggtaccattactgaatagccttagggagaagctctctggaatggagagaggtatgttggatcattgtgactgccgattgggtaccgtgaaaacagtgtaaggctctagataatagcgcatcacggtcaggcacggtggatcacgcctgtaatgcgccaggcagctattgggaggaacgagaacaggcgggatcacgaggccagtgagaatcatatgaagatccttggcctatacctagtggtgaaatgcctcgctctcttactatagataactatcaagaagagaatattcacgccaggctgtggactggcngaggttgccatgttagatcacgcgatgcaaactttgggagaagagcgtgcaggcaaggagcaatggtagtagaaccctgggaaggctggaatcatcatccatttgagccgcatgggtcagctagcaacatttgcactccccgaagacccgtggggctaggcgaggacgtcaaaagaaggtcacgaatcgtcaatacatatagagaataacaaacaagaacaaatacaaaacgcaaagatataacagtcccaaggagaagacaatggacaccataagggaaacaagtgacaatagagacaacaagcactaaaagacaaccttacatataacagtacgatcaataacgccaaaaaaagatcaggcgcaatcgaacgtgcgacgtggggttccttcgcgaatctcaaccagggtagaaccactcagaataggggtttctacccaattggaagaactcctaccaaccatcgccttactaaactgcaccttataaaggaacgcgcaacggcacgacacagtcgtacggacaatccacgcgcaacgacctctgccaccgcgcaacagcatctatctccgcaccaacaccaggggatcaagaccatcctaccagtaacactgacgaccatggcaattttgagcccaacgaagaaactgggaagtagaacaatggggacgacctacgctccccggcacagacacaaataaccacatcctaacaccggacacaccaccgggcaagcagaacgactcgaccgatcaccaacggccaaggcaacataacgccccaaaaagggcccaccacgcacgtacgaacaccacgttcaacaccacacataacacacgcggcaacagcaacacgcacgccccagcacgacacacagaaaaaaccaaaataaggacgcgagagcaaaagaaagaaacaaaggcaaacaaagcacacacgcactagcagacagacaaccaaaaagcagcggaaacacacacacaggagcacggagcgacgcgaaaagcaaacaggcacgagcgagcaaccacgacgcaccggagaccaatcgaccaaa

SEQ ID NO: 604765 - DNA, 125 bp, Homo sapiens
agctccatactttatcacagagatggaatggttaaagagtccttgcacaatagatatgtagctaagtattacatatggatggaaataccatatacatgcatgtatagagatggtgtatggggaag

SEQ ID NO: 604766 - DNA, 787 bp, Homo sapiens
taccattcatacgcatagagaggctaccgaggtgtcgtcctgtttcccgtggcaggccagcactgtatgacctgggcatgtggcttctgcagctccagaaaaagcagagaaccctgctaggccatggctcccaaggcaggtgaaaggcaaaactcacgacttactatcaggtgctgattgcatgcatcgtgcactagccccacaatcatcatcatcacagcagcatctccagaaccagaagctgtgcaccttcttggctcaaccatgcatgcacagtcgggccctctatgccatcccaggcttggactatgtcagacatgaagacatcctacccctacacctccactgatcaggttcccatccaacatgaactctttgacagatttcttctgtatgaccagacaacagcacctccttttggtggctcagggagacgctaagggcctggcaagagaagaatcacccctggactggagctctccgatgttcatcgggaaacaactgagaacatacgtgtcaatgtacatcccacttctacatgggcatgagggaagaccagaattaccacgtgtactggtggcgctactgtatccgaacggagaaccttgacagtgctgtggtacagctccggaagcaggcactggaggcacctccagactctctggcaccttggagacagtgcgagggacaagggggtagatggccaggacaaccaaggatatccaacgagccacctgcgatacagtctaaacacacagtacgcatgcagcttcagtggccactgttg

SEQ ID NO: 604767 - DNA, 162 bp, Homo sapiens
cggcacgaggcctgtctctacagaaaatatgaaaactagccaggcatggtggcatgtacctgtagttcctctcacctgagtccaggaggttgaggctgcagtaggctgagatcatgccactgcactcaagcctcaagcctgggtgaatgaaaccttgtctca

SEQ ID NO: 604768 - DNA, 408 bp, Homo sapiens
  misc_feature (64)..(64): n is a, c, g, or t
agtaaacagtttcctcgctcctgtttccctgggtcactgcctctgtattccagccactcagctntagctgagcagatccagagagagaggaggcccccagtgcctggaggaaggccaccattgtggaatgggacttgcttcttggggctgaggcccaatgtttgtaatcaccatctgtaaccacagcctgatcctgcagctctggccctgctcccccagcccggacaagcaaggaggagaaaaaccaggcccaactggggccgctatagcctcctgattgccattagcaagcaagcagcagacacctggaacctgaccactatgggaggtgaaattctggcctaccttctcaccaacaaacctgtcaaaaaaaaatgcggtaaataatcatcttaacttttaaaaaaa

SEQ ID NO: 604769 - DNA, 1550 bp, Homo sapiens
tgcggagaccgggggtcacgtggggctctatgtcctgtccatgctgattcctcgatgggcgatggaacgatcctgcgctggggccctgcttgatggcttacctaacatgttaaccaagcagaggtgacatggctgccagtcaggcaggcggcctgcatgtctgacccggcagctgtccccatccaggatgaaagctggcatcaggatgcacaatgccccgcgtccgatcagtcgactcctagcgcaccatgcctagtcttgacacgggaccagatgggctcacgaaatcacttctcagtatgctgtctcccgtaaatgaggctccgcatgcaaggccttggctcttcctcagtctgactgcaaagaccccccagagccgcttggcacaggcaattctcgagcatacctccttcccctgccagcggaccgtacgccccaaacccttctgccgcgctatgcacctgcgccaggcccttcaacaccagggtccccttggcagccggcgcacgggcttggcaccgcgcgcgcacaacacccttggatggccttcatctccctaactccttttcccacttaaccaacttgcacccgtggctgcggcgcccaccgaacgcaacggaggcccctttggcctcccatttctaacgacaccgcctttatctcccccactttggagtcaccactttgtcggcctctcccatcactttaaccacaacagcctaaccttccgttgttataacggaaaaggcaatttttggcacagcattttaaaccccccttcttcaccattccaaaagagaccctattgggattctaccccccatcctcgcgacaacacacaccccccttttggcattcccaaccaacctaccaccaccttttggctttctacccaacctttaacaacccctaaaccattcttggggcgcaatcatattaagggatcttccccatataacgaccgcattcccgttttccccgtttaaacacacgcgaccgctttgcgccaaacctttgggcaaaggccctatttacgaagccgcgcgtctacccgcaccttagggccgcacgcaggcaccataatagggacgccccctcacattatatcgctggggcaaacgaaaataaagacctcacacaaccatctgggactttactccgttcagaaacaactatagggccccccactcaagcgcgccaacaaaacaggccgggcgcaacagaacgcccccgaggatgaccaaacgattaggggagacgcgcatataagaggccccgcaccaggcgcccctccccaacaaccgccgcccatatcatctatagtggacccccggaccgtgcagcacgtacccaggcgtcattaacacttctgggcacttacggcaatttaggcggtacacccccaaaacgagcgcccgcagtctcccctatctatcaagcagatcgccacccccaagagattttcgacgaacgcgccccaagaaatggagcataccccgtttaaaaggtataataacaagccccattttatcaggcagagagcggcactc

SEQ ID NO: 604770 - DNA, 165 bp, Homo sapiens
cacaacaatgggacaggcgcgatgattcacgcgtataatcccagcactttggggggccgatgggggtggatcacttgaagtcaggagttagagaccacccttccacacattagaggaacccttatacataaaatctagacaaaaaaggaagaaaatgagcgcccg

SEQ ID NO: 604771 - DNA, 377 bp, Homo sapiens
ggtgctaccaaaaccaaaggaggaattttgcaatcaattaggcgggttgtattagaatgtgaatcagatcttgaagcttatcggtgctttgtgcaggtttttattcctcaaaaatgcatccaagctttggtgtgggaatcttgttacatgtgaggtgggttggtttatcttttcttagatcaattccgtttcttttgcaaggaagggggtttctgtgccctcggtgggatcaagggcttgatcctcacgtctgctcatgagacaaaaatggacattcggcagacagaccacaaccagcgcatgcgtccagctttgtttgaatattttagtttcgaagttctccacagacaaaagaacaaagaaaacgtttgcgtccg

SEQ ID NO: 604772 - DNA, 437 bp, Homo sapiens
tgcgtaattattactgatacttttcccttttgtacctgcgtgcattcaagcatagcatcatttatgaaaggatgtttttaaaagcagtctgaaaatgggacatctgtagagacattcatttccttcttctcctccgaatgtggaatgtaaggtctgagggaatggaaacgtaggaaaagaggcggaatgggaatggaatgggatggagatagtggatgggataggaagagagggctggggaatgggccgagaaggtggtgctgagtgtgctgtgagatagagcaagatcacaagaagtggctatttgtaattggctttaagataaggtgctgaagctgactgtaatgtcgctagtgcgtgccgatgtccattttgacaagaattaaaatttccagctagttcacattgatctcgtccgtgctgaggcatccactcca

SEQ ID NO: 604773 - DNA, 318 bp, Homo sapiens
  misc_feature (214)..(214): n is a, c, g, or t
  misc_feature (253)..(254): n is a, c, g, or t
  misc_feature (257)..(257): n is a, c, g, or t
cagacagcccagcgcacaccctgggcctggtagttaaagatcgacccctgacctaatcggttatgttatctatagattacagacattgtatagaaaagcactgtgaaaatccctgtcctgttttgttcttaattgccagggcatgcagcccccagtcacacacctgctgcttgctcaatcgatcacgaccctctcatgcgcacccccttagagntgtgagcccttaaaagggacaggaattgctcacttaagnngcntcgctcttgagacaggagtcttgctgatgcccccagccgaataaaccccttccttcttttt

SEQ ID NO: 604774 - DNA, 137 bp, Homo sapiens
tgctggacgtgcggacttacacttttttttacccttgtggtggactccatgtcaactaacactgtggggacgggacaggctgtgtgcgcttgtcttgggtgaactgtctctgtggctgtgtgactctggtgagccag

SEQ ID NO: 604775 - DNA, 120 bp, Homo sapiens
tgctgcacgggcactggcattctgcagcttacccttccacgactagaaccttaggctttggggagttttagatggactaggttctacttaaaggattgtattatatattattctttttga

SEQ ID NO: 604776 - DNA, 101 bp, Homo sapiens
cactgatctacggacctttaagttgtgcatggagaagggggctttttttaaacttgaagaaaccagcccattctgtgtgtgtttggaggaggggagcctgt

SEQ ID NO: 604777 - DNA, 127 bp, Homo sapiens
agactaaggagagaacacttaaacctgctatacagaaacataaggctaaccctccaaaagaggcttccttctacctctgtcgatgtgtgactactgtaaacaaaaacgtacgtatttcaaacatcag

SEQ ID NO: 604778 - DNA, 124 bp, Homo sapiens
ttcaagcagaccttttaacccttacagacactattgcctttggtggcagctgttgccttggggaaaggactatctatttgggagaccttcagtgcagcatgtggtccttgggccaggcatggcc

SEQ ID NO: 604779 - DNA, 245 bp, Homo sapiens
gacttcatttataataatacagagaatagctataagctcattgaaagtaaaaccaccaacccaggattctactgtttgaaaagaagtctcgttttaattttggagtttagaatgtgtatttgcaaagtaaccaattttaatctaaaaggttatatcctagttgtgtcaccaaatcataaaaaaccctaaaaaagatgtacctccctctgtaggtctgtattgttgacctaacctgaaaatgctta

SEQ ID NO: 604780 - DNA, 1320 bp, Homo sapiens
  misc_feature (125)..(125): n is a, c, g, or t
  misc_feature (535)..(535): n is a, c, g, or t
gacagacggtgtctgagtggcggctgagagagcgtgactgttcgtatagatgtgacggcgtatctgctgacgtatgcatacttagatgaagtggggtgactgtcggatgagatcgcgggagaganagtcctcgttcactgatctgtggtcggcaggtggcccagcacccgagaattaaagggtggccgatacgcacagaggtggcgcgccatgactctacgcattgcggctgcactttggggtcggcctgacggtgtataggcccgcgcgttggtatgcctgcgtatgatcaccaatgccgggcctatattagaacaccgacgggtcactccaatcatcggtgcgaggcaaggagtaacgggcatgacgtagagttgatacttctcggtaacgaatcacacaaatgaataggtaacaatactcacgtgagtaattctttccactgttgcatgcttctttgctacagggcttattttaatttaaagttaagggggactttaaactgaggttcgagtaggtttcaagggaggacccnctattctggaccttttactagtcgggcctaatgtcgaaagtcataccataattcggttccctgcgtgcacccttgggagtgttccatcatgacacaaatttacaagggatatattagtgcctactgtgtgactgtcactcgcggtgtttggctggttcatccgatacgccatattaaatgtgagatgattgctgacaattaaacaagtcgattagatagtttcacaagaatgcgattggcaattttgaagctggattacaaggcatatttagtcattgtggtttgggtagcgccatggttcgctggggatctttaaagaccttcgtgaaaagtaaccttggtgtcatatgctttgtggtctaaatcaccatgagggttaatcggtatcttggggtttgcaaagatatttcttgtgaacttaaggttgaaacagttcgcaacagttctccaagattaggtagtcgagttaattgcggagctttggctaaatatacccccacctattcaaatacgggaatttcatgaagtcaaaagcaagctcttcaggttcaaagggctcaccttgtgtatgtcacacctccttttttttgcacaatcgacagagcgtgcggattttgcacgttttggcccaacggacatgccaaaggccgagttgggaatcttgggcaagttattgtggggaacgcggcccttgttttctctggagttggacacctagtacaaaagcgcgcgggtctacaacgtgtgcgaagcaactccaggtagtggagcatttatacttgggc

SEQ ID NO: 604781 - DNA, 225 bp, Homo sapiens
ctgcgacgacagagagtagctgcgcctcggaaaaactacctcgtcagcaccttctctgccacagaccctgcctctactctgggccctttcctttctacctgggccttacgaaactgggctgcttctccctggatgctcaacgccagtaccatggagatgcccgagccctgcggctactatagcccaccctccactaacggtccaggacccaaactttgaccttca

SEQ ID NO: 604782 - DNA, 493 bp, Homo sapiens
  misc_feature (141)..(141): n is a, c, g, or t
  misc_feature (316)..(316): n is a, c, g, or t
  misc_feature (329)..(329): n is a, c, g, or t
ccttcccaggaaaacccagtgtgagaccgaaccattttgttgcagcccgcggggtccctcggttccttcaactaccggagtcccccctggggcagcccctactccgtgtcagtggtggagacccacttcgacccgtacgcntttttgttcaaccagggcaacaagggccctgggggggatttccgcatggccccccttttcagccgaacccagacccccaggggtgggttaaaggggaaattcccccccttttgcaaggcccaggggttcccaaaggatacccttgtttttttgcccccaaccgattagggcatgncgggccaataggnctccccaggggttaagttgggattccggccagcacggtggcccccccccctttggaggtttttgttttgttccttccccgggcccctgccccggctcccccccaaagcccccctgccccctcggggtttttcctgccccataaactccgggagccggtcggtta

SEQ ID NO: 604783 - DNA, 216 bp, Homo sapiens
tgagccggaccgaagatgctgcacttctcatccctgagagcaatgtttgcacaagatgtgatgaatatgtcacccagttggatgagggcgagttttagctggatagccattcgtaacaaagtgttcagttcatttctaagcttcgtcatggtttccaggctggtgacttgggcgtagcagtcgatggtggcgagtttggcaccggagagggcgtgg

SEQ ID NO: 604784 - DNA, 1215 bp, Homo sapiens
gcgagaatggagtgttgaggccgtctgtgtgtggcgcgggcgacggtggagtgcccaggactctgaccctgcccctgccttcacgcaatggcccccgtgcagcgccgtgccactacgaagctgccgttgggtttgaacaacatatacgtgccagtaagagctgaactgaaacttgtccgggaactgaacgacaaccgtgacgcacgtgcctaggacgggtctcttgcaatggggacacgtgacaaggttgtgcgccaggaggagtcaggtcaggtttgctgtgagcccgatccgaggaaagcctgtgcaaggagcccagcaaagggcaatctcatggtagctatgtgccccagggtgtccctcttagctagaggccccagaggcagaccagtcgaacacggaattggcgcagttggcttcgagaaagcgtacgaaaaatggcgtctccagagagttgaccgagagggggggccactcatgaagccggatcaggatagcacggcggacacgttacgagccgacgtatacagctcgacgtcgggtccaataggcgttccagacgcgaggacactagcaatgggtaccacagcagtccgttatgcgtcggcagaacgactcgtggcgccctggacgcaggttaaagaggacttccacttccgagcgtctcccatcagtcgagcttagaaagagtggcgacgatgaccgctcacgcgcagctagcacggcctcgaactcgcagaggaaggacggcctgcaaagatgtcaacagagtggacaccattcttcgacgacgtgggtgacagtggaagcaacggtcccaaggtattggagtgcaagaacgcagttgctgataacgcagataccggttacaagacagagtagacgcgccccaaggccgcatcccggggagctagtttcgctccaggagcagcgcgcaacgtatattgcggcgcgtcacttcggtagcttcacgcgaggcattgggccgctatcacactggagtagagccttaacgaagcggacactactccgcagctattccgtggaagagtacccgcgaccgaaagtatattccccaacagtgtaccccctcagcgagccgactatggtccatctacgcaagaaggagagtacggcagatcccgcccgggcagagaactacaagcagaacaacaagatcgacggtcgcttagggaaggccgcctgagcacaccg

SEQ ID NO: 604785 - DNA, 1082 bp, Homo sapiens
gtgggtcgacgacggacgattacttgattctccgtcgatcataatatatccaagcgcgtcgttttgtttgccactagaactcaaaccacaggtcctcggttgcggcttgtccagacccctcgtggtatggtgtacacagtgttgtgttaccccacctctgtggcacgttccgattcatgtgggtggttgtggtggccaacagaccacaaagactcaggcactttttcgtcggaatctgtctaaaacgagagcgcgccatatttatttaagggggagaagattgttctaagcgagcaccacctccattttcatactgggtatgatggcctccattcgccacgataccttagtttgcggaccacaaaaagagttggtatctgcactctgggtgggcccaaagtaataagggaggatctttttcaattagagacaccgagaagaggggggtaaaatacttgtgctttcgccccgcccacaacgacatgtgggggatcacaaagcggtgtgtgttgaaacatcggtcgctgtgtatacacagcgcgttatagtctcaagaaaacatatttacgcccacaggggtgttctaccacacgagaacatcctgcgggggtttccagacaaatcacgctccttgagagttgtaccccgcgacaacagtttgtggtgagagaccataggatcgtgaatccctcaagagggtaaacaatttgtggggtataaaacacctaagaatattttccccccaagagaatttcttggattcacctacagacaccctttgtggtttctttatgggtgttccattaaaagtgagaaagcgccaacatatgtgtcgtgtagtgcctaaggagaaacccttagacccaccaaagagttttgaaccattggagacaaataatgtggaccaaccccccatatttgtcggggattgaaaaagggggaaaaaagggatgagactttgcactttttttggtagagaattgtgaggagaaattccccggaattttcctaaccctttgaaaaaatccccccaacccattgatgggttttccttataaaaaaattggggtttcctctttgga

SEQ ID NO: 604786 - DNA, 117 bp, Homo sapiens
gtttccttgtggcttgagcgcttcccgtagcctcggggaaggagcaggatttagaggaccactagttggaacccaatcctcgttcttggagggaacaggaacctcttttcagagagg

SEQ ID NO: 604787 - DNA, 521 bp, Homo sapiens
cctcacctggcgtttgtatagctccttctagcccccttatctcattccagctgcatgacagccaagtgagacagggacccatccacatcccccttagagatcaaacaattgtgtctcgaagcagcaaacctccttctcagccatcacctgctgggcatgttctgggtgagcctggggaagatgatatgtgccccatcgtaaagtgaaagaactgcatctcagggctccacagagcacccagagtccagtgctgcagaggcaggatggcccaggcccctcaagcccattcttctcttggctcctgttccatctcggcagtgcttcctccagggaggatgtgggatttgatacgtgggaatgacagggtttggcaatcccatagcttctgaattccagggaggggaggagaaagatgcgggtgaaaacctgctttcagagggttttcccttggctgcctcctcaaccaaactcacccacaaattgcatgtcaagtttcccaacctccacctaggggagcaggc

SEQ ID NO: 604788 - DNA, 1121 bp, Homo sapiens
  misc_feature (1)..(1): n is a, c, g, or t
ntgtgagggagtggggaaaagtggtttgatctgatattgtgttacttactttgtggtgccatagtcgtgtgtttgtatgtgtagtctttttgttggtttctatttgttctactttgtatacgttatctatgcctttccctgcatttgttgtgtgtccaggttgtactgtttccatcgcgagattttttttttttggggtcacgcactgtttgggtttagcaccgtccttcagtttgtgttttttgttgttccacctttgtttccgtctctatgttctctctttgggtgctcgccccgcactttgttatcccgtcagatgcaccggtgtttgccacgagtggcccggtgcccccaccacatccgcactgtccatcccggattccccagggactccgggcaagggtccgaagttaaccagaggcacacagaggacagcccatggcaaccagcatcccccgaggagagagacattcagacagaggaaaagtctcctgccccctcattccttgcccagagtgaggaaaacttgccgccaccccccgagcactgatgcccgggaggtgggaggaagaagtgggaaatttcccttccccagtgaccccccagacgtctgagccttcaatgttgaaatttttctttatttaaattacttttatcttattaaatcaacttatcccaaatgatatagacgacagcacctggctctgtgaaaggtggcatctttttgggcaggcaggccactggggcactggaggagggttcacaaaatatgggttgctgttttttggcctccaagctgcatggaggccggcccacgggtttaagggtgtgcactgggcaaagggcaagggcggcacaggtgtcaaggccggcttggacaatgaaaccctgagccttgctgcattccttttgcttccacccaccacctagcttctttggacactcttggggtgggggtcaatctttggggaattaatggctgccacacccgggagatttgaagtgtaagggaagtgtgggagagcaagccctggcagatggggcacccgtgccctgcaggtgttgacaagatccgccatctgtaaagtccttggcaccactccacccaatgtcagtttcca

SEQ ID NO: 604789 - DNA, 336 bp, Homo sapiens
gcgtttgtgctgtgctctggtcagccaggccagtatgtaggagagctacaagaagattctgctgtgccagttgagaggattcctgtgctgagcccgggcaggcgaagattggcctgcccgagggacccagaggtgttgctgacgtggagactcaggtcagagtgagtccgtgtggcagagagggctgcaacaggccaagggagtaagcaggcaccttataagcccacgcaaaagagttttgatcttatctaaggacaagaagacaaaagttgggcttatcaaatgcatgcttcaaaaagtggcctctgtactctcccagcaaagaacaaaaacttg

SEQ ID NO: 604790 - DNA, 82 bp, Homo sapiens
gcggccgcctactactactactgctcgaattcaagcttctaacgatgtacggggacatgttcaataaaaagctgaactttag

SEQ ID NO: 604791 - DNA, 198 bp, Homo sapiens
  misc_feature (118)..(118): n is a, c, g, or t
gagtgcaatggctcacagctgtaattcatgcacttttgtggaggctaagacgagcagattgcttgaggtcaggagttcaacgaccagtctgggtaacatggcgaaaacccgtctctancaaacataaaaaaaaattgggcgggccgcaggttggggtccaatggcccccttgttaaatccccaaacactttgggtggc

SEQ ID NO: 604792 - DNA, 231 bp, Homo sapiens
gctcgtctctagagtatccccccagttcctgcttcttgagatacaatcactttagattttttaaaaggaatatagtttacgtgcaattccttgggaataacattttaggggcacacagaatacaacgagcctccgtgtttagactgaagggcttgaacaggaagatatcccactgaagagtgattaatagaatccataagaagagtctttttcaacgaagcatggaactgg

SEQ ID NO: 604793 - DNA, 1171 bp, Homo sapiens
aggcacaagtgcgcattggtgggaaaggaactgctcgcagaaagaagcaaggtggttcatcagaaccagacacagccagcatgcaccacaacaacacttcagttctccattcaaagcacagttaggggtcaaaccaatcatctctggtcattgcaagcaggtgaatcatgtttcacacacacccaaggcaacagtgatccacatttaacaaacccgtaaagattcaggcatcatctggcagcgaacacatttcaccattacaggccatgctgagacaaagcagctgacagaaatgctacccagcatcttaaacccacgcttggtgacggatacgtctgacctacgtttaaggagactggaacgaacgctctgacccaacacaaatctgtggatggaaaagcaccactatgctaactgggagacggactgactgactgactgacacgttaccagactctatgatggacgacacttagggactgacgagactatccaaagacagtgaaggacaaaactggaatgggagataaaactatactgaagcgaccttaaaaaaccctgagccgacacagattaccatgggagacgacgtgaaatatatggaacgtactagtgaccatggactatataataaagaaccacatataaaggggtaacaatgcgaaatacgtgactaagcaaaaagtactaagacactaccaacataccatcactataagacacacacggaccacacaaagccacacccacataggagaacaaaacgtgggcaacgacgaatccataaacgacacacagaacaaaaagggcaatactacccacacaaaaagacaaagagacaaaaaagggacaagacattacagatataaaaagacccgcacaggccacaggcccctgggaggacccattgcacaacgcagaaagtgcacaagacaaaaaagcgaaatctcacattaaagaaagaaataataaaaggacacaaaggaaaaaaagaacaaaagaacacagcaaacgaacacaacacagagacgaacagagcacacaaacaaacaacagaacccacgacaacgaaggaggcgcccacaacacagaacacacagaaaaaaaaccggaaagaacaagacaacaggaaaaaacaaaaggggacacccaaaaaacaagacaaccgaat

SEQ ID NO: 604794 - DNA, 388 bp, Homo sapiens
gcagtggggggggattcaaagggcttagtttgccccctgggaaaaaaaaagttcctgcgcatccaaacccccctgtgtggctgtcgtttacatttgggaggggtcccgtatgtttgtacgttgggggccccccgtttttggaaaatttaaaaacccagcctcctgttttccccccttaaacggccttgaaaaaagactcgtctctggttttgtattaaaccctaaccctttttttaagggccttcggggccccccttttttaaagctgggcccaaacaaaaagcctgggcccccctcccaatgtcctttttataggagggttttgttttttttccaaggcaaaatggggggtaaccgtttaatttaacttaaccatcccgggctccga

SEQ ID NO: 604795 - DNA, 219 bp, Homo sapiens
actagaaagacaaaaagttaccaggcatggtggtgggtacatgcgatcccaactacccgtgcggatgagtaacatgaatcgctgacaccttgtagacggatataacagtgacccgtgatcgacccactgcactgaagtctgcgtgacagaccgaaactccatcgaaaaaccaacactttgattctgcaaagaaccctggcgtgcgcttgagtccaggta

SEQ ID NO: 604796 - DNA, 185 bp, Homo sapiens
  misc_feature (33)..(33): n is a, c, g, or t
  misc_feature (38)..(39): n is a, c, g, or t
  misc_feature (45)..(45): n is a, c, g, or t
  misc_feature (52)..(52): n is a, c, g, or t
  misc_feature (64)..(64): n is a, c, g, or t
  misc_feature (78)..(78): n is a, c, g, or t
  misc_feature (80)..(80): n is a, c, g, or t
  misc_feature (146)..(146): n is a, c, g, or t
cctcctctgctcaaggcccacatgctacatcantcccnnctgctnttcagcncaggagctgcantctcccactgtttntnacacaagacttagtccaggaaaatcctctttaagtaacacggtaggaaccatcccagaaacagtcnacattcatgttctaacatgatcttctgacatccttaata

SEQ ID NO: 604797 - DNA, 279 bp, Homo sapiens
attggggttaggactgaagacctaattgactgtttccaagaaatccttctcggtagcattttttcgccgtgctcttggtggcaacatataccagcctctgtgcagactgctcctgatctgagcaccagtgctattcggacacagtcgtgctaccaggtacaaatctgatatctgtttgagcactcattgatcgagcgtgagtcgtgaaatatgtgggtccgaccctctaggatcgggcaagcgagaattcgattgttctatccaatctccgctggcctc

SEQ ID NO: 604798 - DNA, 426 bp, Homo sapiens
gtttataattggcttaaagggatggacttgtgattggctgcaggaagaaacttttttattttttaaattttgacccacagaacccctttatttttatttttgactcttattttttaaaaaatttgcgcctcgggatttggcttccctggaagctctccgagctttggggctttagttaggtcatttttttaaaaaaggaaagagggtcgaatgggctgcttaaactggaaagggactgtgattggctggttaatgggaaacggtttttttttttggcggcaggggttttgctgaaatcaacagcttccctattttggatgcagaaaacagggtttgggccattagtcgttatatttgccttgaaaaaaaagaaaccaagggggctttgcaatatttattacccaaagaacttgctgctgccttcca

SEQ ID NO: 604799 - DNA, 1051 bp, Homo sapiens
cggcgccactggccgtttgacccctgtgtcgactcgctccccaggtgacgagagagctggggccgggcgctgctccgcgctgacctgctgaagggacctcggtccatgtcccctgttgcgccgctgcccccgtctcgttcgtgcgcgggccagtcagggtgccagtgtctctgagctgtgtcgaggtcgcagacctagaggcgccctcgacgagtgcctgtgccctgtggtcgcttgggagcgactcgggcgctgtgtgccgggtggggattgcctcgtgcagcgtgaagtggccgttcctccgcggtgcctgacagcttcacgctggacccttggccatgcagcaatcagtcattgaggcttggtcgttgcagcctacatgctcgcattcgtgcgaaccaaagtacatttgagaccaacacttgaccagttgcacgaacaggggcagcgttgactagtaccgaaggcgtcaattcagacgagaagcggaagagacacctggggcacaagctggcaccgcttcgattccatcacgggttgtcccaaaagttcagacgccaagtacgccttgcgatttggccagcggaacctcttcagaatcttactgagcacgggaattcccatgtagaagatcttcacggtccaacagatcatgggaaaaacccgtgcagaggctatggaagtggccagattgggaaacgcacgcattggcgagggacattggcccaggcagcgactacattggcatatacaacccaaaaggggaaggccttagcaagactaacgacccaaacatttatcccatttccaagcgcattatagagggccaaaagcagttaggttagattagcaccagtaggagtagattgacaccgggaatgtgaacggaaattcgcgccacggttacgtaaagcccatacagaaaatgggggcgggcaaatagcggacacctttccaaggttacaagaaggggaggaaaaaggccgtccaaaagcccaaaatatatgcgaggaaccattggaggaatggcaagtaagtccattacaccgca

SEQ ID NO: 604800 - DNA, 257 bp, Homo sapiens
agtcaagtcagatcccgccgcatcagcctttaccctgacagctgcggtttgtttgtttctgagtctctgtttagagacgaagtcttgctctgtcacccaggctggagtgcaatggcacaatctcggctcactgcaaccttcgcctcctgagccaagcgattctactacctcaggctccacgagaaagctgggattacagtgtgccatcaccacacctggctgaattgagcatttttaacacagacagctttcaccat

SEQ ID NO: 604801 - DNA, 189 bp, Homo sapiens
gtcactgttgcacaataaagttttcacaagtataacactggtgatgtaagtcaacattgctgtagccaggtgtgaaggttgtatggcgtcgtgaccggatgtacatcatgtttgtagggttgggtgcctaatcttgaattgtagcttaaaagatacggatttttgtaactctgtgaaagttatgaggct

SEQ ID NO: 604802 - DNA, 375 bp, Homo sapiens
cgagtaacttagaattgatcagggtcaggttcgtgttagtgagaggtgacgtcctgctgcgccttcgtggtctagccaggaggtgtggtatcaggtggcagtgcaggccgaggtcgcccttgtccagtgtccatagaggtggccatcagctttgctcttagatccctgtgctgccgggttggaacgcattgcacaagcaccgccagccggtacagcgcatcctacgggcactttaagccaggttctaacacaacaacaacttgcactacgggttgccgttaacagctgtattacctactctcaggcggccagcacgtgctaagctacaatgtgagcccttaacgtccatatgagtgacgataatcttaactcagg

SEQ ID NO: 604803 - DNA, 378 bp, Homo sapiens
tgggtggatcacttgaggtcaggagttcgagaccagcctggccaacatggtgaaaccccatctcttccaaaactagcaaaaattagccgggtgtggtggcctgcacctgtagtcccaggtgttcaggaggctgatgtgagagaatcacttgaaccccagaggcggaggttgcagcccagccgaggatgtaccactgcactccagtgtgggtaacagagtgagaccccatctcaaaaaccaaaacaaacaggaaagaggtcaagaccaacctggccaacacagcgagaccctgtctctatttaaataaataaataaataaataaagtggaaacaacagtagatcatggcatattgttagaataaatattgatgctcaac

SEQ ID NO: 604804 - DNA, 162 bp, Homo sapiens
aggcgctatgttggcacgtcagcagactttgtggtggaggctatcggggacgacgttggcacgcctgggcttctcggtggaaaggggccatcgcaggcttaaagatcgaatgttgaacgacaaggtgcgaacggattcctgttgattgttgcgcctactggc

SEQ ID NO: 604805 - DNA, 549 bp, Homo sapiens
aaacaagtgaaattcaggtttcagtcttcaaccccagtttggaaaaaagaccggactaccattaatgggaagttctgcactgcccctttgcctgtcaatgacagaaaaaagatggtctgcttacctgaaccagtgaacttcaagccagtgtgactgtttcccttcacctgaagatagcctgtgtgtagtttaacctgggcaggacacatctccccgcattttttttttttttttagaaaaaggtgtgatagggatgtgtgtgtcagcttatttttttttggggtttgaaaggggaccccctctttctactaaggagaaaagcaaagctcttttttattttcctcataatcagctaccctggaggggagggagaactcattttacagaacttggtttcctttgccgattttatggacaaaccccttttagctttcccatgcaaacttaactgcccctgctttatctccttgggcatttggacttaggattcaataaaaacatggacagggtaaaccattttttaaaaataaaacttcatggaggatttga

SEQ ID NO: 604806 - DNA, 151 bp, Homo sapiens
gatcccacagtcaactgctgtcatggatacgcacattcattgctgagtagtacagtctctctgtcagtgatgttatgatgggaaaaagatgcttagtatgtcttatcgtatggagcttgagctatgtgttgggggtgggggtctaaaaaca

SEQ ID NO: 604807 - DNA, 391 bp, Homo sapiens
  misc_feature (200)..(200): n is a, c, g, or t
ctgcctcctgagacaagcaattcggctgcctcgggagatgttattacaggagcctgccatgagacccgactgatttttgtatttttagtagagaaggcattcaccatgttggtcagtctggtgttgttgaactcctgaccttaggtgatccacctgcctcagcctcccaaggtgctaggattacaggcatgaggcaccgngcccagtcagctgcttatcttttaaataaagtgaacttcaaaaacagatacttcatattctgggcatagcatcacacatacaaccatttccaatataataatattaaatgagtacttaacagacattctaataacgcatacaccttttattcacatttgcctgagagcaattacagagttattcttcattt

SEQ ID NO: 604808 - DNA, 1008 bp, Homo sapiens
  misc_feature (78)..(78): n is a, c, g, or t
  misc_feature (84)..(84): n is a, c, g, or t
  misc_feature (224)..(224): n is a, c, g, or t
  misc_feature (236)..(236): n is a, c, g, or t
  misc_feature (240)..(240): n is a, c, g, or t
acctctctttcctggttctcaagagtgctgctgataacgcggtccccggcacgcaccatctgtggcatcccggccggncgaggncattgcagattttggaagatggcaaagttcatgacacccgtgatcctaggactaagccctcaggctggggtccctgtgcggttcccgagcagtttcggggatatgccctaccagccgttcagcaaaggagatcggcttgngaaaggttgcangacntggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagattttgcccagaggaacctccgcagagacaaagatcgtcggaacatgttgcagttcaacctgaggagtcctgcctaaggagtgccaacagaaggagagagaacgcgttcgactgcgaacacaaagttccagaaacgacttgggggttaggcacgagaatgggatcacgaaatcacagaaaccccgagactcttcagttgcagttcgtagtgagtgcggaagtgagagagggagtggatcttcctcagttcgatgacaaatgcgcacttgcaagtatcagagccacaggacattgagtgtgtgggccctagaatacgtacgacgaagcctttgaacgcatcacacgtggcgtggagcactgcgaagggtaaagcgcatttccgggtgtccccacagatgaccttgtatccgaagtgcaaaactcgggaatttgttggcatgctccacctggcacatgatgaataccgacacggttcgtgaatgtgccgagtggccatcctttgcaaaggaacgtttgctcgaaagacgggcccaaaagatccaacggcgggggggacaccacctctggtggaacccggagaaatattcgcgccgtctcgcccccc

SEQ ID NO: 604809 - DNA, 248 bp, Homo sapiens
  misc_feature (79)..(79): n is a, c, g, or t
ccctttaactgcaataggaagaaaaaaaaaaaggtttgtgtgaaaattggtgataactggcacttaagatcgaaaaganaatttctagtatacttgagtgccttaagagtgaccaaagcgtgcccaaaagctcttgaaagagctttaaagataggcagggtaagtgctttactacgaaatactagctgagtgtttatgtagagctcacaccttccgataataaaactgtgcctgtatataatctcata

SEQ ID NO: 604810 - DNA, 395 bp, Homo sapiens
  misc_feature (143)..(143): n is a, c, g, or t
ttagatcacgcccctcccctagtaaagctaaaactcaccggagattgtaaaaaactccagttgacacaaaatagagctacgaaaggtggcttgtaacatatcctgaacacacaagtagctaagtacccaagactggtgattangataccccatctatgcttgacgccctaaatcctcaacagattaaatcaagcaaaactgctcgccagaatcactacgagccacagcttacgactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacg

SEQ ID NO: 604811 - DNA, 974 bp, Homo sapiens
tcagggcaggctcgtggctgggctggggtgccgcgagcccaggcgtctgagacctactgaccggccgcgggcaaggcctgacaggcggtggggcggctcggcccctgggctggagtcgggcggcgggcgtgcggcggtgcggtccgtgcgctggtgaacggacgcctgggcgccccgaggcgccgtgggatgtggacgcggccaccccaggcaagagcagggcctccgcaccggccccttgctaggttgtccccggtcccctggaaggagctgcggaaccgcctggcaggggccgcaggggaggtccccatggagccctggtggagacctctgcaggggaggaggcccaattgcctattggatgggccccgctagctgtccatgcttggactgtgtttgcgcctgctgcatgctccttccatggaagatccggagaagagggggctccgaagttcctgaagggaaggatgcttgccacaagagcgccctaagtgatgcctgaaagctaaaaccgacgacggaaaagtgtcgacgctggtgttccaagggtgcgggagcatgcgtagagacgcggagcttggaaagaacctgatcgggccaggcctcgttttgaggaaggctccccaaagagtggatcagacgaatgccaaacattgaaaagcagagctgtgtatcagagacaacgccagctcgggaggggagaggtcggcggcaagaatcgacatgctcgagggcaaagattgacgagccgttgaacgacgctggtcatcaagtccaacacaggcctgctccaaaccgggagcttcaccccagttgtgagcccaccagggcggccggaagggcgagacctgcacaaagaagcaggagacgccctgcccgcggttgtcggtggggacactaacccaaaaaaaagggaaggggggcccacatgtgaaatacaagctggaggacccatgaaacgccacgaagggacg

SEQ ID NO: 604812 - DNA, 199 bp, Homo sapiens
gtgagagacagtcttgtcctgatgcccaggctgtagtacagtggcatgatcatggctcactgtggcttcaacctcttgggtccaagtgatcctcctgcctcaggctcctgagtagctgggactacatcgtgtgcaccaccacacctaggtattttatatttattttattttttgcctcacactctgccaagtctcaatg

SEQ ID NO: 604813 - DNA, 816 bp, Homo sapiens
  misc_feature (15)..(15): n is a, c, g, or t
  misc_feature (17)..(17): n is a, c, g, or t
  misc_feature (31)..(31): n is a, c, g, or t
  misc_feature (44)..(45): n is a, c, g, or t
  misc_feature (70)..(70): n is a, c, g, or t
  misc_feature (776)..(776): n is a, c, g, or t
cgagggtcacaatgnangtgggggtaacccntttatttcccttnnctttttctcttttagcctcgccttnattccagggggtggggtttccgtccggaatcgcccacaaggaatgggagtttggtccaattggggtttaaaggaattgggggaaaagaaaaaatttcaaaagcctctggggggggagaaggcgccttttggtttttttttttaagaaggggggcccttttttgaaggaattgggaaaaatttgggggggaggggacccgtattttttaaaaaaacttgtgtggttttttgggggacccccctaaaaaattttgggaaaaaaaaattttttttttcactctttttgtgggaaaaaaaaattttgtgggcggcggggggtcttttttttgaaaccactttctttaaaaaaagttttttttttttttttggaaaaaaaaaaacccccaagaaaaaaaaatttttttttttttttttccccccaaaagaaggacccccccccccctctcccccctcttttttgtgttggaaacaaaaacaaggggttgtgggtgggcccccctttttttttttttttaaaaaaaaaaaaaaattttttttttataaaaaaacttttttttttgtggggggtggggggaagatattctttttttttttttttccgccgccgccttcttttttttttttttaataagaaaaaaaattttttttttaataggaagagccgccccccgttttataaaaaacccccccggctcggcgccccaaanatataatttttttttgggggagagggggggtttttttttt

SEQ ID NO: 604814 - DNA, 256 bp, Homo sapiens
aacaaatattctctctcttccagggcaggaatgggcatgtgtgatcttcgtgtgaggtcctttgtgctatgcacgttgggaagcatgttagaatttccctcccttttaaggctgaataatattccattctatgtgtataccacattttgtttatccatttatccactgatgaacatgtgagtagtttccacctttcagctatcgtgcatcatgctactatgaatgctggtgtacaaatagaatggaatattattca

SEQ ID NO: 604815 - DNA, 1926 bp, Homo sapiens
tgggggagcagggaaaacttaattggaggtaatgaatatattctacttggaaactgggaagggataagtgggtcatagaattgggtgggcttatgggtaacctttaggttaacgcatcttctcttatttcatttatttattattatggggtgagaagacaacaaagattcaacttctggtcccccaaggcgtgggaggatgaaagggggcggagagatatctgtcggcgcactccaacgggagatctccattcagagcgcttcacccgagggatcacaaacgcgagaactatcctcgagataaccctaagagcctctccgcgagaaggacagcgcgtggggagattcaaacaggcggcatgtgagcgccaaaaacaagtcgcgcggcgggccctatacaaatgtggggtacaccacttatagagacacagacaagagagtgggggttataaccacggcgagtggtgagcccaagaagggcggtggaaacttctctcaaacacaacactcgcgatgaacccacgtcagagagggatgaaatcatcgtgagcccgacactacaaaagaacgccaatacccacaaaagaagggggtgagctaggggggagccaacctcacacacgagggggccagatgatggacatgccccacaacatgttggagaggaccacgacggaggaccaccaatttatataacacaatccaccagactagcgcgaggtaaacgaaacaaaataacatcgtgtcagaacaacgacaagggaggagggagaaacccacacagtacgaaccacagagagagaaaaacacagacacaacacaaagcgaacacacacacaaacaaccatgcatgacacaaaacacagaggaaacaaacagaacaagctacacagatcagcgcgagacacacaccacaaggaagcacagaccacacccaccgggagcgcacaaccaaacgacagggacacaacaaaaacacgacgaaagcagacacactacacacacacagagacgataaaagcagaaggaaaacatacccaacaacaaaagaatagacccaagacggataacacaaactaagacacaagcagactaacgatagcaagacaaacacacaaaagagaacagcacacaaacaacacaacaaatcaatataagaagacgcacaaaaacacacaacccactaaacaaagctagacaagagaagaggaaaaaccacagacagacagcgaagcgcaaataaggcacacaagagaagaatgagacaccaagacacaaacaccaccccaccaaacccacacagcaagacaaccacacacaccaaccaccacaagtagaaccaacccacaacacaaccagacagagggaaaacacaaacacacgacaagcacgaaaagaccagcaccagcaggcagcccagcaagagagaatcagacacaacaagaaccagaggaacataagcacaaaaagcaaatagcaaacaacagaaaacacgaaatgagacaaacgacaggaacggaaagaaagagaagaagagagacgaagaaagaagcagaaaagacgagggaggaaagaacaaacacaaagaagaaaggcaaagaaaccacacaaagaaccaaggagacagctacgaacgagagacgagaaagcgagcgaaccagcgacgaatcaaaaacacgcgaagatgcaagaaagacgaactcatacgacagacgacacagaacggacgacgtaaagaggtgagcaagatgaagaagcaaagagagcagagacgacaaggcagcaaccacgcagacacggacaaaaactacgaagcaggcgaacgaaacgaagaaccaaaagaaagggaaacaacgcaagaaacaagaacgaagtacaagacgaaacaccagtcggctcgacgatacggcggagcgcgagtgacggc

SEQ ID NO: 604816 - DNA, 149 bp, Homo sapiens
ggtacctactggttgcagcgggtaggctaggattgtgggggcatgaatgaagcgaacagattttcgttcattttggttctcagggtttgttataatttttttatttttcaggctcttggtgaggagggtcttggcccgctgcaaaccag

SEQ ID NO: 604817 - DNA, 952 bp, Homo sapiens
ttctggcgtttttgtcgtgcttggtgtccttctggggtcttccggttgcttggttgttgcctttggtggtgtcctatcatgtgtgtttgttcggtggtggccttctgtgtgtgagcggtttctttcctactgcgttgtgtcgggtccttcttgttcggtctgtcgctgttatgtgtggttctagtgtgtgtggttctcccctccgtggtcggatcgttgcgtgtgctggagccgtgagtggtgtttgctctgtcagtttatatccctgtcgtgatgagctagttaggaagctactaggtgctctacgcccttgcagggcaccttgtagtgtcctctgatctggtcctcccaacatgctgcggatgttctttgacgccactgtattgtacgtaggacgtggtgtagcgtaggatgctcttctacagctgggagagtacgcaaggaccctcgctgatcagtcagggcaagggtgtggcccattatatcctgtccacagccttcttcaagtggctccgtgaagcagaggatgagtctgaccacaactgagggctggtaggggccggggacctggagccccacatggacacacagatggcccggctattcacgcctggtattgcaggggggcggcagcagcgtcggtggcagtgggtgcctgtagtgtgatgtgtctgaactatataaagtggctgaagaggcaggatggcttggggtgctgcatgggccccctccaggatgccgccaggtgtccctctcctccacctggggcacagagatatattatatataaagtcgtgaaatttggtgtgtcattggggtggggaggggcaccaacgcactgccatggggtccttttttttattttctgaaaatcactcatcgggactgccacgtcctcgctgctgggggcatatgccccagcacatgtacactcaagctgtggccatgggca

SEQ ID NO: 604818 - DNA, 151 bp, Homo sapiens
tggtgtctacaggatctgtaggtggcgtgggtaggaagagtggtgtttggacagcaggtgttggtctcagtgaccaggtggacacccaggctgactcacggtttttggggacatagtggtggatcagtccaagtagtagtgtgacacgggt

SEQ ID NO: 604819 - DNA, 242 bp, Homo sapiens
gctgttctagagtaacacacgggtatgtacagctatgtgtgacatgcatctagtgaatgacagatacatgcaatgtggacagcatctaggaagtggagatacaggaagtggacagcatctaggaaggaaatacaggaatgtggacatgcatctagtgaagatgagatacagcgaagtggacatgcagtctaggaagtggagatacagcaatgtggacagcatctagtgaagacgagatacag

SEQ ID NO: 604820 - DNA, 1249 bp, Homo sapiens
gtacaacccaggccatgacccctacacatggggcgcctctcagtccctccataatgacctccgcgcgctagccatgtgatttcactctccactccataacgctcctcatactatgcctactaaccaacacactaatccatataccataatgaatggtgcgcgattgtaacactgagaaagcatataccaagggcccatgctagagcacgcatcgcgtggtcctacaagaaggacctttcgagtacgggcataagtccctactttatttacctcacgaagctttgtctgtgtcgttcgccaggagtattctgtctgagcctatttaccactgccagtcctagacacctctatcgcgcaccgaacttaaggacgtggcagcgtgagcactccgcaactaagggagatcgacccccgctaaatagtccccactagaaacgtcctcacgttccataggagcatcacttccgtatttagcttcggctactcaagtgcagtactcaactgtccacctgtaggctcaccaattaggttcttaattgaggatacagaccaaaccgagataaccagagaggaagtatcaaaggcacatggcattcaattcagctagaatataataatcgttggagctcttcgttatttgatactcacatcctatacgagagtcccgtcgagaagtatcacttccgaagggtcatccctcgttccaccacgagtatttccctggatcggtgcagaagttccgctcaccagtgccttccaaatcaatgtcatgagttccgcgtttaaggcccatccaataggcctcttcgcgagccaggggatcgtttccaaacaggtcgagtataattgtggcgaattcaaaacctttgtgcccgtaccgagcttaattcctttaggcgtttccaagtccccccggccaataacattacaatattttctcacacatttttaacgagattcccagagatcagttgcatcttttgtggggcttttcggaaaaagtacccgccccggcccttggattaccctttgggacaactatatatggttcagaaagtgttgggttctttgaaccctcatttctccttgagatatagttcctacccaattccttagttcgaagttggacggggttcctctacatacacgacagaatactacaataacacacgatgaaaacactaagcacaaccacctcaacgcatctacagacacaagaacaataagaacgagatagcacatatcacag

SEQ ID NO: 604821 - DNA, 199 bp, Homo sapiens
cttcggtagttacatcgcccatagacacaattctccagcagcttctgctcctggactcttgttacttcctggaggggattgacgtagctcctggcggcatgtgctttgggcccttgggaaagcctttgtgccacggttgggaaactttgaggccccttgagttctgctctcagcgagtatagagtctgtgacaaatcga

SEQ ID NO: 604822 - DNA, 241 bp, Homo sapiens
atctgtggagaggttcatagtaccgtgggctggaagcgggtggataaagagcctgggtgacttgtatggaagccctcgaagccaggcctgaggtcctacaaaatggagccctgagagtgtgcctggtcttaagctgactgtgaccacgttaaattaagtgatccataggaaggaaggtggtgtcgaagccgtgagttgcgcggagaaggagcgctcaacacagcctcagtggttcactacg

SEQ ID NO: 604823 - DNA, 937 bp, Homo sapiens
caaatcgacgaaaaaaaaaaaacatggggagagccgaactaaaagtctttagcaggggtaccagccctagaaattccagtacaccagaagcagccgggaaaccaaatcctcatcaaaagacagaaacgaaaaaaactcgagccagcctgagaagggaccctattttatgctggtaacccactggagactggcatcctcacagctggagaaagggattggacccaaccatactcaagtcaagaaaaaatcttcctcgtcagaactcattgggttactggtacctaggattaagccttactaatgttaaagttaacagaaaggcttaatttcatataccttctatatggtgtcttatccccttccggatcggtaacatagctcctgttgttattaatgtaactaagtctgagtcacctcagaccatggcctttagatgatggctcggtaaaaaacctgtgtggcaagtgtaaaacgaatcaagggcagtagccttgtaacacaagttattatatgcctcggaccctctaatttgaccaaagtaacccctaagcacatcattcgttgtgatcacctgcagccaagacgatggatttttggttcatgatagctggaacttgtggtaattgggacaacgtcgtttaaggtacgcagggtcaatgtggacttcctgaaaatgttgtgtcgatctaaacgtcgcatttatttaggtaaggattgccttgtagtgttacttaacagtgaacggcttatataaacacttcactgtgttatatttaaccggctaagggttaggattgtatggaaaagaaaacacgtggtggcactattgtgtaaagacagtccgagagagaagtgaggtacatatgcggttgtgaagagtacactacaagatacggtatggagaggaagaaatgaagtagaagtagtaaacgtgggc

SEQ ID NO: 604824 - DNA, 133 bp, Homo sapiens
cgccgccccggcggggcgggggtccgggccggggcgggcgcgctggggcagcggcagcggcagtaacagcagcgcggcaggtcctgcggcagcgcgaggcaggcccgtgacagcgccccacgcgcgcggtcat

SEQ ID NO: 604825 - DNA, 163 bp, Homo sapiens
aatttaactaaaaatatgactgctctcttttcaaagaactgcttttttcagtcccagttacgtcaaacaaaccagcccctaaatgttaactatttgctatttttgttcaaacttgggaaaatattattaaatatccttcccctaggaatgagaagaaaaacca

SEQ ID NO: 604826 - DNA, 754 bp, Homo sapiens
  misc_feature (192)..(192): n is a, c, g, or t
  misc_feature (465)..(465): n is a, c, g, or t
  misc_feature (540)..(540): n is a, c, g, or t
gcatgttgtgctttgtagggacaaatgtgcatttgtttgtggcaaaagcctacaattgacaaacttgtaaatttctttgtatataagacctaagcttgtaaccctggacttattcctttatgtagtttaccttggttttatgtaaaatattctatttcccttcttacataaaatgataaagacgtcgtgtgngtctcaagaaatgggcaacctttgaacaaatgtaaacccagtgaaaaagtggattttctttactttttgtctttgggttatggagttgattttgttctttttgaagttatattatttttaaaagtgcctcccacctaaggcgtaagccatgaccatttggggtaccaagagcctaattttgtaggacttaatctgttgaaaagtgcagttacttctggaaattaacctcaatattaggtcagcatgtgaaatgttggatttgacatgtcaggnagggttcatggactgattggtcccatttgccctcaagtcagttggttaatctcaagacctgttactaactgattntattaaatcagagtcttcaattcttgcatggttagatctaatttctgaaccaatgagcacactttaaccaggtttttacaggtaccttttttctttaaaccgattggggaaacttcatgggatttaaattaaaatctacggtataggttctgaccatgaacctgctaagtcggcagacttaatttttttatggctggcctgattctcctagttg

SEQ ID NO: 604827 - DNA, 523 bp, Homo sapiens
cagacatctggagcagcatgtggctatccccgtggctgctatgatgacatggattagctctacgtgggctgcaagcattttgggatcgaggctacctagaggggcatcgggccatggaaaacctcggattagcaagcaataaaaacatgacctcactcttcctcaaaggagcccctggtcttccctgtgtgactcagttctttccatctgtttgtcccgctgcaagcctctttctgcgctgactgtgacattggaacgtggccttcctgtcaccccctccgtgccacgcactgaaggccacccccacccacctgggaaactaagaactggatatttagcctcattcacttgtactgtaacaatgtatactaatttggttggtatttcactatttaatttttaagaagcctattttactagtgttatatatgaacaaagtactgcagaagttaaacctgtgttgtattatttctgagatgttttgctttaagagatactttttgctcagtttatatatgccaga

SEQ ID NO: 604828 - DNA, 247 bp, Homo sapiens
cgttctcacgactggtatcaattggtgactcatctattctaagtgaagtaatcttgaatggagaacaaaactgtatattctcactcaccagtgggagctaagctatgaggatgcccaggcgtcagaatgacacaacgggccgggcgcggtggctacacgcctgtgatcccagcacttcggaggccgaggcgggcagatcacgaggtccggaaattgagaccatcctggctaccacggtgctataacg

SEQ ID NO: 604829 - DNA, 415 bp, Homo sapiens
  misc_feature (8)..(8): n is a, c, g, or t
  misc_feature (56)..(56): n is a, c, g, or t
gataaaanggccctatgtggcccctttaaggtaagagatattaccccttcacagtnggtagctccttttttaaaaaatccctatccccatacaaccctgttaagtggaagaaaatatttgcaaaccatttatcccaacaagggactaatatctataatatacagagaactcaacaggaataaaacagataatcccattaaaaagtgggcaaagtttgtgaccagcctggccaacatagtgaaaccccatctttactaaaaatacaaaaattagccaggtgtggtggcacgtgcctgtagtcccaactacttgggaggctgaggtgggagaatcacttatacttgggaggtggaggttgcagtgagtggagaccatgccattgcactccagcctaggtgacagagtgagactccat

SEQ ID NO: 604830 - DNA, 100 bp, Homo sapiens
gcatgctgagtgccatatcacatccatgaagtaggaattggggctctgcagcacgcgtttcttctagtgttccctcttctcctcttctggagagggatga

SEQ ID NO: 604831 - DNA, 623 bp, Homo sapiens
cccctatggtatccccacccatctcttccaaatcctacccattcttataggtacataatacacgtactatcttctaaaaattccatgcgcttctcatcaagactgttttctctccttgcttattttataaagactcaggccatttcttattcaccttccttactcctcattacacactcaacaaacacttcgcaagaaaaactagactggatagtagctatatagtcagatatccctaacagtttactagtggtatttagaaacacaacagcaacatgtctccgtatgttattcagctaatagttgatctcccggtgggaacaaaagggcatgaacacacaggcctacactagacagtggcgatgactaagagttaaagagccaaagatttataatccagaagatagtgggtgcataccagttgtgcgatgggaagatcagttcattaaactccgttcgtgttataaactggctgaccccatgaccaagcaggaggctggcgatgctaagtagcaactgccacctctagggcatgcttggagactggagctgtgccagggaccttactcatctgtgaagcatagaaagggcatgcgtgcccttacaaggcccaatacataaac

SEQ ID NO: 604832 - DNA, 525 bp, Homo sapiens
ggccgggcgcggtggctcacgcctgtaatcccagctctcagggaggctaagaggcgggaggatagcttgagggaagttacgcttattttttttggtctttggtgttttttttccctttttctgggagaaggggggtctcgctatataggccaagggcaggtctcgaactccaaaaaaaaaaaaaaacaaaaaaaaaaaaaatatttgtggggggggctggggctagaaaaggttttcaaaacatttgtgtgggggggggggccccactggggagtagggaaattgggcacatacacggtgggtcccacagaggagataccccgggcaccaaggaaacgaggggtggtgtgggttcccccacgacaaaaaaaaaaaaccgcggcgggggggaaaccgcgcgaggcttctcctggaaaacaatccccaaagggggcagtcacgagagggccacaagggggctccaacaacagaggaggtgctccaagcagacgtcgtgattatcaaaaataagcccgccagagggga

SEQ ID NO: 604833 - DNA, 104 bp, Homo sapiens
aagcagttaatacagactcaaacaaatcaacagggatatattagtgggaaaacacaatataaaactaagatgccattggtttctttaattgggttaagaagcaa

SEQ ID NO: 604834 - DNA, 402 bp, Homo sapiens
tgaggtcagagacatgtgagattgcctacatcacacaatgagcttatagcagagatgggaacacaatccagggttcacaacctcaggccttgcaggtttctggttaagcatagaagctcccagagaaacatactccaggccactggatggatgctcaggcagggccccgggctcttcccccttgagcttgactctgagagcacaggccgagtctctgagttttccacagccagcatgggtaaccctgggaagcagccaggcacaagcaagctgacctctctcatttcactcagcagaggctgaggcggtgaggagcaggtttcaggttcccagggacggcagtggcccgaggaagtatctttaccagggatcagcagttttgagtgggtgtgcaaccaggca

SEQ ID NO: 604835 - DNA, 128 bp, Homo sapiens
ggtcctcccacgtggtgctatgggcttgaggttatggccaatatctagggcagagagtcatagtgggatctgtcccaactctggatctggtccacactacagaagtctcttacccatccccaatccag

SEQ ID NO: 604836 - DNA, 307 bp, Homo sapiens
tcgactctagaggaccccgacactgttcctgatgtgtcggcaatcccatcaacggtgttcctgaagtgtcgaaaaatggttcgatggcgttcaggtgcgggatgaattgaatcattatcgcgctcactttgtttgaagagcttcaaacacggctttgcacgctgcttcggcaatgtgacgcgtctgattgacacgacacatttggaacggtggggagcggcagaagtcgagccgcggatttagccgtatcagcggctcccggacgcagtggatctgggaacagtgtcgtcactcaccaaccaaggat

SEQ ID NO: 604837 - DNA, 178 bp, Homo sapiens
  misc_feature (3)..(3): n is a, c, g, or t
  misc_feature (24)..(24): n is a, c, g, or t
  misc_feature (51)..(51): n is a, c, g, or t
  misc_feature (53)..(53): n is a, c, g, or t
ggngctcccagcgtgcagcgaganacccgagtatcctaaaggcatccgggncntgctgctggggcctccggggcggtaaagggacccaggcacccagattggctgagtcttctgtgtctgccatttagctactggggacatgctgagggcatggtggcttctggctcagagctaggaa

SEQ ID NO: 604838 - DNA, 86 bp, Homo sapiens
gctaactaacttattcagctttgggccgatgggggtggggggggtctttcagtgaatatttttattaaactctaccgtggacaaga

SEQ ID NO: 604839 - DNA, 378 bp, Homo sapiens
tgaattagcaggccatcagactagagctgagtcttggggtactgccaaagctgaggctcgaattcccagagttcgagcagggggaactcaccgctctggacagactgcttttggaaacatgtgtcgagaaggccgaaggtttgcaccaaccaaaacctgacgccgtagccatcgtctagggaacacagccctcaggtgtaaaggccatcggattgaggaagtacctgagctttcttcgagaccggaatgaaacagatgaggctgcagattcgaccaggtaacatcgctgtggtcctttgagacttatggcctggaatgagagtaataggggatatgcctctaagcgcatgttagctcgcaaaggtcaaggggaaatcg

SEQ ID NO: 604840 - DNA, 348 bp, Homo sapiens
cccaatttcccccccatttgatagttattcatcagtgaggaaccccagaaaaacatccctttgtttgttaaaagactgtgaaaaaaaacgagataacaaagaaaatcaaaggcaaaatgagtgggtcagtgaaataagccccagtgagaagcatgtgacttttgaaaaccatcgcatagtttcccccaaaaaaagggattttgaaaaaaccctttcctgagcatgggggagggggctcaaaggatgagcaggaaagcttcaacccttccaggtcccccctgagtcatttttttccaagggaaatttttggaacgagttcatcaggggaaggggggcccttttttttta

SEQ ID NO: 604841 - DNA, 1286 bp, Homo sapiens
aaatgacaaatggcctccaaggattttgcaataggcatgatcttattatctcagatcatggtcggattcctggggaatttctttcttctctaccactatagtttcctttgtttcaccagaggtatgttacagtccacagatctgattctcaagcacctgaccatagccaactccttggttatactctctaaaggaatcccacaaacaatggctgcttttgggttgaaagattccctcagtgatattggatgcaaatttgtgttttatgttcacagagtgggcagggctgtgtgcgttggcaatgcctgcctcctgagtgtctttcaggtcatcaccatcagccccagtgaattcaggtgggcagagctgaagctacatgctcacaaatacatcaggtcttttatcctggtcctgtgctggattctgaacacgctggtaaatattactgttcttctacatgtgactggcaagtggaacagcataaatagcacaaagacaaatgattatggatattgttctggaggaagtaggagcagaattccacattcattacatattgtcttgttatcatcccttgatgttttgtgtttggggctcatgaccttggccagtggctccatggtttttatcctgcacaggcacaagcagcaggtccagcacattcatgggaccaacctctccgccagatcctcccctgagtccagagtcacccaaagcatcctggtcctggtgagcaccttgtgttactttactcgctctcctccatctttacatatgtctctttttcctaatcccagttggtggctgttgaacacctctgcactgatcactgcctgttttcccatggtcagcccctttgtgctcatgagccgccatcccaggatacccaggctgggctctgcctgctgtggaaggaatccacagtttcctaagctggtcagatagttctccgatttatgtggattgtcttctttttgtataatgaatggccgtttgttgatttcttcctgcaggttaagcaccgcaatgggcagtcaattgcagtgtatataagactcagaatccgtctttgcccttcaaggatttttcacgtatcataaacaacagttacagatgaaatgtttttgcaaagtgctttcataattttcattttgtttgtaatttcataattttcattttgttaatgttgcaatggagaagttaagaggcaaattattaattaaaaatgggcctctaataagttggaacaatgcaactttaaaccaattaataaaaaatgtcatgga

SEQ ID NO: 604842 - DNA, 536 bp, Homo sapiens
gtaatcatgtgctatatactgtgacctgatcctcatcgaaatacacgccttagtgctgaccagattcttacgcagtatgacagtattaatgtcattgacataaataaagttgtgaaatatgttcccggtctacagacagaagatggttcttatgctggagatatttggcggagaaattgacacaagattctctttttgtgcggtggcaactatggctttgtaggggaagcttgatgctactcaatgtggaaaaggcaatcgaattcgtattatcctgtatgaacttagacggtggatttggttgcagaccaagttctgaatcccatgctgggcagatctatagtagcacaggatttctggctattacaagtcagttgcatcacgtaaattctgatttacttggctggtggctttgtgaacgacaattaccctcaggcgggctcaatggaaggccggagaagttaccagatgtctgctactcatggtgggtcctggcttccctaaagatacttggcagacttcattggcttgatcga

SEQ ID NO: 604843 - DNA, 774 bp, Homo sapiens
tccaggcggccgggaaaaatggcggacatccaaactgaccgtgcctaccaaaagcagccgaccatctttcaaaacaaaaagagggccctgctgggaaaaactggcaaggaaaagctcccggggtactacaaaaacattcggtcgtgggcttcaatgaacacccaaggaggctatggagggcccctacttgtgacaagaaagtgccccttcacgtggtaagtgtgctccatccgagggcggactcctctcgtggcgtggtgaaccaagatgaagatgcagaggaccaatggtcactccgccgagactatctgcacatacattccgaagttacaaccgtttcgagaagcgccacaagaactttgtctggtacaacctgtccccctgttttcagggactgtccagatcggtgacatcgtccacagggggcagaagtgccggcctctgagccaagacagtgcgcttcaaggtggctcagggtcaccaaggtctgccggcaccaaaaagcagtcccagaaagttctgaggctgggatatcggcccgttcccccacaatgaaataaaagtttatttgctcattccccaaaaaaaaaaaaaaaaagtctccgaggactttaagagcggggggggcggaaaacacgaggctatagaattggccaacttggccaatcaggtggtttcctgaccccagttttcttgtcaaacagggggaaaattggcgggccccaaaaggaagcggataaatcggaaaccaggtactgtatacactcacgaaaa

SEQ ID NO: 604844 - DNA, 160 bp, Homo sapiens
  misc_feature (41)..(41): n is a, c, g, or t
atctcagcaggcatccccgcatcattcctcaggggttcgcntgctgcacatccattcaaggctccgcccgtcccaagctcatcccagcatcggcagggcagcatgtggccgcagggcagttcctccagcctgggtctcccatgggtcacgcagctcgcac

SEQ ID NO: 604845 - DNA, 383 bp, Homo sapiens
  misc_feature (8)..(8): n is a, c, g, or t
  misc_feature (72)..(72): n is a, c, g, or t
  misc_feature (378)..(378): n is a, c, g, or t
  misc_feature (380)..(380): n is a, c, g, or t
aggagaanagggtacaagccctgcttccttcccagattggtaattccaatcatggctggacaattagaatcnatcttggggagctttaaaagtcatgggcggcaggagagacagctcatgcctgtaattccagcactttgggaggccgaggcgggtggatcgcctgaggtcagtagtttgagaccagcctggccaacatggtgaaaccccgtctctactaaaaatacaaaaattagccgggcatggtgatgggtgcttgtaatcccagctactcaggaggctgaggcaggaaaatcgcttgaacctaggaggcggaggttgcagtgagcccagatcacagcacttcactccagcctgggcgaaagagcgaaactcccntntca

SEQ ID NO: 604846 - DNA, 236 bp, Homo sapiens
acactctgcgcggcgtgatgcatgaggaagatggaggagttggggtcgctggcgctcattttggtctgggcgccctgcagggctgggaacaaggtggagtgcatcagggctggtaaagcacttccttagctgggggcgaccacctttgtcattctaaagtaaggatcctggtcaatggcacatgggattatgaactggatatccgtcctgtctcggaagatctgcgggaatgagtt

SEQ ID NO: 604847 - DNA, 414 bp, Homo sapiens
ccccccagcggcggtgtactcaccaggtcgtacttctgatttttaaacaatatattttaataacccttaactgtttatggtattacctgcagatttcttgtacttcatattgcagttgctattcatctgaattgtgtttgttcatccgttaaatacttactaagctcctgctctctatgccaggaacacacaattaaattaatgttagaccatctctgcccttacagaactccttagcttcttggaggtagtaccatatcagtcaggagcagaaatcctagctgctttctttcgtatatatcataacatttaattgtattttatattatactattggttacaaatattttttatatatcaggatatacttcagacagcatttagatattgtcttgaaatgcaaattttaagtac

SEQ ID NO: 604848 - DNA, 197 bp, Homo sapiens
  misc_feature (137)..(137): n is a, c, g, or t
tctagcctgggcagtaagagctagactccatctcaaacaaaaacaacaacagtctcgaggaggccagaggagcatgtttgttccccccacctttggaaagaagaaaacattgtatcaagtggaaatatcttcactanatgcaacataaaactctggcgattttcatcacaccaggtcaggtgatcccaggctggagt

SEQ ID NO: 604849 - DNA, 211 bp, Homo sapiens
ggatcccctgttactaaatggctgttatccaggctccatgacatgtcttgccatagcaaagaataaatatacgtagccaattctaaaagtagccctctttctcctggatcttgctgaattagtggcttggggggtgggggagataaaaagaacttaaaatgggttaagtaagaaatgttaaaaagtccctgttttgtcctgaaattttagt

SEQ ID NO: 604850 - DNA, 1026 bp, Homo sapiens
gctccgctcccgtgagtaacttgtgctccgtgtgggctcctgctcgcctgcccgcaccgccgccctgccacccatgtgacctgctgcctgcctggcctcctgcctgctagcaaacccttcctgactggcccctctgcctgctgcaatgcctgtggacgcctcgtccccccgtcctgccccctgtcctgctgcaaatgttcacgttttgaagacgtggggcgcaaacgacgggcgcacacatgcgacactgcaacgacggacgcgatccaacctggcacgcctgacgtgaacccggaccccgcgcccacgcttgctacccgagaaaacttgctcctctgcgcaccaatctgccaactctcacacactgactcggcaaaccccgtctgaccggcgccttaaccaccgctcgaaacttactgtagaaacctatacgaccgtttccctcaacgcctttcaacttagacactcgtaaccgggccttgactccttccaagctcccccacccacttcttccctctcaaagcccttgccgtacaactgtttgacacaacacgctttgcaacctttcatgttcgaaaaacttagaacactcctttctgcgcacgctgttcttggcgaccacttcgtccacggcccttgcacaacctccttttcccaacacttccttcaaccaaccacttcctaacatactttaaactgcttggcacatctttacaacccttgcaacaggcattattcaatcgccagcccttttggcagacaaccccttttcttgccacccacaacactgttttaccggacacatgtggtcccttcgacaatcacacggcctcctttgtggaccccctttcagtctatcaacgacctttgcttggaacgagcgatcaacacccaaacacccccttcagaactcattggaatcttaacacctggagcggaacggacagttagctcttatcaacacggcctcccctttggcccgcccaaatgcttatacccactaacctttcggggacttgggcctaa

SEQ ID NO: 604851 - DNA, 388 bp, Homo sapiens
  misc_feature (269)..(269): n is a, c, g, or t
  misc_feature (285)..(285): n is a, c, g, or t
  misc_feature (353)..(353): n is a, c, g, or t
  misc_feature (383)..(383): n is a, c, g, or t
gatgggagtttcactcttgtctcccaggctgcagtgcaatggcgtgatctcggctccctgcaatctccacctcccaggttcaagccattctcctccatcagcctcccaagtagctgggattgcaggcatgcgccaccatgcctggctaaatttttttgtatttcagtagagacagggtttcgccatgttggtcaggctggtctcaaactcctgacctcaggtgatccacccgcctcagcttcccaaagtgctgggattacaggcgtganattcgtgcccggccgngtatcaggttcttactttgagcagattccatctatcaggttcactggtttatacatattaagtatctngtcataaaagttgggggaccagctagggtncaagt

SEQ ID NO: 604852 - DNA, 201 bp, Homo sapiens
aggcatgagcaccgcgcccggcccaagctgggttttattgttgaaatgaggcctctcactgttacccaggctggagtgcagtggcacaatcatagctcacagcagccttaaattcctgcgctcaagtgatcctctcgcctcagcctcgcaaatagctgggattacaagtgggaaccaccaagtctggcaatttttaaattt

SEQ ID NO: 604853 - DNA, 435 bp, Homo sapiens
tagaggatcccacgatgacacttcagcaggaagtcacagtagaatcacatgtcggacacagtctacgagacgcttcgcatatgttacctcgtttgatctttgtaatcaacccatgaggcaggtggggtgtggcgggtatgatagtctccttctatgttgctggcttagagaaggtcagtgacttgtttaaggtcacactgctggttcctggaagaactgggcctaacacaggcctgttggctctgttttcatccctctggaatcttaatccttagcacttcagagtggtggaattcaagactgggccacttagcaaactggtcccttaatttattagattgtattgacatgtgagctgcatgaccactgcttggacggggctgctcaggtagacaagttctgttttcatagcgagagaatgaacttcctgggagg

SEQ ID NO: 604854 - DNA, 366 bp, Homo sapiens
aaaaaaaaaaaaaaaaaaaaaaaggggtggggggtggggggtttattttttttttaaccccccctggggaaaggccgggcctaaaaaaagggttttttttcttttgttcccgggaacccggtttaaaaaaaaaagccccccccgttttttttttaggttttgtttaaaaaacccccttgggcccttggttgggaattgggcccagaattttttttttccctttttggggggaaaaccgccttttttttccccccgttttgaaaccaaaaaaattgccccctttgggaaaggggggttttttttttttaaccccggggtttttttaaaggcccgggcaaaaagggggcaatttttaatttttttcca

SEQ ID NO: 604855 - DNA, 1022 bp, Homo sapiens
tgggggtggggactggccccaaggggcaaacaggttaattggggcagcagcggggaaaatcagcggtgggactgggccacaggctccagctcgtccttcttctaaagggcataggagttcgaggagccctgggcagcatggatgagctcatcggccaggcactcagcaagggtctaaagggtcccggaaggcagcctcacgagcgccgtggtgcccagcagccagaagtggccgggtcaccacacggggcaggggggacacatccacgagccgtgggcggcactcaacagcccgcgggggcgccccaagggcggtggggagatcctccgcggggaaccacgtggggaaggaaggggggtctcaccgaggaccggcacaggagggatcactcgcccgtgggaagcccagggtgttagtagactctcaaaggggcttgctggagcgagtgcgcgccacagatccagtgagcctttctgggccgtgggtgcggcggccggtgccttcatcagtggagttataggggaggcgctcccacaagggggaccactggactcttcggcgggaacgcggttgggcgggaaataccggccctggcccctggtagaggccggtcacttggggatccgtgactccttacactgggacagggtaatccttgccaggggacactgggcattgcgacccggcacacttcaacccggggggcccccacttccccaaagacaagctggaaaagacgcggggggcccctcgccacccgggtaggaggcgggaagaccccccaatcgggcaaacccaggaaaacacagccagacacccgccccggcaacccgcgggaaaaaccccacgggaaaaccgcggcggagacccggagagggccctgggacaacaaccgaacagggggggacacccacactgcccgaccgcgggctcacctaaacaggcctacaatggggacagccccccacaaagaggctacaaccccgggacaaccaccatggaccgggacagacacgtttcca

SEQ ID NO: 604856 - DNA, 105 bp, Homo sapiens
atcgacaacatttctttcagaattgattgggaggcaatggcagaagtgagactagcgtaggctacacagcaagaccccatctttacaaaaacaaaaattaaaaaa

SEQ ID NO: 604857 - DNA, 102 bp, Homo sapiens
gtttaatttgttttccctaaaacttgaggagaagaagtctgctcctacctccaatacctggaatacttaagccagaaccgtcctccacctgcgaacctatga

SEQ ID NO: 604858 - DNA, 256 bp, Homo sapiens
ctgccgcgcggcggccgatattgccgggctctcccacccactctatggcggcgccgtgacctgttcagcaacgctccaatttttcgacccggctaatccgattaccatcgtccgggtcttctgcgtcctggcgcttgccgtacgtgctatcatttgtctgtagcactcagaagcctctctgcggaagatattccgcaagaagaagccgccgccgacgccagacagcgccaggccggcacccaggcttctcacgcct

SEQ ID NO: 604859 - DNA, 332 bp, Homo sapiens
  misc_feature (332)..(332): n is a, c, g, or t
ggcaactttaatgagcacacatatttcacaactcttgaatatttcttctgcttgctaaatactatattgtgaagattcaattactaggtcaaatacacaccttaataaatagatatgtattagagaagggatggaaaaatatttactcattaagaataccaacacatgaaagtgatttcagagtatggagtcttgagtcacaaaggaccctttccggaagcttccttttttgcgttaggttttgaatttgactgaaggaaggtggtgagcacttgagcccctaatggattcttcttagacttagatggttttccacattggcctactctttn

SEQ ID NO: 604860 - DNA, 327 bp, Homo sapiens
  misc_feature (17)..(17): n is a, c, g, or t
  misc_feature (28)..(28): n is a, c, g, or t
  misc_feature (49)..(49): n is a, c, g, or t
  misc_feature (114)..(114): n is a, c, g, or t
  misc_feature (117)..(117): n is a, c, g, or t
  misc_feature (180)..(180): n is a, c, g, or t
  misc_feature (285)..(285): n is a, c, g, or t
  misc_feature (311)..(311): n is a, c, g, or t
aggactgaggccctganaatgagctganattcagcatcccctggaggantcggggtctcagcagaaccccactgtccctccccttggtgctaaaggccttgtgtgcacgtgaanctncgtgtgcacgtccgttatttcagtgacttggtcccgtgggtctagcccttcccccctgtgganaaacccccattgtggctccctgcccaccctggcagatgactcactgtgggggggtggcctgtgggcagtgagcggatgttgactggcgttctgaccgccccttgnacccaaacctgtgatgaacatggtgnctgattctggggggca

SEQ ID NO: 604861 - DNA, 202 bp, Homo sapiens
tcatttacaagcatcagaagtaccagaaatagggacttcactccacgggcactcactgattcccagacgacgcatggacacaatagaggatcaccataggtttgctatggcttttctattattttcttccccccaagtggtggccctaattccaattattccaatagaataggcaaataatttccacttcaagggtccccca

SEQ ID NO: 604862 - DNA, 274 bp, Homo sapiens
ttctttgcaaacaaatccttaaatcagctcctggaacaagttttgtgttgttgtctgccatcattgacactgaggattcaggggctcatgccccaaatacccgacctgtgtcttgaccatgtagtatgatgcctccacccggagaggcccctgtgttctgcagctgcagcttaggccgctcctgggttctcctgcatcgtccctattgttgaacaaactcagcactctctggaaggaggcttcctctttgtggttcccctgtgggcactgtttg

SEQ ID NO: 604863 - DNA, 124 bp, Homo sapiens
cccgtcaagccacaaggactgtacgagttagatggactgtgccgcaggattgggacgggcaggcatgttagagactcactgatggagttatctgtaggtttggatgctcctacgcttgatgagc

SEQ ID NO: 604864 - DNA, 182 bp, Homo sapiens
agtggtgggcggatagcgagacccatcgctacaaaagattaaaagttagctgcgtgtagtagcatatgcctttcaacgtagctactcaggaggctgaggtgggaggatcccttgagccgaggagtacgagtctgcagctgagctatgatcgcaccactgcattccagaccccagtctcgaac

SEQ ID NO: 604865 - DNA, 558 bp, Homo sapiens
  misc_feature (235)..(235): n is a, c, g, or t
  misc_feature (374)..(374): n is a, c, g, or t
gtgtaccagtgagaggcttgtgaagggattgtttcggcgactccttatctaagaaatgaagataatttttatgaggtgcattttggtctgtgggagtggaagggaaaatgacggtttctttcctatactgtcctttgtttggaatggtgaaaatgttttgaatctgtttctggtgtgatcgttaggtccaagatttcacgtgacgttgtgtgccgggtgttgtggtcaacacacnggaatgctcctttattctctgtacggcctttgggtgcatcatttgagtggatgttcatttgcttgagacgattgtcagagggaatcttgtgtgccctttgctctctgtgcctgtcattgcgagggtttctttgagcgcngtctgctgaccgtcaggcacttgagattgactcggtgaacaatgccgccagcctttctgatgcgctcctgccctctctgactcctacacaggatcagaatcactcagatatcacttctgttggtggaggcgagagaagaatatttatccagtttctgcctttctgcccccattagctctttacc

SEQ ID NO: 604866 - DNA, 302 bp, Homo sapiens
tgcttagaagaggcatgacactatactgaccacagtttaattcaggatcaacagaaggctgggcacggtggctcacacctggaatccctgcactttgggagaccgaggcaggcagattacctgaggttgggagttcgagaccagcctgaccaacatggagaaacctcatctccactaaaaatacaaaattagccaggcgtggcagcgcatgtctgtaatcccagctactcaggaggctgaggcaggagaatcgcttgaacccaggaagtggaggttgcggtgagctgagatcacgccattgc

SEQ ID NO: 604867 - DNA, 105 bp, Homo sapiens
gcggccgcctactactactactactgctcgaattcaagcttctaacgatgtacggggacatgggcctttttttgggcacaataaagcgtttaaacctttcaaaaa

SEQ ID NO: 604868 - DNA, 454 bp, Homo sapiens
agtttccccgcgtcgggtactctgtgggctgcacacgtggctcgcaccttcttaattcccagtcacttttgcggaggcttgcgccaggagtgattgcttgagtctaggagttcaacgaccggtctgcgctacatggtgataccctgtctctactaaggatacaaaagttagccagtgtgtggtggtgcacgcctattgtcccagctactggggatgctgagatgggaggatccaccttagcccttgggggtcgaggctgtagccaagtcatgattgcaccactgcactccagctgggtgatcaagtgagaccttgtctaagacaatacagagaaaaaaaaacgggaaatcgtttaaggtcaaccttcgggcccacttttccgggtgtgacatatttatacccccaactaatatgaacaagggaattcccgttaacaatgaaataaatcctaaaa

SEQ ID NO: 604869 - DNA, 122 bp, Homo sapiens
gtcgactgtcaaaatgcctgaactgaagagcccctgattctcctctcatggctgctgcggctgctgttctttcttctctttcttctttcttcttcttctctttcttcttcttcttctctttc

SEQ ID NO: 604870 - DNA, 151 bp, Homo sapiens
tggaactcctgggcacaaaccatcctcccacctcagcctcccaaagtgttgagacgacaggcatgaggcacccagtacggcctcattcgaaattttctaagtccgcttatggaagcatgcacctgcagtcccaactacttgggaggctgag

SEQ ID NO: 604871 - DNA, 140 bp, Homo sapiens
tatagcttaagatggagaaggtgttgaggtcttccaataacccaccattattctcatgtgcctaccagcgaaagtgcattcagtccactcctggaggagaggagcggtgcaacatactatgggcaaagtggtgcaacgca

SEQ ID NO: 604872 - DNA, 310 bp, Homo sapiens
gagcttcctgcgacatgctgtcagacggagatgggggtacatcctcactccgcccgatctacatacccgagcggacaaggtgctctgcgggccgcactgagcccaggtccacgggatcttggccctatttcctcctgtggcccgtagtttgctgtgtagggcggtgatacccagctcctagcacctctaggccaaatactgggcagccaacatagcagcctatggtgaagaatacatctcggtctgcctttaacttcctcccaccagtcaccacggccaatggtataccttgccagacagatcagtgaca

SEQ ID NO: 604873 - DNA, 119 bp, Homo sapiens
ccaccgctccctggaaaagaggttcctctaaagatcaggtgttagtagtggcaatactctaaactatagataaaactttcttttcaccaattcactcttggaaaggcccggggggacac

SEQ ID NO: 604874 - DNA, 288 bp, Homo sapiens
agcactatgcctgtggagtatactctctctacgaagttatacctcagtgtcaaagagctgtcctcatggactacagttaatttacaaggggatgtagagggtactgtggcaaatttaaagtcgcaactagattctatcttggacaaccagctatcaccaggctcggtaggtttgtcgcctctacctataaatcttcccactatttagctacatagacgggtgtgctcttttagctttttcttaggtagctcgtctggtatcgggggtcttagctttggaccttatcga

SEQ ID NO: 604875 - DNA, 393 bp, Homo sapiens
  misc_feature (152)..(152): n is a, c, g, or t
ctgcaaaacaggccctcagcgtgggcacgaacgtgtggcagggcttcttccccagggcagggcctgtaagacacaacagaggctcctgtgcacggccctcaggagacgggaggaggccccatccagcacaggccccaggctcaggcgctccnacctgggagaaggcactatcggccaccacctccccgcttcctctttctcaatcagtaaggtgattatcacagaaaagcagcagaaaattttaaccccccaaaatcacgtttttccatatgaaaacctatttggtcaggcatggtgctcatgcctataatcccagcactttgggaggccaaggagggaggatcacctgaggtccagagtttgagaccagcctggtcaacatggtgaaacccc

SEQ ID NO: 604876 - DNA, 186 bp, Homo sapiens
  misc_feature (18)..(18): n is a, c, g, or t
  misc_feature (107)..(107): n is a, c, g, or t
  misc_feature (112)..(112): n is a, c, g, or t
  misc_feature (151)..(151): n is a, c, g, or t
  misc_feature (173)..(173): n is a, c, g, or t
cttaaccctttggaaggnttgactgtgtgacccgcagcaaataattcatgtcgaaagatgaaaacaactaagttcataaccccctgcccgccattgacctccctttnaaaancgagaccaagactccatcactggtttcgaatttacatcnaactgctaagattgatacattncaagtctgcaaat

SEQ ID NO: 604877 - DNA, 1010 bp, Homo sapiens
  misc_feature (194)..(194): n is a, c, g, or t
tccggcgcggccacgagaactgggcgacattagctggactgtggtggacctcagacaacgcccgtcgaagtgctattcccggcgccccgggactactgcaccaggcgcgaaacacgttgatcacacagtgtgcctacacagtgtcatcaaaggctgagactgtcgtgacttgcccagaaattggtctcatgtgnctcagtctacgatcaacgagaggctgagtacagcctctaagacgaattggccgagcgaggagaagcgtgacaaggcatgagccatggccatcgcgtcatcgccagagctcaaggtgtgcgcggcagggcgttgggctacgtaaggctggcctgtcagggaagtaccaatgcaacggcgtgccattgtgccctccatgcttggactgtccctttgatcacctgatgacttccctggagctgctgtgccctcccacacattgcggtgggcatccttatcggtggacctagtggcgccctttgcgcataactcgtgttgatcacgagacgaagtggaaggctggcaatgctgtcacagtgttcagtcctccaagcatgcattcctggttcatagtttagtcccatatgggaagcgtggggatgcccatcaacggctccagaggaccagtcgagttcttcagaactgtctaacgacgatcccaggttaatcgcgcctcactgtcttcgaagcatgcctgggacgaagaatgagagggaccaacctagaaaccatggactagtgtgatcttgggccgcgcccgagtgtcaagggaccgcctgtgtcactcgcagattcgggatcggtgcccgtcgatccgagtaatgtcgaggtcgcgtacggtgttggcgacggtgcatagggatggcgggagtcgttcgaataacaagaggtggtccgcctgggagggtcgaagctggcgttgtaatcctggcggggctgtacagggccggttggctcgccgggggactggtcgcccggacggggtcgcccacccttgg

SEQ ID NO: 604878 - DNA, 172 bp, Homo sapiens
gtacgattttctgggaacgaccacctgacctgaccgggaacgacctggactttctttctggaagacacctgactggacctggaacgacccgggactttctttctggaacgacacctgactggacctggaacgactctagacttttctctggacagaccctagactttacctg

SEQ ID NO: 604879 - DNA, 150 bp, Homo sapiens
  misc_feature (14)..(14): n is a, c, g, or t
  misc_feature (97)..(97): n is a, c, g, or t
  misc_feature (113)..(113): n is a, c, g, or t
  misc_feature (123)..(123): n is a, c, g, or t
ttactggtaccttngcaggctttacacctgcctgcatggtgacaattttctttagtattagctctttcaaaactctttaatttatcttgtttacaangtgtatgactattaancccctatggncaatgaaaattttagaaatttctaagt

SEQ ID NO: 604880 - DNA, 190 bp, Homo sapiens
acgacgtgtgggcacgactgacgcaacgtttgggggggccccgacgactggaccacgtaacggttacgttacgacggtacgacgggaccactgacgacacacgacgacaaaccttgtcgacactacgacgacggacactgacgctcacactgacacacacacggacgacaaacactggcaacggagacca

SEQ ID NO: 604881 - DNA, 769 bp, Homo sapiens
ccgctgggcactcggaggcgcgcacgtcgttccccgtccctcccgtcgcagccgtcctcgctctctcgcgctaccctcccgccggctcgggtcctccggtcagttctctcgttagtccaggctctggtcttcggtacccgtcggttcgtctccgagtttgcgatctcggacggcgtccccggcgcgacagaggcaggactcggacttctgttgcctgagcaaatggctgccatccggaagaaactggtgattgttaggtgatggagcgctgtggaaagacatgcttgctcatagtctacagacaaggaccagttcccacaggtgtatgtgcccacagatgtttgagaactatgtggcgagatatcgaggtggatggaaagcaggtagagttggctagacgggacacacctgggcaggaagattatgatacgcctgaggacacctctaccatagcacagataccgatgatatactcgcactgtgtctataccatcgacaagaacctgataagtgcacgaaaacaaatcgccagaaaaaagtgggacaccacacggaacgtcacagcaattacctgatcaccaggacgaagcaccatcgcatcaatggtaggggaacgtaaagaacggaatctaccgagaaatgactgcaaacacaaacaataggggatgagaaagaccaagcatgaaaccacagacgccggggagaaacatgaaaaggaaaaacaccatggcaaaacagaaatagaggcatacaaatcaagcaaatacca

SEQ ID NO: 604882 - DNA, 238 bp, Homo sapiens
gcagttctaccgtacaaccctaacataaccattcttaatttaactatttataatatctaactactaccgcattcctactacttcaacttaaacttccagcaccacgggccctactactatcttggcaccttgaaacaagctaacatgactaacacccttaattccatccacccttcctcttcctaggggggcctgcccccgttaaccggcttttttgccaaatgggccattatcgggg

SEQ ID NO: 604883 - DNA, 717 bp, Homo sapiens
gtgtgtataggggtatggtcccgtgtgtgtgtgtacagttcatcatccagctacacatgaggaccaaactgcttcagcctaaaatggaagatacacatttttttccttcaaaatgccagtgagaactgaagtagctcttttatagagataaactgtaactctttctgtttaccaggcttcggtggatatcatatttcttaggacacagatgtctagttgaccacttaacatttgtaactgatgatgcgttgacctttttttttttttttgccaaactagagaaattgtccatatactttggcgtgaaatgtgtttatatttatttgaaatgaaccaaatggtgaggaaacatccattatttgggctctattctaactgctctatatcttatttagaatgcctgacttggaaggaacaaacttgcactgttgctttggaagccgcctgcgcccaagagtcttttgactcgacaaggttattcatgcggccccaatttgggctaacttggccagtaggccctattgggaggcaaacaaaaattcactggcccttcgttttacaacggttggactgggaaaacgcaggcgttcccaaattaaaacgcctgaggcacaatccccttttgccaggtgtggtattaagagaaaggccccacaaatggccttccaacaataccccccccgatggggactgtgtttcaccatagggcaatatgca

SEQ ID NO: 604884 - DNA, 233 bp, Homo sapiens
tggccggttagtcgcgggatcgttgagtgttatctggaggagagacgtgaggctatcaccgtgattagtcagggagtggtctcaatcgtcactgagctcggtgatccgacacgggctggtctcccaaagtgctgggattacaggcatgagccagtgtgcccagccggtgtttggtcttggttggtttgtgagacagctgtttgactatggcgcgttaaggggccaggcagggc

SEQ ID NO: 604885 - DNA, 1778 bp, Homo sapiens
ggggatgccggaggctgcgtgtacctcttgtgcgctgacgctgccccgcgaaggaggcaggacgttggaggactcgcagacctgcctccactttgactcgccggaggacagcttgcatcccgtctcgcttgtgcccactactagcggcggatcccgtcagtgtcgctccccatttcgcggcagcgagtgctcgtcggtgatgtcagacgcatccactggtccttccccagcacatggcatcttgtgtcgcgcgcagaaacctacgtgagacgtgaacacctcctgatgatcgacacggtgcattacaatgcccacgtggcgcgtgtttattacttggagtactgccacgttggcaatcactaggagcgcatattgctacactcccaggcataataccggagtcatcatcctgccgagagggcattgttgcaagagagatatccctcattaatgtccagagcgaagcacattgccgacccaaatgctgggttaccgaggactctgtgcgacggcccgaatcgtgaggggatatagtttctaccagtgtggggcaattacctgataggtaaacacgcgcgcctcgggattcacgagaggccttgtcccccgctttactccattcgaagcttcacaggccccttgtgtccttccgcgcgtagacgaggaagccctgctgggccatgatacctcggtcggaagggggccgctttgcgcttaaccttttttggggcgcggggggaggaagcctcacccaggaactccccttggcatggggggggcggtgagggccctacctcggaatcccacaaacgcaaggaagcccatgggtttcgggctgccgtccttcggaggcacacgttgtcccgggggggcgtggctggcctctggggcgttctctcccccaagttagaggctgttcgcattcccggggttgtccatggcgtgtgggtggccttgcggtgggcttagagataggcttaattccaggtggttggcgtagataggggcgcttacccgttggggttggctttgatacctgccttgggggcccgggtgtctgtggccggtcggggggaagcttatttcccaaggcaatggcgaaagggacgttagattcggatcattgggaaggccatggggatgcaaagacgagataacacgcggccaattcgcaaggggccccatttccggcggggaccagaagaattgcataggtgccaaagacattggggtgggattcgagcaagggccacccacagaatacccaaaggggtggaagagctataccaggcaccgggtgacaggtatagccacggagggcacgtaggttgggcaccgtgtataacaacgaggccacccgggaccccgggaaggacccagcggaccaacggccaaacaaccggaggacccgaagagcaaagacagcgaggacaagaacggcacagaggaggcgtcccccggagagtactagggtgggaaacacccaaagcaagactatacgagtgctacagcaaggatacgagaagaaattgttgtgttcgccgacaactgccggaagagaggcacacacacaagggtgctcggcaagagaagctacatactagctcaagataaggagagaggtaggtcacaacagaaacgtagacgtcaagtgaccaacagacaggtttagataggatggaatagtagagataactgtctcagtctgtctgcctctcgtcgctctctgtttgtctgtgaccgttaagaacagtaaacagtgtaggcgagagacgggt

SEQ ID NO: 604886 - DNA, 149 bp, Homo sapiens
aacaattgagcacactgtaacggatatgacatgtgagcaacagcaccctggttggcatggagcaggagtatacctcatggggacagatgggcacccctttggttgagcttccaacggcttcccagggccccaggctccatattactgtg

SEQ ID NO: 604887 - DNA, 358 bp, Homo sapiens
  misc_feature (186)..(186): n is a, c, g, or t
ttaggtggggccggggttccaaacctggcccaaagattggaggccctcaaagaccaaattggcagttccttgcaaagtggccgcacccagcccccctgcagtgagggggcaagaagcccaggccaagtcctccctccccatttaaggccaagtgggaacccaggagaatgttttgtaccctcagantgggctccacatttttgggtttcagtttgcccatttgttgaatggagacagcagttgctactccccctgcagttgggttaggggcggggactgggggtgctatttaggggaacaaggggattcaggagaaaccaggcagcaggggattaaatacatgaataaaaaaaggctt

SEQ ID NO: 604888 - DNA, 623 bp, Homo sapiens
  misc_feature (166)..(166): n is a, c, g, or t
  misc_feature (172)..(172): n is a, c, g, or t
  misc_feature (183)..(183): n is a, c, g, or t
  misc_feature (221)..(221): n is a, c, g, or t
tcatttatgcttttggagccacgccaacagacccaagccaaagaggcccccggccctcttggaagatatttgagcccttacttggcccggcccagccccggccccccaagactttttggctttgttggccagagaagcccttaacggcagtgaggaggaccaaaantaaacncggggggaggnggagcctcctctcctcccccctttccctttccgttggnccggccaggcccgcccccgttttaggaaaccatggatttccgggaggaggggccttagttcgaaaccccgggcattttcatcagcatggattacgactcggggctgaccgaggcccccctgttggactttagtttcgagggccccctacccaaggaaacggcaacgggcgggcttccctttaaggaggaacggagccccccgaccctcgcccctgttggaaaaaattctattaaaactccccgccccggttgccgaggaccccagggaaccccaggcccaggggaacaccttacggggctccagggggaaagggggtgggacagggactcggggctgggggacggggcggggctttcccttcgggtgctttcccttaaaaaaaaataaaaaatttgaacttg

SEQ ID NO: 604889 - DNA, 107 bp, Homo sapiens
ccaggtggcctgcaccaactggaagcgcgtgatgatcgtgctgagcggaagcctgctgcacgggtgcgcctaccggaccgtggcatccggcgaaccgtgccaaccag

SEQ ID NO: 604890 - DNA, 325 bp, Homo sapiens
ctactactactactaaattctcggccgctcgacctggtctcgaactcctgaccttgtgatcggcccacctaagcctcccaaagtcctgagattacagatgtgcgtcaccacgcctggctaatttttgtatttttagtagagatggggtttcaccatgttggccaggctggtctcaaactcctgaccgcaggtgatccgcccacatcagcctcccaaagtgctgggattacaggcgtgacgacagcccccggccaaagcctgcttattatttaaaggtttgtttgtacttttcttctagctgtcttctgatgtcgacgcggccgcg

SEQ ID NO: 604891 - DNA, 271 bp, Homo sapiens
agaaagtcaaggacgctggcacagactgtatagacagtgattgtcctatttaaaatagaattttaagggaacaatcatcaattaattaactttccaaagggcctgataaaaccaaaggatctggggcatgctatcccattgtggcagattcatatgaggtgttttgcggtgtcagccttttctccagagcatttgtttgactgactccaaggcactcaggagagccacgtctggcagactttacactaaattgtcattgtgagggcctgtc

SEQ ID NO: 604892 - DNA, 374 bp, Homo sapiens
gaccagagggaagaagaaagagaggaagtaaagtttaattatgccttttttggttgaggtgatgatggaggtggagatttggggctgttaaattgttttaggtaatagctcttctagtcaggttaggtctaggaggagtaggcgcaggagaattgcttgaacccggtagttggaggttgcagtgagctgagatcgttccactgtactccagcctgggcgacagagtgagactctgtctcaaaaaaaaaaaaaaaaaaaaagagggtttccagttttgggttggtcaaaaaaaaaaaggaatttttagaaattcctttgtttttaacctggaattttgggggaaaagtggggcctttccattaggggggaaaaaa

SEQ ID NO: 604893 - DNA, 952 bp, Homo sapiens
  misc_feature (263)..(263): n is a, c, g, or t
  misc_feature (270)..(270): n is a, c, g, or t
  misc_feature (305)..(305): n is a, c, g, or t
  misc_feature (328)..(328): n is a, c, g, or t
  misc_feature (351)..(351): n is a, c, g, or t
  misc_feature (364)..(364): n is a, c, g, or t
  misc_feature (367)..(367): n is a, c, g, or t
  misc_feature (509)..(509): n is a, c, g, or t
  misc_feature (575)..(575): n is a, c, g, or t
  misc_feature (667)..(667): n is a, c, g, or t
  misc_feature (682)..(682): n is a, c, g, or t
  misc_feature (695)..(695): n is a, c, g, or t
  misc_feature (700)..(700): n is a, c, g, or t
  misc_feature (750)..(750): n is a, c, g, or t
  misc_feature (752)..(754): n is a, c, g, or t
  misc_feature (760)..(760): n is a, c, g, or t
  misc_feature (767)..(767): n is a, c, g, or t
  misc_feature (769)..(769): n is a, c, g, or t
  misc_feature (773)..(773): n is a, c, g, or t
  misc_feature (777)..(779): n is a, c, g, or t
  misc_feature (781)..(781): n is a, c, g, or t
  misc_feature (787)..(788): n is a, c, g, or t
  misc_feature (791)..(791): n is a, c, g, or t
  misc_feature (805)..(805): n is a, c, g, or t
  misc_feature (836)..(838): n is a, c, g, or t
  misc_feature (841)..(841): n is a, c, g, or t
  misc_feature (844)..(845): n is a, c, g, or t
  misc_feature (847)..(848): n is a, c, g, or t
  misc_feature (851)..(851): n is a, c, g, or t
  misc_feature (857)..(857): n is a, c, g, or t
  misc_feature (862)..(862): n is a, c, g, or t
  misc_feature (882)..(882): n is a, c, g, or t
  misc_feature (884)..(884): n is a, c, g, or t
  misc_feature (889)..(889): n is a, c, g, or t
  misc_feature (891)..(891): n is a, c, g, or t
  misc_feature (908)..(908): n is a, c, g, or t
ctagtgggccttccttcccaggcatggtggctcatgtgtgtaacctcggcactttgggagaccaaggcggacagatcgcttgagtccaggagttcgagaccagcctgagtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaanctcgcanaatgggtggctatccagagtgtgtctgcgtggccngagaagagaggcgaaatcaggangatgatggaagttgctgctgcanatgttaagcagtnggngggctctgtggaactggtggatatcggaaaacaaaagctccctgatggctcggagatcccgctccctcctattctgctcggcaggctgggtccgacccacagaagaagaccgtgtgcatttacgggcacctggatgtgcagnctgcagccctggaggacggctgggacagcgagcccttcaccctggtggagcgagacggcaagctgnatgggagaggttcgactgatgataagggcccggtggccggctggataaacgccctggaagcgtatcagaaaacaggccaggagattcctganaacgtccgattctgnctcgaaggcatgnaggantcaggctctgagggcctagacgagctgatccttgcccggaaagacacatncnnnaagganggggacnanggcngcannncngacaannacnggcggggaaagaanagccctgcatcacctacggcctcaggggcannngcnacnntnncancgaggnggagngcacaacaaagacctccatncnggggngnacgggggcgcggggcangaggcatgactgatctcattttctgatggctcttttgttggcaa

SEQ ID NO: 604894 - DNA, 423 bp, Homo sapiens
cataatttgtaaaatgtatggcttatgcttcaatttaatgtataatgacaagtcttagggattgaaacataagccatacataatttgtaaaatgtacaagctctttaagatgctttctgggttggaacatggccaaagactgtgtgagaggcctccaggtttgccattacagctgtgagagaaacgtcctttcctcagcgtctcccagacagatgggaagggaagggtgtggggcacatgctgttcatcccattcaagaataccagcaggcgtgtgacgcacatctcgagatgagaagagagagcgtacatcttttcaaagtataaataattgttatcatccttcgtgctgctccctcttagacaatgtcatgtcaaaaataaaacaagatttttgtgtgttatttagaacaaatagaaaaag

SEQ ID NO: 604895 - DNA, 913 bp, Homo sapiens
gcaatcatacggccacgccggggttcgtgatgtacgctggggaaggatgcaaatggggcgccctaccgcagtgcggggaaaaacccggtcaaaaggaggagtgggtcaccccagcccctttggccgccagaccgcttcagtagcggcgaagttcataagctgccccacagtcctggggcgtgggaactacgacactcgaataaaagacggggcgacaacaccagagcacaggggggccgtgggcccagaccaactcgcatggtagtaacaacggacgaagacccgcccaggacatgtgggcctcgaaggcagtgtacagcgatctctctaagggcgccttatcaccgatggataaaggggctccctgccggagacccccggcgatcaagcccctccccgcgcgcaccactccctgggcggaacctcttgaacagagtctgagccctcaaggaattcttcgacaaggcaacacggggagacgagccgccaccggagcgggtgaactccccgccctggtagcaccgacagaccgcgagtactcccacaggaagccacgaatcaattttcccacacacgagagtgggggcaggtgggccggctcctgtaatcgaccggacaccccggggggccaaccccaggggggcaaccacaacgctgtaggcaagtggtttgcccaagacacaacacaggctccggaggtacgccgaacagcgtgagagtctacacaagcgagccctcttccaaacagcgggtggggacaacccacccgtggcccacgcggtggacgaaacggcgcgagggtcggggttggcggggacgcggaacaggcggttgactaagcaagcaaattcgcgagggcccccccccgagaccgtccaggcgatggggcaaaaaacggaagccccacaaaaca

SEQ ID NO: 604896 - DNA, 210 bp, Homo sapiens
  misc_feature (51)..(51): n is a, c, g, or t
ggcggcggcatcggcagcatcttccctgacggtcaccttagggcggctggngtccggtgcagccacagcatcctgagaccttcggggcccggagcagcctccctttggtctgcttctctaaggttcaattcacagagcacttcatatctaccaggatatgttcctaaaacatccctgagttcaccaccttggccagaagttgtttttgcc

SEQ ID NO: 604897 - DNA, 926 bp, Homo sapiens
  misc_feature (16)..(16): n is a, c, g, or t
  misc_feature (18)..(18): n is a, c, g, or t
  misc_feature (32)..(32): n is a, c, g, or t
  misc_feature (47)..(47): n is a, c, g, or t
  misc_feature (52)..(52): n is a, c, g, or t
  misc_feature (56)..(56): n is a, c, g, or t
  misc_feature (61)..(61): n is a, c, g, or t
  misc_feature (63)..(63): n is a, c, g, or t
  misc_feature (71)..(71): n is a, c, g, or t
  misc_feature (75)..(78): n is a, c, g, or t
  misc_feature (93)..(93): n is a, c, g, or t
  misc_feature (108)..(108): n is a, c, g, or t
  misc_feature (120)..(120): n is a, c, g, or t
  misc_feature (131)..(131): n is a, c, g, or t
  misc_feature (153)..(153): n is a, c, g, or t
  misc_feature (162)..(162): n is a, c, g, or t
  misc_feature (164)..(165): n is a, c, g, or t
  misc_feature (171)..(171): n is a, c, g, or t
  misc_feature (177)..(180): n is a, c, g, or t
  misc_feature (190)..(192): n is a, c, g, or t
  misc_feature (199)..(199): n is a, c, g, or t
  misc_feature (209)..(209): n is a, c, g, or t
  misc_feature (229)..(229): n is a, c, g, or t
  misc_feature (246)..(246): n is a, c, g, or t
  misc_feature (252)..(252): n is a, c, g, or t
  misc_feature (271)..(271): n is a, c, g, or t
  misc_feature (275)..(275): n is a, c, g, or t
  misc_feature (279)..(279): n is a, c, g, or t
  misc_feature (284)..(284): n is a, c, g, or t
  misc_feature (289)..(289): n is a, c, g, or t
  misc_feature (292)..(292): n is a, c, g, or t
  misc_feature (295)..(295): n is a, c, g, or t
  misc_feature (300)..(302): n is a, c, g, or t
  misc_feature (331)..(331): n is a, c, g, or t
  misc_feature (340)..(340): n is a, c, g, or t
  misc_feature (342)..(342): n is a, c, g, or t
  misc_feature (351)..(351): n is a, c, g, or t
  misc_feature (363)..(363): n is a, c, g, or t
  misc_feature (367)..(367): n is a, c, g, or t
  misc_feature (903)..(903): n is a, c, g, or t
ccagtccgcctgcgtnancaaaagctgcaganactgccctgcctggngggangcanggaancnaaccctanctannnnaagctctgtgctgcnttcaaccctcccaancaacctcctccnaacaagtggancgctccctggcctgcctggaanaagaaaagnannaaaagnaaggannnnaaggaaaagnnnaatggangaagccaaancaaaaaaaaaaaaaaaaatnaatggggctgggctgtnggggangggtggggtggcaaggaanaagnaaancaacncttcnaancanaagannntgctgctgcaaaaaaaaatggaaaaagcntaacggcantnggaccaaangaaccaacaacntgtnggcccagagcccagcctggggatcccccaagtgggtgcatggcaggccctgcgcactggccctgctgtacctttgactctgccccacactttattctctggtcctcattattgaagcattatctagagaaggaaggcagcgcaggggcttagtccagccaagagagggatcctcttccaacatttgggaataccctgggatcattcagtgacttccctcctggttcagatgggaaaactgagaccagagagcagaggagagcttgttcagagtcataacttgagttggggccaggaccctgccacaacatgccctgaggcatcaacggtctgccaagacaccccagtgtggtctggaagctggaaggagaccccaggattctggaccaagtgtatctacaggagatgctggtgccaggcctgcagatccaagagcagagctgggatggaggcagggcccaggagcttcgggaccagagtctccatgccagcagctgagaccctgcccaggctcaggacacagtcgtctgcaggagngttgctgatactcactgaggtga

SEQ ID NO: 604898 - DNA, 543 bp, Homo sapiens
agactctttaatctagataatatcagctttgcaacgcagcagagcagttgcgctgaacacccagtaaatgtaggtgtaggagacaattaacatccactgaatgtttctctgacatcagactattcttttaatgtcattgcttttatgaagagttgcaaatagactacataatatacgtgggcaaaaaggcaattaagtgaatctcttgaaacactaaatgtataataaacagcatattatcaacatttacatgattcacatcaaaatgatgacatcctaaaacgtattccttttaaaggatagatttataaataaaatattacatatcttttaatactctggtacaatacttcatatactgcaggaaaattaattgtaggtctagtcatcagcttaatcagggatccttttcccattagcttttattaataacagaatcacaattaggtcataaataaacaggcaaattattaattacatgatttgaggcttaggatgaaaacttgtcaaaatcagtttgatatacagcaacgttatacaaca

SEQ ID NO: 604899 - DNA, 452 bp, Homo sapiens
ccgcttagatcatgcgaggagtgccacgtataagaaggctgccgcgtgccacagaggtgctgtagatgctgggcccaggccctaggtttgctcgtcacagtgtggggaagcccattcctctgcaggctcccattgtcatctgtatcagtttgaaaagcatcttggccggtgtggtggctcactcctataatcccaacactttgggaagccgaggcgggaggatactttgagtccaggagttcgagaccaacctgggcaacatagggagccctcatctctataaaaaacttaaaaattagctgggtgtagtagtgaacgcctgtagtcccagctacttgggaggctgaggcaggaggatcacttgagccggggaggttgaggctacatgagccgagatcacaccaccgcactccagcctgagcaacagagtgaggccctatttaaaaaaaaaa

SEQ ID NO: 604900 - DNA, 1366 bp, Homo sapiens
ggccgattctgcacctccgtccggcgctgccctttgattcgtgatttccatcttgcattctccggctgcatcgcgggcacctggctcgtgcaagcaggcaggggggccgatctgctatggcagtcatttcatggtgccccactccagcaagagtgccgctcgtttgctaacatttccagtgaacaaccagcagcaacagcaagtgatacggcagggctcatgctagcctatgcacacaatcattccacctcaaccccacgcagacctcatgacgtggacacaggacgctgggcatggacttctcgcaggagagcatctgccaaacaagacacacgaggctggacgacgcacatgcaagcagcgaatgcaacgcaggggaattccgaggtccacatcaagcaccctcacatccacccaacgacagcacagggcaagcagcaagctccaagccaaggccaggccaattctcccagcacagacaagccggacgtacatcattactgccccatggagcagggcaacacagaccaggcatccattgcaagcagaacacaacagactcaaaagcgcttcagtccaaggacgctagaggcgagacatcaggtcacaccaaagacgcacgagagggacatgacggacaccaggggaccgacaggggcattcggcattcaccacgggaacactcgtggggacgggaccgaggacagagctgtgagtgaaccatggcgggcgcggcgcgacttcacattgacggctgacgagcaagacacgctcgtgaacacaacgaaacacgactacgggaggccgacactgagcggactgggacagggacagcacgtggtgcaggcacacgcttggcacggcacacacaatggcacccccgggaaaacaggcatcagaggatgaatgcgacaccagcacagaggcagcactggaggacagacagacagtgcaaatggtgaacggccgacagaacgccagccgaaccacgcgggcagaagggggcaacacgaacggaaagagtgaggacacccccacaatctgggcgacaaggggaagacgacaaaccccatagcacaagcagccaccagcagcgcccgcagcaagagctagggcacatatacagcacacaacgacaccgagaggaaaagaggcgagggcagaaagagaaaagcgagagaagaaccacaaggaccaagagcgacacaggacagcaggcaagagacaacgacaagaagacagagcgacgcagcagacaggggaggcagaaaaaacgcaccgcgcgccgaggaagaagcagcaaaagcgaggcgccgccgagccccggcaaggcgagcaacgtaaagcgacagcgccgagcgaacca

SEQ ID NO: 604901 - DNA, 196 bp, Homo sapiens
taagcacctgctgggacttctgcccggcgcactcttcctccagctgtctagctactccttcacgcctcatccttgtccccatcaccttctccatgcggggacaacagctccgtacggcttcctgtggatgtctgtccccagtgcctcccactgaagacacttcctaagtctgtgctgaatgaacaaatgacagaca

SEQ ID NO: 604902 - DNA, 635 bp, Homo sapiens
  misc_feature (624)..(624): n is a, c, g, or t
cgcgtcggcaagcgcttacctactactgccccgagcttagccctgcactacctactatcgccctacactaccctctactacctccgtacatcccgtacgaccaggacagtcccgtacatacaccgtaccctcgagccgcccctaggcgacccggagtcgcccgtgagtaaaccggaagaaatgagttagaattagaagatacatctgattattaggctgcgcgtacttagtattacatccgatttttaggctgagcgatcccggagttacctcctttactcatctagtctaggttatctgacgatgttatctgatttttcggctgagcactatcctgttatattattcgattatatctggttacctatctcattaagccatctgatttttcggctgagcactactatctattattactattactatctgattggatatctgactatgctcctatagctcatctaaacctgtatctaattagataagtcgagtataaggaagagaagaggagaagataaagcgcccggaagtggttcggattcttactggactatgaagtttactccggtttaccactacctcacgggttgggtgaccaggccaccggtttgctcatcactaccncaccctgcccg

SEQ ID NO: 604903 - DNA, 826 bp, Homo sapiens
aaagagagagggtgctccgagggggtgtgggaggtacagattaccctgtgtgcaccatccgcactttgtctacctatggtagcccaaggtaatgtcacggcacagagtcatttagatctataacggtctggagctgccataccttgagaaatgaactgctatggcaccgcgatctgtcaacctctccaacgtcttgaaagaacaatgtggggcgaaaatgtgagaacatgcactgctgcaccctgaacctgcagacggtagaacacatggcagcgtatgtctcaggctggagatgctgcactaatttgcctggacgggccacctgttgatctgggaaatgtgcctagatggcgagtcgccctgacagatggatcacagcatgagcttcgagagactgccagtgggaacagcagtccgctccagagaaccggacacccagcacccaccgagacacagaactgcgtttggtggaagatcccggagcgcaacagacaattcggcgatgcgttcagccacgaacaaacccaggaaccgcgcgagcaaagccccggtgctcgaagccggcaccgccagcgccgtcaaagagactcaatagccacagattggcgttggcgcacactggccacagtgaatgatgagacccagcaaacaagccactgatccgcgaaaggaaccttccggtggtaggttgtgacgtgcgcgagctgattgaaccctatgatttgtgaccccgtaattccaagataggactttctctccctgccccagccctagcgggtgcgtggagaggaaccagacttcgggtacacaggaaatctcacaggtg

SEQ ID NO: 604904 - DNA, 808 bp, Homo sapiens
gggggcgcgggccggggctgctgtgggagagttcggattgctgcggcggtgctgaacgttgactgtgggaaattcggaaacaacgctcacatcttcctgtgggaaaccttctagcaacaggatgatgtctgcagtggactgcagtagccaccttcctctatgcggaggtcttagtagtgtcgcttctctgcattcccttcatttctcctaaaagatggcagaagattggcaagtcccggctggtggagttgtctagttgtcctatggcaaatactttctttgtaggtctctcattgtcatccgttgtgcgtgttaggtcatcgatgccgtgcgcgaaattcggacagtatgatgatgtgacggaaaagggtgaagctccagaacaatcccggggccatggatgcagttctacatgaaggctcatccgtgcccagaggaatctctagcatagctggctttatactatgctgctgtccttcctggtttagacgcctggtgactctcatttacgcagcaggtccatgctgctggctccaatgaggcttaaaaagcaggcggaaaagtgctagtggagggcgagccaagagagaaaatggagggagaatgcagccagcgcaataaaggagcagaggggacgggaggcagctgggtgtcgagaacgctgagggagaaagggaggaaaagaaaggaactgaaggagactgcaaacacggaaagatgggcccacagagaacaagaaaacgcaacgtggcacgggagctctggacccaggaacacctgtaggaaacaaacgcggaaagccggaagc

SEQ ID NO: 604905 - DNA, 257 bp, Homo sapiens
  misc_feature (172)..(172): n is a, c, g, or t
  misc_feature (176)..(177): n is a, c, g, or t
  misc_feature (184)..(184): n is a, c, g, or t
atttatagaaaggacagcctgatgccaaaattccaccaaatgcaaaactcacttttgaagtggacttagtggatattgattgaaatagcagtgcttcagctcctaaggatattagcaacaatgataaaacttggccttgaaagaaatttacacaactagttgagaacttgtnactnnttgtacnggaagagtccactggcaaattcacggcagtaatcaaatatgtttttcttggtcccagcttatgagagataaat

SEQ ID NO: 604906 - DNA, 105 bp, Homo sapiens
acggtcaggacagccgcccctgagttgcagctcgcccctgagttagttgcagctcgccctgagttagttgcagctcgccctgagttagcagctcgcccctgagtt

SEQ ID NO: 604907 - DNA, 191 bp, Homo sapiens
catcggacaggccaccgtatttcgcgaaaaaaacgttccccccgctatcagctcggacctaccggaagtgcctccttattacgcacaaaaaaatgaatactcccccggctagttgggacccaccttggtgggaggctggcttgtgggcctactaagttgacggggacgaagggctttgtcaacttcgtcaa

SEQ ID NO: 604908 - DNA, 286 bp, Homo sapiens
actatatagcttggcagatgttagatggcaccaggaatgtgctcacccagctagctcgcaaggaggtagtcatcgactctcgaaccagggaagcggacctaccagtggagtggccttcccgaaggatgtgatgacgttggtgactgcacgaatggcaatctgtatctaagacagctatgatctgctctaattgctataagtgaactgtagataggacttcacaaatgaaggccattataaagtaaagggttctgatatgacttaacaaggtgaaagggcatgagtt

SEQ ID NO: 604909 - DNA, 153 bp, Homo sapiens
ggcggggacctcacttgactacctcaatggaagatcctcactgaggcgtggctacctcccttttgtcaccactgctggaacgtgaaattgtccgtgacattaaagagaagctgtgctatgtcgccctggattttgcagaatgagatggccaca

SEQ ID NO: 604910 - DNA, 277 bp, Homo sapiens
tgtatgtattaagagagcctgaaatcaactctgtgcctaatcctctgagccaatgatgactttatagccttatcaaactgcagtaaaacttgcagggcagagtcgagtgaactgctgagatttgatgagctcatctaggctctcctgaagactgtgtcccacaagtagtacttctgtatagctgatatgatatggcttaggaagcagaactcgtttttcttattcaagcttgcgttgatgtcctgtgctgaaggtttcctggcaacgggccagcggg

SEQ ID NO: 604911 - DNA, 90 bp, Homo sapiens
ggatttgctggtgcagtacaactaggcttaatagggacttaatagggacaagcatcaagcacgcagcaatgcagctcaaaacgcttagca

SEQ ID NO: 604912 - DNA, 369 bp, Homo sapiens
  misc_feature (40)..(40): n is a, c, g, or t
ccgtcgtcagcatcatcactgtgtatgaagttgtacctgntctaggcgtttctattccgagttctctcgaacgagccatgaacacgcttgtgtatctttttgtttactccgcagctcgaacgtgtatgttctagtgtgggcctgattcacgatgttacctgatgttatttactagctactgaggtcagacaatccaagaccatcattatactaaaacttagagttgtttatggaagttcatagacacttcgccgaattggttttacctcctacatgggaacatgttcaaggaacccaggacgggcttactggtctgactcaactcttcccattcatcaatccctattcaccagtggcacggagagggga

SEQ ID NO: 604913 - DNA, 192 bp, Homo sapiens
ctgccttaggctcctgagcagctggtaccacaggtgtggtccatgcccggctaattttattttcaatagaaatgaggtcttgttaagttgcctaagtgggtttcaaactcctaagctcaagcaatcctcctgcctaggcctcccaacgtgttgggattacaatgctttttataataagaaaaccattttatt

SEQ ID NO: 604914 - DNA, 101 bp, Homo sapiens
taccgggtgtacatcccatgccgctcccgtccgtcacgatgacacccaccgcccgtgagggcccgtcctaggaatggagtgtggggatggtcgcgtttgta

SEQ ID NO: 604915 - DNA, 521 bp, Homo sapiens
  misc_feature (136)..(136): n is a, c, g, or t
  misc_feature (219)..(219): n is a, c, g, or t
ccccgcgccccgcgttgggttccattcggcccatcgtgggttcccccggttttgtgttcacaaaaaggtgcgccccgccccggtttcaaccttgaggagctcagggtggccggcatttccaaaaaagtggcccggnccctcggcatttttttggatcccaggagggggaacaagtccccggagtcccttcaggccaacgttcaacgggttaaggaggcnccctccaaatttttcctttttcccaggaagccctcggccccccaaaaaggaaacagttttttttaaaaatttaaattggcccccccacttgccgggccggtttttcccctccggaacgttttttaaaaagaaaaagccccggttctcccttaggaaaagaaagaattttaaaacctttccttgtttccgtttggcccgtgccaacccccggttttttggcattcgggcaaaaaaaaccaaagaaacccccaaaccggatttttaaaaaaaaaaataaaaccctccttggggcttgggttcca

SEQ ID NO: 604916 - DNA, 1169 bp, Homo sapiens
taacaccggtgaaaccccatctcgtgcctcccgggttcaagctgtgtccaggtagatcttgaactcctgacctcgtgatctacccagctacggctcccaaaatgctgggataaccaggggtgagccaaccgttgcacaaaccatcacatgtgcatatcctatatcgcttacatcatccacccagcaccctagagaaaacatggccaacataacaccacaacacaacccaaactatccacccaactgacacttagccccaatggatacacagttcacctcacagcgtgcagacattccaggccaaagggtccaccaaaagcgttcaccaggcgcagcagtacactaccggttcctggtcaataacccccaatatattaacccccttccatgtaccttacaagcaacgaccattctatctctctctacgcagactcggacatttatatacgctgtacctcgttgcacaacaaaacaactctgtgctgatccaccctgtggccttcccaatcatatacaacaattgcggactgacgcgaacacacccgagggaacgtgcaaccacgcttatcggtgggtactatgcgactgtacggccttaggttacacaccaggctatatccctatggaatacgggcctaaggaaaaaactctttggtggcacccacgggtttaactggtgtctacctggacaagggtcatggacatgtcagcttctttaacgcactcagccccatattctttaaaaggctaggataaactgccagggtgccacgtctccgattataccacacatgcgctggctcacagggatgatagagaactggtggtccaccacttacatatttcggggcggtcatcctctgccacaaacgtgcaagccacagctacttggcagacattcaaccctatatttgagatcacaatttcaaacgccgtgtttcacaaacaggacaaacacacacacgacacacaccaagcaggcgcgcgacgcaccggcaccaccaacgacaataagctcacacaacccctccagacaacccgacgcacacaacgagaaagccgcgggccaacacgcccgccccaaaggaccaccgcgcaagacaagcggcgcggtcctcccaacaaacacacccggcgaacagcaggcgtgcacaacaccggcggacctg

SEQ ID NO: 604917 - DNA, 536 bp, Homo sapiens
cggagggaggggctgggggatgtcagggccacggagcgcaaagcgcaaaggcccgggcgccggccctgccgccgccgccagttcattttcatagagtcgcccgagcttaacgtcgccttgcacgtgttttctaagctccacaggtggctttggggtacacgggcgcagctcaccctccttcccgcccgctccccggccccgagctcgaggttaaacagggccgcggagtcggccgggaaggggtcccggcagcccggggtggggggcgcgcggcggggtcgagcggggtctggggggggcgcccacctgcggagaagtcgtcctcgcggtcggagctgtgccggctgccgtcgctgtctctctccggcgagctgtggccgggcgagtcccgctcgggcacccgcaggaacctgcggcgccgccacgggggcaggtgctcgcgcccgggggtctcctccgcggcgaggggcgagcccgggcggcccttggcctcggcctcccgctgctccaggtcgcgggtcccccgctgcggccgc

SEQ ID NO: 604918 - DNA, 385 bp, Homo sapiens
  misc_feature (75)..(75): n is a, c, g, or t
ggcctaagcctccccttgccctcttgctcccagactcctagaaagccaagaggccgggcgccgccttctaagaanaaaacgagtccgcagagggggctggtgagggccgtggcccttccctgaagtttgcacgtggccccaacacacagagcagcctgcggagaagtcgtcctcgcggtcggagctgtgccggctgccgtcgctgtctctctccggcgagctgtggccgggcgagtcccgctcgggcacccgcaggaacctgcggcgccgccacgggggcaggtgctcgcgcccgggggtctcctccgcggcgaggggcgagcccgggcggcccttggcctcggcctcccgctgctccaggtcgcgggtcccccgctgcggccgc

SEQ ID NO: 604919 - DNA, 473 bp, Homo sapiens
  misc_feature (182)..(182): n is a, c, g, or t
gcccagcccctgggaaaaaaccgggggtttaggggggtgccctaaccccccaaggggggggtgtgacccaaggggttttcccaagggggaatttttaaaattccccgggccccaaaggggggggggttggaaaacccccaaaaaaaaaagggccctttggtgggagggccacccgggggccncccagccctagggggggtttttttaaatcccaggaagggcccccctttttttaaggggcaccccttcaggggcccctgggggttttccccccctaccccaacctcctttgggaggggggggttgggggaaggggggggtttttcccccccccggggaagggggggggtaatggggaccccccccatttttttgggggccaacccccccaggggtaattaaaggggtttttaaaaattggcccccacccccccggggaattttaagaaaaaaaaaccggggcccatttttta

SEQ ID NO: 604920 - DNA, 236 bp, Homo sapiens
tattacaaagaaggacacacaaattttaaatgcattttctatcaaactgaattcaccatcttctgcccaaattcattccccttctttcaaccctggcctgaaaaatctatctgagccagaaaactggaagtcattctagattcctcccttctctcccctctcacctattgtcactggcctcctgcccccatcccctgggtgcctcacctccacccaccaggtcaggtgggctacgt

SEQ ID NO: 604921 - DNA, 383 bp, Homo sapiens
  misc_feature (298)..(298): n is a, c, g, or t
  misc_feature (314)..(314): n is a, c, g, or t
  misc_feature (323)..(323): n is a, c, g, or t
aatgctgaatgttccgttgtgtgtgtatactccattcacattttcaataagtttgttgagtttgggttgaaatcttatatacagaaccgtgttgtggcattcagggtgattgaaaagtaagtactactctagggcagtgacttcaggcttttgaagacattaccttatccataaaacatgcttgaccaaattctcaatatatgtatattgatgtctactactatcgatccagatgttaaacattgacaaaatttagtttcttctccttactttccttcttccccttctttcctctgcnttcacctccacctgcncccatctcncctttcttcttgtcccttctcctttccctctacttcttcccctgtcactttctgggtcct

SEQ ID NO: 604922 - DNA, 674 bp, Homo sapiens
tcctcggtgacaaacttaataaaatttggcatcagtacagggcatctcttatggcatactaaaatcccaggatccaggcggggggtaaaggggcaacggcaaattgggggtatctgggtcccccaaaagtactggccggctctacccctgactctgcaatgggctgccagggggatcactcctccatgggagccatcccgctccagggccaaagcgagagcatgggcagtgaatggcagacactcttcctgggtcatgcctccccggtaggtagcatcaacatagccataggattgtaggaagcccccgggagcctccaatgggcaaaggagactggcctataccatacataacccccacatagggcactggatgtacacctggccctcctttctgagagggtgccccagcctggcgatgagatagattccccgccatacagggttctccccgggtatcgggtaacactatctccttaaaagaggctgggctggctggtggtgggcaccaggggaggcccatccagtccaaggctgggggaaaccgagctgggtaggtggacagcatcagcaacggccggggtaatcagcagttgagcctgagcgacagcagaaaaggcggcgtgaatcaggtggtcagctggtcagcactcgatggcgatgtaggaccccagt

SEQ ID NO: 604923 - DNA, 876 bp, Homo sapiens
  misc_feature (369)..(369): n is a, c, g, or t
  misc_feature (373)..(373): n is a, c, g, or t
  misc_feature (391)..(391): n is a, c, g, or t
  misc_feature (399)..(399): n is a, c, g, or t
  misc_feature (403)..(403): n is a, c, g, or t
  misc_feature (417)..(417): n is a, c, g, or t
  misc_feature (420)..(420): n is a, c, g, or t
  misc_feature (422)..(422): n is a, c, g, or t
  misc_feature (428)..(428): n is a, c, g, or t
  misc_feature (475)..(475): n is a, c, g, or t
  misc_feature (486)..(486): n is a, c, g, or t
  misc_feature (707)..(707): n is a, c, g, or t
ctgggaaaggtgaacgagattgccaagcataaagcctctgtagaagatgcagatacacaaagcaaggtgcaccagctatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttancccnacccctgtgaactctgtnaacagctnacanagggtttccccttnacnanaactcnagcatccccatcccatttgacactgggggcaagggttcttcttgcangtggggtttanacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaaagctgntgaactctggggggcctctgctgtgtttcctggggaggaagcagccctaggaaataaatattcatttgtcataacaggcaatttaagcccctttatactccaaaagagggatttaaattgtaacctgtttttaccaaagaactaaataaaaaatgagtacagagccaga

SEQ ID NO: 604924 - DNA, 101 bp, Homo sapiens
tctctgaggatgatgatcagagacctgaatgaaataaggaagatttcatctgggctaatgcatagaggaagagtattacagacaggggcaagcgggcgcta

SEQ ID NO: 604925 - DNA, 273 bp, Homo sapiens
tgatacatataagtcatccaggatatatgaagaggtactactagatataagaactttacgattcgaagacgaaagctactcaaatacagggaaattattactattactagctagtaagagaaatgaatgagcctacagatgataggatgtatcatagtggtgtatgcctcggggatagtccgacgtaacgtcggagacatccggcataggccgcaaaaagtgttgtgggcaacaacgttagattgacgccgcataaatatgatagtgcaaatg

SEQ ID NO: 604926 - DNA, 125 bp, Homo sapiens
gtataacggggttgttcattgaggacctccgcctgcatctatgtacgacccatctgtccggtccaaaaagaagaattgtactcttagggagttggggatcccaatgattggtgccgcacatacag

SEQ ID NO: 604927 - DNA, 1155 bp, Homo sapiens
ctaagtcctaaaatgacattttgctaacattcccattttttctaattttaggattctataagcgccaataattttgtgttcctggtgaccatcccgaccattagagttcttgacatgctaaaatgttctatgttatcttatttcggtattcggctctttcttttcataaatctgactaataccatcataccagtcaaaattaccaaaatctgttgtctttgctaaacacaacacttctattaaactatctgggataactttcaagactttatgacagcactcatccagaaccatgcttcctacagaaacagcctatcctgaatctgccatttgtctccaatgccactcttaaatatttgccaactcctattactaagtctcttcaaaggattaccagcagtcttaatttcactttctgtcaagccactttgtacttttcttcactaaaacatggaaatatattttgaacataagcaacaagacaaattttacagaacagtttgaaacaactataggacttccagtgattaggacatagaaaaatatttaaagaattcacacttttttcccttttatattctaggtatgacagaatggtttcatcattttataattttgtagacagaaatacacatactactcatacatacacttaaaaatgtatatgtatttctttgaaaagatgagcatcacttatgaggaagcaaaataatagaaaattttcccaacaaagaactacaaattcctttaaaagcaatattcttgaactgctgtgaagacatacaaccacaatgctacataactttaaaatcacagcagaccttagaaaccatctaatctagatggtccattttttcatgtgaagaaattgaggattcaagttgaaaatctttgaaattaaggaaatggcagtagtcagactgtaaacaaagtgcaagaaaaacacatgggctttgctgttaaaaacaaaacaggccaggtcaccacaacaaaactatgtgaccttcagcatgttactaagcttttttcggggttggggggtcaggggagcacttcaccttctttgtctttcataaaagtataagaactaggggccaggcgtggtggctcaggcctgtgatcctagcactttgggaagctgagcgggcagatcac

SEQ ID NO: 604928 - DNA, 1101 bp, Homo sapiens
ctaagtcctaaaatgacattttgctaacattcccattttttctaattttaggattctataagcgccaataattttgtgttcctggtgaccatcccgaccattagagttcttgacatgctaaaatgttctatgttatcttatttcggtattcggctctttcttttcataaatctgactaataccatcataccagtcaaaattaccaaaatctgttgtctttgctaaacacaacacttctattaaactatctgggataactttcaagactttatgacagcactcatccagaaccatgcttcctacagaaacagcctatcctgaatctgccatttgtctccaatgccactcttaaatatttgccaactcctattactaagtctcttcaaaggattaccagcagtcttaatttcactttctgtcaagccactttgtacttttcttcactaaaacatggaaatatattttgaacataagcaacaagacaaattttacagaacagtttgaaacaactataggacttccagtgattaggacatagaaaaatatttaaagaattcacacttttttcccttttatattctaggtatgacagaatggtttcatcattttataattttgtagacagaaatacacatactactcatacatacacttaaaaatgtatatgtatttctttgaaaagatgagcatcacttatgaggaagcaaaataatagaaaattttcccaacaaagaactacaaattcctttaaaagcaatattcttgaactgctgtgaagacatacaaccacaatgctacatttcatgtgaagaaattgaggattcaagttgaaaatctttgaaattaaggaaatggcagtagtcagactgtaaacaaagtgcaagaaaaacacatgggctttgctgttaaaaacaaaacaggccaggtcaccacaacaaaactatgtgaccttcagcatgttactaagcttttttcggggttggggggtcaggggagcacttcaccttctttgtctttcataaaagtataagaactaggggccaggcgtggtggctcaggcctgtgatcctagcactttgggaagctgagcgggcagatcac

SEQ ID NO: 604929 - DNA, 215 bp, Homo sapiens
ctcattccaagccattggctgctgttcctgaagagagagctggtcagctcaactgaaagccgtttcttgtaatcttgtggcttgtcctcagacacttcggcactattacagcagactgcatatgtcgccacaccgtcattcctagagtgaaccccctccgggaagatgtaaaaaaacctgtcccccccacaaaacaaaaaaaacaaacataaaaa

SEQ ID NO: 604930 - DNA, 1420 bp, Homo sapiens
tttttctttttagttgcaggcgtttcagtctgtttgttgtttttcttctttttctcttgttgcgtgtgctttgtttcgtgctgtgcagtgtcttcgtctggttgtattgtcctcttgtgtcttttttccattctctgtgttgtgtcctctgtctgttcgtcgtgtgtgttctcttgcttgtttgtgtctgtgcctctgtctgttgtgttcttcttctgtttttttagtctcgcgtttctccgcgttctttcgttgttcctcgttttgtctcttcctgcgttcctcgtttttcgttggcttcttttgtgctgttgtcttcttgtatcttgttgcggtttgcctgggtctgtttgttggggtcgttttctggttgtcttggtctctgtcctgtcgttgtgtcgtggtgtctgtttggtctggttcggtgtgctttctgtcgtgcgttgttgcgtgtttgtggctattgtgggcgtattcgcgtgtgtggtcgcttgtgggtcttccctgtgtcgtctgtgttttgtttgtctttcttgaggtgtcgtctcctggtgtgtctttcttttgggattgtctgtggaggttccttgtcctgtgctcgggtagatgtcgtaggtgtgtttttgtgcgtggtgatgtggtggtttttgggcgtgaccttcggtgtcgtcttgtttcatctcttcgtttgttttgtggtctgtcttttaatgacattccctgtgtgtctggtttgactctattgctgtctcgtgtcagctgcttgggtgtgtcttgtctccaagtgtccttgtcgatctgcccggaggatgactagcatggattgtttagtccatgaagtgattggaaccaagatcaatcgataggtttacatgtatggcccatctttacttagtgtgatgattccatgcatgggttcacatgttaccttgctatgtaatgttgtatgcgcctgtatacgatgatccttgatgatgaaggttggagctttacaatgcgcacctgtgaccaattatgatggacgtctagggctcaattatcatgaatgacatgagctctatgatgtcaggcctggctctcgcatatcggtagtcagtgggtggctcaagggccagcctccatgcgctgctctttctgtaggttatttattagtattggatgcacggcgaaggtctgggagtgtctttcccacctgcccttgcccatggtggggatggatcattctggtctgatgtcatgacgatctgtgcacactctctaaacagcttgtgatgcaagtgtgagtcctattgtgttatcttgaccttattttggaagtatttgaagtggcctaggaggaaacccagaaatgaatccaggggtatgtcatcacgttttttcatagtcaaggtcctcaccctgaacctccacaggatgctca

SEQ ID NO: 604931 - DNA, 518 bp, Homo sapiens
aaagagacagaaaaagatgtaaaaattgaaagagagagaaaacagttttgcttagaccaactctggtaagtaatttaagccccttaaaattgtactgactgcaaagcagttcataattatacatatctcttaaattataggcttcagaattcagtcattattctatcataggaacttgtgaattactttctccaagattttatatgacaccttgagcttgttgcgttgggagaatttcagtggaagagcagaaccaagtaatgccatcctcatctgagtccctaactgaatgctctacgtgattgcattttgttcatttattcgacacttctatgtgatgggtctagaacaatagacaagatctgtgctgttagagacttgccctttaaaggaaaatgaagaaatgattgcataattaactgtagagagtaactttgagagtggttaccaaagagagtctatgaatagatcctcatctgtaaatgaattattaggagaataaaaattccctcttccta

SEQ ID NO: 604932 - DNA, 468 bp, Homo sapiens
  misc_feature (4)..(4): n is a, c, g, or t
  misc_feature (49)..(49): n is a, c, g, or t
  misc_feature (60)..(60): n is a, c, g, or t
  misc_feature (459)..(460): n is a, c, g, or t
attncgaattttaattcgactcactttggggaaatttggccctcggggncccaagaattnggcccgcaaattttttttttttggagtagagattggaccaccatccttagcccaacacggtgaaaccctgtctctacttcaaaatacaaaaattagctgggcatgatgtctatcaagattcatgaaaaccagccaggcgcagtggctcgcacctgtaatcccagcactctgggaggctgaggcgggtggatcacaaggtcaagagatagacaccatcctagccaacacggtgaaaccctgtctctactcaaaatacaaaaattagctgggcatggtggcgtgcacccgtagtcccagctactagggaggctgaggcaggagaatcgcttgaactggggaggtggaggtcgcagtgagccaagatcacgttactgcattccagcgtggcaacagaagcgnntccgtctc

SEQ ID NO: 604933 - DNA, 729 bp, Homo sapiens
  misc_feature (37)..(37): n is a, c, g, or t
  misc_feature (106)..(106): n is a, c, g, or t
  misc_feature (118)..(118): n is a, c, g, or t
  misc_feature (175)..(175): n is a, c, g, or t
  misc_feature (180)..(180): n is a, c, g, or t
  misc_feature (192)..(192): n is a, c, g, or t
  misc_feature (198)..(198): n is a, c, g, or t
  misc_feature (203)..(203): n is a, c, g, or t
  misc_feature (214)..(214): n is a, c, g, or t
  misc_feature (219)..(219): n is a, c, g, or t
  misc_feature (223)..(223): n is a, c, g, or t
  misc_feature (228)..(228): n is a, c, g, or t
  misc_feature (246)..(246): n is a, c, g, or t
  misc_feature (269)..(269): n is a, c, g, or t
  misc_feature (280)..(280): n is a, c, g, or t
  misc_feature (304)..(305): n is a, c, g, or t
  misc_feature (315)..(316): n is a, c, g, or t
  misc_feature (326)..(326): n is a, c, g, or t
  misc_feature (337)..(337): n is a, c, g, or t
  misc_feature (341)..(341): n is a, c, g, or t
  misc_feature (353)..(353): n is a, c, g, or t
  misc_feature (355)..(355): n is a, c, g, or t
  misc_feature (357)..(358): n is a, c, g, or t
  misc_feature (361)..(362): n is a, c, g, or t
  misc_feature (380)..(380): n is a, c, g, or t
  misc_feature (388)..(388): n is a, c, g, or t
  misc_feature (417)..(417): n is a, c, g, or t
  misc_feature (424)..(424): n is a, c, g, or t
  misc_feature (462)..(462): n is a, c, g, or t
  misc_feature (516)..(516): n is a, c, g, or t
  misc_feature (556)..(556): n is a, c, g, or t
  misc_feature (576)..(576): n is a, c, g, or t
  misc_feature (712)..(712): n is a, c, g, or t
gcacccctgagggacacaatgtccctccctgccggcngtcccacctccctggttcccaacagcattgaaaccccccacttccctgaccagactggcattttttaanattttgcataanactatttcttccatagacttcaaacaatcaactagccaagtgaattatgggacatcnaaacnaagtttaatacnaacccnaatgngtgactgcggnttacnaagngcccngtatcacctgggggagcnttcagtagccatccactacaacngggcccaaaanataataacaataataataataatnnggggatgaanncccaacagcntgtggaatggntaanatcacgtaagancngnnatnnggggggggggggtccccnacagccgngcctgtcccagcagtgaaaatgcccgccncccagcngggctcagaaagggctggggccctccaggcagagggcngagcgcagggggctcttggaggacactcaccccatggtccatgggatgcttctngcttccttaaaaacagtagggcatccgcattgtataagtnggtggagaccctagtgtggntcttttgaaggatatgggaagggaggatgacgaactagagaagtgggaggggaccaaaatcactgaggtcccagaatatcatagatttgggtataggattggggtcactaagaattgagcaccaggaattccagcntcttcccattaaagaaa

SEQ ID NO: 604934 - DNA, 103 bp, Homo sapiens
atagattgagttaggtcagatctctttcactgtcataatttcctcacgcaaccaacgcatgcataatccttctaatagctatcctcttcaacaatatactctc

SEQ ID NO: 604935 - DNA, 243 bp, Homo sapiens
  misc_feature (123)..(123): n is a, c, g, or t
  misc_feature (180)..(180): n is a, c, g, or t
  misc_feature (240)..(240): n is a, c, g, or t
tagaggaccctgatactgtggtgtacccgtcatggaatcaagtgaattcatcacgctgcatggattccacttcattcactcgggatgcaattcacaacgctgcatcggatccagtgcattcantcatgcttcatggaatccactgcattcaatcgggatctattgggccaagctgcatgnaatccattgcagtcactctggatgcatttcacactgctgaatggactccagtgcattcantca

SEQ ID NO: 604936 - DNA, 424 bp, Homo sapiens
cgacagaatttgtaaaagacatcttgtttataagccgcaacggagtactcgtactgattgagaacatggcccgtgactgtagggagtacgcgcagactcgctacttcaggggcggatgctgacaatgcgcgctcctctttggcccacggtcctgctgcggaacctcatcatcttcctgcaaacgctcaaaaacatctttgagccacacgtgcgcgtaggagacgcagccaagatgaatatccccatatgtggcatcgtggacaccaagttgaaacccctgcctcatcaactaccctgtacccggaaatgacgaactctccgattgctgtgcacctctattgcaggctcttccagaaggacataacccggaccaaggagaagcgacagcagttgaggctctctatcgccatcaggcccagaatga

SEQ ID NO: 604937 - DNA, 285 bp, Homo sapiens
aagagctttattgtagagggcgagtgtgggggggtcatgccatgtaatcacagcaataggggaggcccaggagggcggatcacgaggtcaggagatagagaccatcctggctaacatggtgaaagcccatctctactaaaaatacaaaccttagctgggcgtggtggcacacacctgtaatcccagatactcaggaggctgaggcaggagcatcgcttgagcccgggaggtggaggttgcatgtgacccaagatcgtgccactgccctccagcctgggcaacacg

SEQ ID NO: 604938 - DNA, 147 bp, Homo sapiens
acccacgcgcggaccgggtgggaacaaggagacttgcacccgccacctgttcccgaggactttctctggcaccgacctgagtgtgcagcgtctgattgacggccaggaccggagcatttcatgtctgaggtccggtcgtgccgaggg

SEQ ID NO: 604939 - DNA, 240 bp, Homo sapiens
cgagctcggtaccctatttttgcattattaagacataaggaaaccaatttgatacaaagcatgagaggctattcatctggctgcctcagaaagcagatcatggtcgataggtgaagtgacttctgcctgcttactgtatcaaatgacttctgtaacacttgctatgccatcttatatttaaccttttaaaaaatgactgccagttaaactcagagctcatatatagaacattataactat

SEQ ID NO: 604940 - DNA, 743 bp, Homo sapiens
  misc_feature (34)..(34): n is a, c, g, or t
  misc_feature (82)..(82): n is a, c, g, or t
  misc_feature (97)..(97): n is a, c, g, or t
  misc_feature (102)..(105): n is a, c, g, or t
  misc_feature (126)..(126): n is a, c, g, or t
  misc_feature (130)..(130): n is a, c, g, or t
  misc_feature (175)..(175): n is a, c, g, or t
  misc_feature (235)..(235): n is a, c, g, or t
  misc_feature (238)..(238): n is a, c, g, or t
  misc_feature (268)..(268): n is a, c, g, or t
  misc_feature (275)..(275): n is a, c, g, or t
  misc_feature (278)..(278): n is a, c, g, or t
  misc_feature (292)..(292): n is a, c, g, or t
  misc_feature (295)..(295): n is a, c, g, or t
  misc_feature (391)..(391): n is a, c, g, or t
  misc_feature (396)..(396): n is a, c, g, or t
  misc_feature (404)..(404): n is a, c, g, or t
  misc_feature (425)..(425): n is a, c, g, or t
  misc_feature (495)..(495): n is a, c, g, or t
  misc_feature (565)..(565): n is a, c, g, or t
  misc_feature (589)..(589): n is a, c, g, or t
  misc_feature (636)..(636): n is a, c, g, or t
  misc_feature (639)..(639): n is a, c, g, or t
  misc_feature (729)..(729): n is a, c, g, or t
taattcttataagtttatacatactgcataatgnctttgaaaacagtataactcaaaataatagaaaacaaaattcattgantgacgtcctactganttccnnnnatttctgtgacaacacaaatntaanatttaataaaatattaccttttcttagcaaaaagtttcttaagtnagattatcctttcatgttttaaatgaagcttcttctaaagaagtccttttattcacagtngcnaatttctttttaacacatacaatgtatacnacatgcnggnatcaaacacctganggngcgggaatcttatgaatacagccagggcaacagtgtagagaatcatgaacaaaaacatcacagtgcacacagaaaacattttggcacacagcacanacatnaacatgtnggtctttcaattccccctganatccataacaaaatctttctccattatattcttctggggggatttcttgggaagcatccgaagggaacanatgatggtaaggccgtgccaagtggggagcggagaccaaagtgagagcacagattttacattcgacaggnagctcacagtactttgcccgaaantgtgggcagaaatagcctcctaatgtaagccctggctcagtattgcnatncaaatgcgccaagctgaaagagggttttgcatcctggtcagataaagaagcaatggtgttctgaggaaatcccatacgaataagttagcnttcagaacttgagc

SEQ ID NO: 604941 - DNA, 681 bp, Homo sapiens
  misc_feature (66)..(66): n is a, c, g, or t
  misc_feature (75)..(75): n is a, c, g, or t
ccccatgggagcggtaccgaatacaaacctgggtgaaaaggaaggtttgaaattaaataaccctgngcttgcttntccaagccttggaacctaaaaatttgttgggcacaccagtaggtgctcaaccaattaatttgctcctgctgtatttaccagggccaaaacaagctcttgcaatgcagtgggtcctcaaaaacctttatcctttcagtgctgtcatggccatagtgcctaccacagggcaggcatataatgttattcccttagctcacagcggtacccatggttcataaaaatgtgtgtggcccatagtaggtggtcacgacatatttgttttgttcattcctgtatctccagtgcctagcacttagtaaccccttagtgtttgttgaatgaatgaatgtcgggatgaagcattgttctgttcctgaacccccaatatctcccataacagaggtgcccacaatatggggagagcagtggggcagcgcaaaagcctgtgccagcctgtgtgtttggatgcctctttaggaacagcagcctcccagcctgcctgaatgcagggcctcctccctgcctgccaggaagcacatggctccaacgcgttatgccagcctggagtttttttttttaaaataaacctttttcctaattattttttttttttttcacattaaacag

SEQ ID NO: 604942 - DNA, 221 bp, Homo sapiens
ggggggggtccttcttttttcccccccggggggcgcgggggggggttttcccctcttcgcccccccccccccggcccggggggccgggggcccccctttggggccccttttttttttggaagagaaaaaaaagagttataatgggtaaaagatagggaaaaattcaagcgcctttattgtaacgcgatgcataattgtgagcaaataaaatcgaagaatag

SEQ ID NO: 604943 - DNA, 101 bp, Homo sapiens
  misc_feature (48)..(48): n is a, c, g, or t
ccgtcgatactcagatctatataagcatgaaagagtacaaaagatgtnggagtcagtaagcccatacctaaattaaccgtaaagcttcaaggacttttggt

SEQ ID NO: 604944 - DNA, 198 bp, Homo sapiens
cccccccaaaaaattttttggggggcccccggggggtttcccccctccccccgggaaggggccccaaaaaaacccaaatttggggggggctttggccccccccccaaaaaaaagggggttaaatttaccttgggagggggggggggggggggggtttttttttccccccccccccccccaaaaaaaatttttttttta

SEQ ID NO: 604945 - DNA, 303 bp, Homo sapiens
gtacgtggaaatgtgacgcttctggaaatacacaccgtccacctgactgctgctaggcactggtggtggtgtgtctatcatcattgtccgtgcaaatgtctcgtgacttgcggtcccggattgccgttatcgtgttgagttcctgtagtgcacttcctcattatccttgctttaccttaaatgagttacatgagtgtcgagttttatgatgccacttgatgtatctgaattcctgtagcacacactcataggtatgattttttaaattaaagaattcagaataaacattttttgatccacttg

SEQ ID NO: 604946 - DNA, 171 bp, Homo sapiens
acctctcagcagaatcgtcatgttttctgatgcaccgggctgcttcatgcccaagatgacttgcgaggggttctcaggagctgtggacttaagccatggcaaagcccgactgtctttctcagcgtactcctgccaagtcagtaggtgttagtatggttcgcataagttcac

SEQ ID NO: 604947 - DNA, 126 bp, Homo sapiens
ctgaagcacagttggagctgtacctttgtgcccttttagccatgactggatgaagctgggacacaggacaccaagtccctagagcttgcacactagcatgtagggccctggaacctgtgccacagg

SEQ ID NO: 604948 - DNA, 530 bp, Homo sapiens
gagcggggtgcatcggggcggggccggcgatggcggtggcccgggttgtagccgccgcgctgccgcgaccccgccgcgacacctcagaagcaggaaccgaagtcgtcgccgacgccgacactgcctgggtacttcggtcggggcccgcagccatggaggatttcatctgtgatctcgtgacgacaagcggctctgagagctccgaggggcagccacgaccgtggccggtcgctggagagacgacgcagagccctgtaagactgaaactccggcgcgcatgacccgacgtgacaccgagacaggagatatatagcatgtgtcaacatcatggctcggacgttgccaggtccgcacacacagcttcctgagacatcaacttgacatccatcatgcactaccacgtgagttacacatgtttgaatatctacactgcactccagcattaccaagcagataagactagggcatatacaagtgctagagacaaggaagcatggcacaccaagaaatactgatatctggtgacggac

SEQ ID NO: 604949 - DNA, 410 bp, Homo sapiens
gagagagagagagagagagagagagagagagagagagagagagagagagagagagagagagagagagagagctatagagaggtctctcctagcgcacgccttgccgtcgtcccgtacaaatgcttcggttacccacagtctttcgccagatgagaccggtgttcatggtactggctcctcatcttactcttccttatgccaccgatgtctttggtgcatatgccctagccttaatgcttcattgtgtctaccttttacccgctgctgtggccgttactttggggccatacggaataacagtgattattgcgcctatttgccgaagtcctccctgctcatacgatgctgctactgtcttatagtccattgactctttcgatcttcatcttcctttgagctctcttgttctc

SEQ ID NO: 604950 - DNA, 875 bp, Homo sapiens
gactgatatgatctactagcgtaaacaactgatactaattcattctaccattccaggcataacgtcatacctaactctaaatgtgctgtgccgacaactcacagaagcgaggtaataaacagcacgaggtatcgaagtatggaaatcgcttgaagactgagaaagaaatctatgacgagataggtcatatgagtaaggggagataaaagaatgttcaacgtatattagtggtgaataaattgattgttagtattgagctatctacgtttatactataaagtagtgggctagaaaagtgtgctgcatgcttttatggatgagatgtgactattgaacgtaggattatgagtcatgcaattatagatgggggagacccttagtgattccaatgaaaattgatgagttgttgggacatgtccaacggataatcccacattggaggggctaagaaataagcaccatgcaggtggtgccccaaaggatagacctgtggtggtggcagggacaggtggcactactaggatgtgacagatcttgaagtagactgtggagagatagaatggaagagttcggaagatgaccgagtgaggaaggatggtggagaaggtactttggtgtctagtactgtataagcgggtttgtcacatggcaggtggttgcaacgttccgaaagttgataaagtaaaatttgtgtgatagaggatgatgacggaagaattgagtggaagagggcggtgactgaaagacgactgatgaagaggattagaagattgaagaattgaaaaagagggacatcgaaacggatggaatactccaaaaaaatagtaaccttccaaaatatcacattgggtcttacggaaggaactctgaaaacg

SEQ ID NO: 604951 - DNA, 107 bp, Homo sapiens
ttaccgcgctgagggggaagcatggttatcgcggaggtcacgcgaccaaagacgggcaaggtgacggtccgcattccttacacaggccacagctgggagggtgtcat

SEQ ID NO: 604952 - DNA, 321 bp, Homo sapiens
  misc_feature (310)..(310): n is a, c, g, or t
tgatctcctagtaaataattgaagagtttgaggtagttccccagtggaaaggtttctagaatagagatttgtctgaaaatgttcagaagagctgttcagtattctactcagttgattttatggagggagtcataggactctcagtgttggagtaactagttgtgttgtagcctgtcatggctttgggagtgatttgttctttgctgggatgactagataaatcagtaaagacagaattcagggaaaaggggtgaggagatgggaatggggggagggagactccaggattttaaaggaatgcccctgtgcntaggcccaccg

SEQ ID NO: 604953 - DNA, 393 bp, Homo sapiens
tcaattgctatcatttattttgtactacagcgataggcttcaaactatttatacgataataccaatcctaatttcgattatttatcttgctccaacgtgtttcaattcattattgtttctgtaatacggaatgaattctcttgtcttgacaaaccaagcatggaaatttccccataagagacaagaagacgttcacatgattttccatcttcgatctcatagtctgtctctgtgagagaactttgagttcttaggaaaggcatctgttacctccaaaggagggccactcattacagttttgtgtaatattacagtaaggtctgccaagaaggaattcaaggaaattgggaatgacgacactgtgatcccaggccactctcttgagcagaggtt

SEQ ID NO: 604954 - DNA, 135 bp, Homo sapiens
gacactaccggatatattaagtataaacatctattatacttttgtaactctacagtccataggggaaaatgtaaaatgttactgtttgaggtgtggggcactttcatttccttgggtactacgctttggcagcgt

SEQ ID NO: 604955 - DNA, 312 bp, Homo sapiens
tcggcccggggttgatgttgggagacttttttccttgaaaagcaattgattttgcctttgttaaagggctttgctggctccccatgtactacccagtgtcccgcatgggggttaggctaaattttttgtaattgggcttaggtgatttgtaacccgggtatagggtttttaaaaagtaggccccctttttgccccctgtgtttttttttttatttagtttttgtataccccaaataatttttgaactttgtcttccccctgtaaaacttttgttcttttctccttatggtaataaaaagcttttttacccca

SEQ ID NO: 604956 - DNA, 158 bp, Homo sapiens
gttgggtccctgagtgcttcctcgtgagcattgggtgccagtggttgcccaggcttccgtgagtggcccaccttgggtgggaggctgcaccgctggcatgatcatgccctcggtgcccacacaggtctctgagcggcccctgatgttcctgttggaca

SEQ ID NO: 604957 - DNA, 192 bp, Homo sapiens
  misc_feature (9)..(9): n is a, c, g, or t
tccccaggntcttttcccctcaaagcactgcttaagctgcatcccataagtttgatatatagtatcattttcattatgtctcaaaatatttcctatttttttttttggggggaaatccccttttgcccccagggttgtggggtaaccggggcccctggaacctttggcctgggggttcaagccatttccctg

SEQ ID NO: 604958 - DNA, 409 bp, Homo sapiens
gttcacacgattgtaatgaagtagaggcgctggacgccctgtggggcaagatctcaaggacgcctgcatcatcggcagcgtcgctacccagcatatctacggcttgctgtttcgcgtgttgtggccgcgtgtgtgcctggccgcaccatttgtacgcaacgcaacgtggcgttccccgtaagacatgcagcgacgccagcgcgtgagcaccctgcaatttgcctggtgtggcccagcccggcgctgctcaatgcgcatgggcgacaacctcgacgtggcctgtcgttgtacacaggttgcacgtggtattttcctccgtatggcgacgttgcacggttgaatgcggccggcagccatatacgaccagtattacagcaaatggccgaccgacaatccatcaggcagctcg

SEQ ID NO: 604959 - DNA, 137 bp, Homo sapiens
ggagctcggccctcattagcggagctcagtaagcggtcagtaagcgggctagtaaggcggcgcggtcacgcctgctgggggtatgttgtgttgtgtgtgcatgtgtgtgctgtgtctttgtgtgtgtgtgctccgct

SEQ ID NO: 604960 - DNA, 332 bp, Homo sapiens
gagtataataaaagatgtcttaaacccaagaatcgctaactataaagaatatataggctgggcatagtagttcacgcctgtaatcccagcactctgagagaccgaggcgggcagatcatctgaggtcgggagttcgagaccagcctgaccaatatggagaaaccccgtctctactaaaaatacaaaattagccgggcatggtggcacttgccttaatcccagctactcaggaggctgagggaggagaatcgtttaaacctgggaggtggaggttgcggtggaccgagattgtgccattgccattccagcctgggcaacaaaaaggcaaactc

SEQ ID NO: 604961 - DNA, 404 bp, Homo sapiens
  misc_feature (3)..(3): n is a, c, g, or t
  misc_feature (7)..(7): n is a, c, g, or t
  misc_feature (25)..(25): n is a, c, g, or t
  misc_feature (76)..(76): n is a, c, g, or t
  misc_feature (192)..(192): n is a, c, g, or t
  misc_feature (214)..(214): n is a, c, g, or t
  misc_feature (315)..(315): n is a, c, g, or t
  misc_feature (334)..(334): n is a, c, g, or t
  misc_feature (353)..(353): n is a, c, g, or t
  misc_feature (379)..(379): n is a, c, g, or t
  misc_feature (389)..(389): n is a, c, g, or t
gtngttngcgggacaggcttcattnggacagccctaacccagctgctgaatgccagaggtaccgaagtgaccgttngtctcccgaaagcccgggcccggccggattcacgtgggatgagctcgctgcgtcggggctgccgagctgcgatgccgccgtcaacctgggccggagagaacatcctcaaccctctncgaagatgggaatgaaaccttncaaaaagagcctctaagtttagccctgcaaccagagttcctccagggaagggaacgctttcagggtcatgggagaagttcaagggggaaaatatccaaatnggcttttgtcttccaaatngggggagatccttaagggnccaggagtaagctttacttacccagncccagttttnactttcgggagttat

SEQ ID NO: 604962 - DNA, 486 bp, Homo sapiens
  misc_feature (110)..(110): n is a, c, g, or t
ggtcgtcgtgttgactctgggtggactgccattatcagaagcttgaaccgtgagcgtgtaacctgaaatcgtttctcggtcgagaagtttggtcactttgacttctcccntgacggggtcaattgtgaacgagcttccttggttgccatctataattgagtagtggatgtggctgttggaaggtccatcggcatcatcggccataaccgtgatgacagactgctcaagaacggcatcttcactgatgactgtcgtgtaggtgtcttggctgaacacaggggtattatcgttgatatctgttacattaacgttcacagtggcaacgtcgctcagtgaaggcgtgcctccatcagtggccatctactgttaggtaatactcatgagagctctcataatccagattctcaatgataaatacggccctgaatagaaatcaaaattacttccagcattctgcaatgccaccacattttcccaagctcgtca

SEQ ID NO: 604963 - DNA, 114 bp, Homo sapiens
gccacaaggtacagagtacctacgcgagagccttactgagagcggatgggagacgtcacccccgagggcacctatatcagcccctttaaggtacaggcatggggggccgttcgt

SEQ ID NO: 604964 - DNA, 940 bp, Homo sapiens
  misc_feature (1)..(1): n is a, c, g, or t
  misc_feature (3)..(3): n is a, c, g, or t
ncncgtacatgaaaaaagttgagaagagcgagaggagcgagacgcagtgtcacgtaggtaccaggccaccgtggcgggcccgccgtgtgacgcaacggagaagcacccctggcgtcggcacacatgccactggtgtacccgcacctctgggaagccccctgtcggccaaaaagtgtagcccgggtgaaaaacgggccgcagtatctaccaacgggggctaatccaaaatcggccccggggcgacggccagaatccaccacgttgggaagccagaggggcaaacctatggcaggggagacaccctctctcgggaacaatggtgaaagccactgcgtcggaaaatataacattaccaggcagggggccacaataaaatccagggtggccaacatctccaagcagggtgaggtcaaggaactcgcttgtaccatcgtgggtgggccagggcaccccaatgactgaaggtggtgtgcgccccgccgccccccgcccgcgggaccagagaggcggagcgtccccttgctccagaacagaatataaagacatgaaacagaccgaggaaatatgaaatactcagatgtatccgagaacaagtgcaagagtccctgtgcccggcagatacacgggtgcgttgtccgcagaacacacctcaacaagtgaatgtttggtatcttaaaagcgtttccatcgccttcccgcgtgggtatacaccaacagtcgggccacggaatttttggtggtctgtcagacaaaacataaaaaagggtgggggattcaaacatccagcgatatgcatgttatttaacttctctgcaataaaaaatgcaaaggagtcaggttgaggctttcggcgctagttctcttcttggaggcgtggaatttatttttctctatttttttggcacaattcaaaaaaaaatccccaaaaaaaacacataac

SEQ ID NO: 604965 - DNA, 592 bp, Homo sapiens
  misc_feature (110)..(110): n is a, c, g, or t
ggtcgtcgtgttgactctgggtggactgccattatcagaagcttgaaccgtgagcgtgtaacctgaaatcgtttctcggtcgagaagtttggtcactttgacttctcccntgacggggtcaattgtgaacgagcttccttggttgccatctataattgagtagtggatgtggctgttggaaggtccatcggcatcatcggccataaccgtgatgacagactgctcaagaacggcatcttcactgatgactgtcgtgtaggtgtcttggctgaacacaggggtattatcgttgatatctgttacattaacgttcacagtggcaacgtcgctcagtgaaggcgtgcctccatcagtggccatctactgttaggtaatactcatgagagctctcataatccagattctcaatgataaatacggcccctgttttagaatctatgctgaattttccatgttcatttccccctattattgagtaggtgatttctgcatttgcttcaatatcccgacctgctgcatacccctgaagaacttcagttcccaccagaatgtcctcaaacacggtggcaccatattcgcgtgtactcatata

SEQ ID NO: 604966 - DNA, 285 bp, Homo sapiens
cttaaaccccaaagggtttttaaaaaaagagacccccttttcccccgggggtcaatattaacaaggaatttccttaaattttgtttaagggttgaaaggggggccgcatttgcccattgcattaagttattatgaggcgaattgttgttaaaaattaaagcaaaaaaaaatgtaaattgggttaaacccctttccctttttgaagtgtttttttaagggtttttatccctaaaatgaaaaaaggccccctatttttttgatgtaaacacattaaattcaaagaga

SEQ ID NO: 604967 - DNA, 377 bp, Homo sapiens
tgaggctggagactgtggggcagatggggctggctgcctccctgcctcctgggtggcctggctggggtagctgagtcctcagctgggtagtcttggtggacatgctcgcgggaggagatgaccttgccatcctggacctcttccagaacggtactgcacctgatgggtggtcaccgtgttctttcttgtactgacgtcaggtgggcgtcctctccctccagcagtgctgtgtggtcggttgtgaatctcctgctccagcctgcgtcttcacatccctgcagtgatatcgtataccatggtacctgcagcatccatctctgcagcgaagctgttccagagtgctccatccacgcatgacaatcagcccatgaatctgt

SEQ ID NO: 604968 - DNA, 200 bp, Homo sapiens
aacctgctcccgatttctggggaagggtgaggcatcgaggcatcctggctgcacctggaggcttgtgtcatagctcattcccgcggtttttagacaaacacactggtggatgtgtgtgcatatgcaggctctgggaatgtgctgaaggtgcagcagctgctccacatttgtagcgaacactttggctccaaagagaagga

SEQ ID NO: 604969 - DNA, 228 bp, Homo sapiens
gaatctcctatctcacttggtagtggaagttgtaggatactgtcctctaggaaatgtgccatctagagtgtgcagctctccgccagctgatcacaccaagagacgaagatgatgaggcccaggcgccagagtcactgctgacacatgaaaccttcagggtctagcattgtgggacatccctagtgtgttccagcccctgaatgtttgtgctctagagagccctcaatg

SEQ ID NO: 604970 - DNA, 612 bp, Homo sapiens
ggtctcgatctcctgaccttgtgatccgcccgcctcggcctcccagaaggctgggattacaggcgtgagccaccgcgcctggcccacacccatctaatttcttttcttttctatatatatttttttttttttgaaacggagcctcgctctgtcgcccaggctggagtgcagtggccaatctcagctgggattacaggcttgtgccaaagcccggttagttggtatttagtagagatggggtttcaccatgttggccaggctggtctcgaactcctcaccttgtaatcctagcaccttggcctcccaaggtgctgggattacaggcatgagccaccgcgcccggccacacccatctaatttcttaatttttggtagagacctggtctccctatgttgtccacggtactctagaactcctgggttcaaacagtccttctgccttggcctcccaacgtgctgaaattacaggcttgagccaccatgactggctatctagtttttcatgggaaaacaaatatttctgaaattttaactttttgggctatggtgtaaggctgtaatttctggttaaataaatggcatatctattcctgggaaaacacaaaacaaaac

SEQ ID NO: 604971 - DNA, 136 bp, Homo sapiens
agtgaaactgggcatacggaggaatactgtggggcgtactggaggaaattgatggcatatggattgaaactgtgtaggcatatgtgaggaaactgctgtggtgtacaggagtcaatactgttgtaggctatactgt

SEQ ID NO: 604972 - DNA, 258 bp, Homo sapiens
tttccggggtttttttgccccccggggcccccttttcccttccccaggggggggggcccggggccttttttttttgggggccggttggggggggccgtggggtcccccccggggtttttatttccctggccccgggggggggttttgggggggggggccccccccccccccctttcccggggcccgggggtccttttttgggccccccccccccccccctggccccttaaaaaaaatggggggtttttttttttttta

SEQ ID NO: 604973 - DNA, 410 bp, Homo sapiens
  misc_feature (9)..(9): n is a, c, g, or t
  misc_feature (76)..(76): n is a, c, g, or t
  misc_feature (128)..(128): n is a, c, g, or t
  misc_feature (398)..(398): n is a, c, g, or t
  misc_feature (400)..(400): n is a, c, g, or t
aggggggangttcctaatctctgaaagggggaattgagggtaggaggtgggacttaaactctggaaagtggggctnagggcacctcaagccaaaactgagcacctaggctaaaaataggtccccaggnaagatgctagttcccaatgggaaacaccgacctgtgtcaaagtcaagttcacccatggctctggcagcaccccagaagttacccaccctcacccctggaaatgtctgcataaactgccccttcatttgcatataattaaaagtggatacaaataccactgcagaactgcctctgagctgctactgtgggcgcacagcctgtagggcagccctgctttgcaaggagagcgcctctgctgctgctgtgcacagccggccgcttcaataaacnantgctaacacc

SEQ ID NO: 604974 - DNA, 188 bp, Homo sapiens
acgtatcggagtcgtcacacagagaatgaaagacttgctccagtatttctccaaaggcagaaatcaagaagttctttgaaaccaatgagaacagagagacaatgtaccagaatctctgggacacagctaaagcagtgttaagagggaagtttatagcactaatatgcccacattcgaatctcccaccc

SEQ ID NO: 604975 - DNA, 176 bp, Homo sapiens
cccggcccccaaggggttgggttcccgtctttttgggttccccccccagatttacccccttttgccttaattttgggggggccccgggggggggggggggggaaaaaattttggggtttcccgggccgggttttttttttacccataaaaggttgtcttttattaatttggggtta

SEQ ID NO: 604976 - DNA, 216 bp, Homo sapiens
tcccggtcgctggaccgtatgtgacaccagaggaggaaaggcaacgctctggagccagctccctcaggccctccaggagtcactaaacaactcttcccctggggatttcgcggacgttgtcacgatggaccctgaagatgctacagaggaaatcagtggatttctatgagctaggagaatacgagtctggagactgagaggcgtcacttcggcctc

SEQ ID NO: 604977 - DNA, 120 bp, Homo sapiens
  misc_feature (116)..(117): n is a, c, g, or t
acaattaaacacaacctctgcccagtttcaaccctctctgtttccctaagaaacacggcgccttttgcttaccatgaaacactatccattaaataattataatctcggcgccttgnnttc

SEQ ID NO: 604978 - DNA, 223 bp, Homo sapiens
acaggaagcccctgctccgcccctatctgctgttcgcccttttatgtttcccaaagtgctgaaattaacgtcatgagccagggcgcttctgctgccagggttacttgaagaggagatattgcctctcgacagctgctccctatctggtgcagccatagacacatccagaaaactgaagtgctgagaaggaagtggcttgcttaggcacctgccccatgtctgc

SEQ ID NO: 604979 - DNA, 280 bp, Homo sapiens
atacgcctgccggattgatgatgcctaaccgggtaacgccggctgaatcttgacagaaactgatgtctataacggacagagtcaacggacaccgaggccgggacggacgggtgataatattgacttctagagggattgcagctcggactgcctatattagtcaccctaattccgctccagcagaatcctttaacaccgagttagactggctaacaggggttgctcaagcgagagtcttcgctctcaatcttaccaaggcgttttgttggctcccaacggc

SEQ ID NO: 604980 - DNA, 177 bp, Homo sapiens
atccccccggttagggggtgatcataaaacactctttacgccgttttctattgcacttggtttaatcgtgtgaccgcgggggctgacacgaaattgaccaaccttggggttagaatagctaagttaaactttcgtttattgctaaaggttaatcactgctgttacccggggaggggg

SEQ ID NO: 604981 - DNA, 224 bp, Homo sapiens
ggaccacgcttggtaggaagcattatcatctccagcgtctaaaggggctgggaagggttattagaacgcagaaagatgtgtaattatagatggctgggagagagggccattattgaatacaagtgtgaactactcacaggaacatgcttcggccacactaaatccagcaagagggaagtagcttttagggagatcctttctgatgtccctcccactgaccaaag

SEQ ID NO: 604982 - DNA, 242 bp, Homo sapiens
gagatccccactcagggcagcgcgataactggagattattttcgaatccagtatttcgcactccaggggatgctcatttctattgtattttcagccccactgctgttgtcaatgccatcatcattgtggttatgtgggtctggaagactttgaatgttatgactgacctgaagattgcactagagagaagataggaatataacaggagaaggctcgaagactgaggggcagctcgccgagtt

SEQ ID NO: 604983 - DNA, 112 bp, Homo sapiens
cgaccgagagagtcatggcctttggggtacaccctcgtagtgaaccagcagagcctgctggcccctcatctccagcctctgtcactgtcactgttggtgatgagggggctga

SEQ ID NO: 604984 - DNA, 1253 bp, Homo sapiens
gcccgactccaccactttccaccatcagctgccaaactggtccctctgtctccctggtggccttgtggttcatgtttgtgggagtcatgaccattcctagatttcctgacagcagtggaatacagtgggagagaggttgtccttccaccccagcaaatgcaataatgccctcacccctccatgagaggagccaccctcccatgtgtgagcctgttacctccgcatttgacacgatgtctgctgtgaaccccgcaagctccatccccaactcccatctctccttccaggcccatcccatggcccagagcaggagggagggagggacgatggcgtgtgcggtacaatgtatctcgcatcttgcttgtcttgaacataaacgcaatctatctgctgttcaacccacaacacaccaccatccaccacacactcccacagcgcacaaatatcaccaatagtcaccgcaaacaacagcagacagagacggacaaactgggagccgtgccaacaccgaggaacaacgggcacccacgcataatcggagacacaaagagaagacgaccaggacgggaactacagcaatatgaggacacacagacacacaaccacatcacccgacggcaaaacccgcgacagcacacgtgaagcacgggacaaagaaccccgaaaccaacccacccacaccgccgtcgacgccgccagagacggcggcagcgaacagaacgcgaccccatcgacaccaaaagaaaccacagaacggcgcgacaccccggcaggggcgaaggcgatggcacgcgtggagagaggtcggacgggggcgtgggcacgccgggggggacgggccgcggggacggcgagagagcgagacagacagacatgggggcgggcgcacggagaggaacggcacagaagcgcgagcgagggacggcggacagaggcgagggacgacgagcgggcagtggggcgagggatcacggacaagggcgtgaggcgggagaggcgaaggggggaggcgaaggcgcgagcgggaggggcagacggcgggacggggcagaggaggacagagaggcagagaaggggggaggacggagacggcaagcgacagggcgcacagcgaaggcgcacggaaggaggggaggcggagcggaggaggaacggacggggggggcagagcgaagacggacgacgcgcggggagggggcccgagagaacagccaagcacagcagggagccgaaggaggagaggcacggagaga

SEQ ID NO: 604985 - DNA, 1091 bp, Homo sapiens
agcgggtcttccacaacctccgcggtctggagctggcctcccgcacgacgccccaaccaccggccccgccgccatcaccacaccgtcacctccgccgcatgcactccattgagggccctcctccattcaccgacacccttagacaccatctacacattctaggcatttctgtcactggagaagaagctataatcggtttccattgtgggcccggtgcagcagcacatggcggacggtggcggcggcggcacgcggcggtgcagggcacacggacatcgaaccacgggaccaggcagggggcaggcggcacccaatcaaccacggaccatcgattgcacccactggcgacccatcagccatcaatcgccataatcatcagatggaggcagcgtcacagacgcacggggccattatattctgagcaagcctatccgaccgggcactgcacaggcatgaccaggtgagacacccaagcacagacgttgccaacacacgcatgacgccacgaacagcccgactacactgtagatgatagaacaccatcctggaacaaaagccagcgcacatggcacctccatcacaagcccaaccgaacacaccccacactgcaaccgacactggtctgcagcgccagacgcctggctggggcccaggaccaggggcacgcgtccaagcaaacgccttggcacgatagcgcaccacggcacctgtcacggatgaccctccacgccgcatgtggtggggcagatcacacacgaaccatcacaaacaccccaaccaactccgttgtccaagacgacacaccccacacacataccggaacaaaccaaacaaaaggacaaaacgcagccacattcggacacaccctttcacccagttgaggatggaggacccccgaccgacacacaccgcgacaagcgtccaagccgcatgggccgccccaccggccacgcggccccgccgtaccgcagagaccaggaccaccgaaacgtatgggcccaaagggcgaacacacaccgctcccaacagccatatcccacgaacaatccgacgcggcacccaaccaactcccccgtcaaacagcaacctta

SEQ ID NO: 604986 - DNA, 341 bp, Homo sapiens
gtttgggttacagaatggtatcaggagccaaagatcctgagttgcacgggtctactgcgtccaggccctcgaagagctgggaagcatttgtgcacagcccctcatgacagtcgcccttacacacggtttcagtttcctcgtggtgcgatggcacagtcgcataaagtactaagtggtaactttcatgtacatattaaaccatttcatgatggtcttgattgtctgtgctttcctgaggcaggcgtcctgtctgtgacactcaaactctccctcgctccatcgttacgggccagtccacgccatcctgactgccaggccctcagcatccatctccgtgatca

SEQ ID NO: 604987 - DNA, 981 bp, Homo sapiens
  misc_feature (1)..(1): n is a, c, g, or t
  misc_feature (139)..(139): n is a, c, g, or t
  misc_feature (185)..(185): n is a, c, g, or t
  misc_feature (206)..(206): n is a, c, g, or t
  misc_feature (210)..(210): n is a, c, g, or t
  misc_feature (248)..(248): n is a, c, g, or t
  misc_feature (290)..(290): n is a, c, g, or t
  misc_feature (342)..(342): n is a, c, g, or t
  misc_feature (465)..(465): n is a, c, g, or t
  misc_feature (578)..(578): n is a, c, g, or t
  misc_feature (601)..(601): n is a, c, g, or t
  misc_feature (612)..(612): n is a, c, g, or t
  misc_feature (631)..(633): n is a, c, g, or t
  misc_feature (635)..(635): n is a, c, g, or t
  misc_feature (659)..(659): n is a, c, g, or t
  misc_feature (675)..(675): n is a, c, g, or t
  misc_feature (678)..(678): n is a, c, g, or t
  misc_feature (694)..(694): n is a, c, g, or t
  misc_feature (703)..(703): n is a, c, g, or t
  misc_feature (707)..(707): n is a, c, g, or t
  misc_feature (734)..(734): n is a, c, g, or t
  misc_feature (816)..(816): n is a, c, g, or t
  misc_feature (864)..(864): n is a, c, g, or t
  misc_feature (885)..(885): n is a, c, g, or t
  misc_feature (904)..(904): n is a, c, g, or t
  misc_feature (942)..(942): n is a, c, g, or t
ngtctctccaggtcccagcgccctgccacccccaccccagcgccagggagaagagggcggatgcagaggagcgggcagaggctgggcagggcctgagtgggccaggctaggccaagagagagggcacgaggccctgggngccccagtgccagggcagaggccaggcctgcctggagaaggcagcncgggggcagcgctcaggggtnaggntgggtgccacgccgccgcagccctgcccaaaagagggnggggcctcaaaggggtagccccaagaactgtactctggaggnagaatcaaggggctgggagtgggcactggccccccggagccctctgcaaagnaggggacagtggcacctgtggaaatgcacaagggagggtgcagcgggtgtgagggagggctgccatcctgagggcagggctccggcgcaccagggacagaactaaagggggccagcgggggcngccgcggcgaatggctctggggggagaggaagaaggggtccaagaagtgggggccgccagccgcagcctcagcctcagcctcctcctggggtggtgcggaaggcaccaccagngggtggggccccaggaggcagcnccaggcctggncgggggctcactggggcannncncacagcaatattgccaatgaagancgggagggttaaagtngcntccggcgccttcaganagaactgtnagtngtagttgatgtggatgaggctgcagcncggcaggccgactggggcaaggcagggaccaggatctgctcgtgccaattcgcccgccgccaggctttgacgcccgcccccnccacctccgcaatggtccgtacgttgtggattcagcgcttggccttanaggacaatttctgcagcagantggccaccacagggctggngttcttgcctgaatggttctcaacgtcggcatgcagcngcagttcctgccccaccacaaagccgcggagatcagtgc

SEQ ID NO: 604988 - DNA, 270 bp, Homo sapiens
aggggccagtgggcataggagctggtagtttaagttagccccacatattttaaaagggtatcaccctatcaaaggggtctgggcccaatcatttctttatgggaattgggtcctataaaaatgggttctaccatagctgaacaaataataggtgggtgggctaaaggctcgggatcaaagagggatgaaaagatcgcctaggatggggttccggtccagtactgggttaagacattccataggggtggcgggggaccctcaaaagtcgac

SEQ ID NO: 604989 - DNA, 1782 bp, Homo sapiens
gattgggtatgttagcttgttggcctaggttgaggggctgggagagtgtttattatcaatgatcgctgtcactatgtgtatgaatcactgtgatttttttttcattccccgttttcctgaaaaaaagatttgtttttcctccacattctctaacgcactcaagggcatgtgcctaggagaacgtggtagcattctggtctttccgctttcagaactgctggtcatcttcgtcttttcttcatgtattgattattatatgattattattattattactattgttttttaaaactgtcaggatgaattgtcagacatatggccatgtgttttgtcctctgcttctcccctgtgggaagttgtctccatgctgtgaactggctgtggggtgtgcagctgacgtcagtccctctgagcagtttccccactgtgtcttgtcccatcatgcgctggatctgctcattctcctgctgtgaggggtatgcccacctccttacccccttgacagcatagggcatgctgtgtgctgggcctcaccaggcactgtctattgtgtgactcatggcatcctcgtttcatccccaccgtgcctagcaggccttcctttttcaccacctcggaacagcttgccttttcctccctcacaacaaggactgctgtgcctcagtcctttaactaacttgcactctgccactgtcccagtggtactatctctaaagtggccttgtgcaccattgtagtcttattcctctggatcaattattcccattcctccattcaagcgtaatattcttccattcatcagttcctggacacctgtttacccggagacatggatcggatatatcgcagcatgcaggggatctcaggacgaaaccgccgtggagaaggatacattccacaagtgaatattgtttcctggatcttctactggatattaccaaacgacgacacaacaaaaaagagagcacagcaacaggtggctacggaaaacatagaatgaagctagccacacatacgacacatatagagcatcaaaaaagaacacaaacaagaaacagaagaagaagcagacaagcactacaaaggagataaggagaaagagaaagagaagagcactagacaaatagaatgacaaagagagagaagagaaggagagagagaagagcgaagaaaacacgaggaccacacgcaaacaaggagaagcaacgaacaaagcaagcggaggaaaaaggaaaaaaagagaacaagaagaacgagaaagaagacaaacaacaaccaaagagaagagacaaagacaaaagagagaaaagcgaagcaaagaaaaagcgagaaagaagagagaagcaaggagagcaagaagagcggagaacagacagcgcaggagataacggaggaaggacaaaaccaggcagagcgcggtacgggagaagcagggagacagagacgcgacggagagagccgcgaggagaggaggagacgccagggaagagcaagcggagagaacgaaggaagacagaggggcagaggcgcagcccgcgggaggccggggcagaggcagggtggggacgagaacggagagtaaggagagtgcagaggcgcacgaacacgagagcgggcaagcaagagccgcgacgcgctgaagcgagcacagaagacaaccagcaagcaagcagacggagaggaccaggaggcgaggcacgagggcgagaggcgaacagagagagcagccccaacgagagcgccgagcacagcacagaacagcacaggcaccacgacgggcgg

SEQ ID NO: 604990 - DNA, 148 bp, Homo sapiens
caatcaagtactataccaattggtgctattgatgtttatcataattgaatctgtgtctccataaataacttcaagattcatctttatgtaccatctcatttcgtatgcatcaaagatctcccttccgtttgtacagtcacctgaggac

SEQ ID NO: 604991 - DNA, 117 bp, Homo sapiens
tcctgacaggtagtcatccctccagcagagattagtctacttcttccctgcgtgatgtgtcgtcgtctccttcacagggtgtgaattcctccggtaaccgcaggcactggtatcatc

SEQ ID NO: 604992 - DNA, 338 bp, Homo sapiens
gcaaaggggaagcaaggcaggccttacatgggagcagaagagagagagagagaggggaagagccacacttttaaaccatcacatctcatgataattcaatcacaatcacaaaaacagcatggggaaaacgcctctgttatccagtaacctcctatcagtcctgacactagagctgagttaaccacagccaccagaagttggggacagggactatgttggctaaataactcatttgtgctcttttgcgtttttttgatggtgttgtatataaaattattttttttgttcatggtttttgagaggaattttgaagagattaaaaacttcactatcatgat

SEQ ID NO: 604993 - DNA, 579 bp, Homo sapiens
  misc_feature (32)..(32): n is a, c, g, or t
  misc_feature (56)..(56): n is a, c, g, or t
  misc_feature (142)..(142): n is a, c, g, or t
  misc_feature (144)..(144): n is a, c, g, or t
  misc_feature (157)..(157): n is a, c, g, or t
  misc_feature (165)..(165): n is a, c, g, or t
  misc_feature (174)..(174): n is a, c, g, or t
  misc_feature (184)..(184): n is a, c, g, or t
  misc_feature (187)..(187): n is a, c, g, or t
  misc_feature (278)..(278): n is a, c, g, or t
  misc_feature (347)..(347): n is a, c, g, or t
  misc_feature (381)..(381): n is a, c, g, or t
  misc_feature (434)..(434): n is a, c, g, or t
  misc_feature (457)..(457): n is a, c, g, or t
  misc_feature (479)..(479): n is a, c, g, or t
  misc_feature (501)..(501): n is a, c, g, or t
  misc_feature (504)..(504): n is a, c, g, or t
gagcaaaatgacattaaaatcatattggctcntcctatccatgagcatggaacgtnctccattgttggtgtatctctgatttctttgagcagagttttatagttctcattatagagatcccccacctccctggttagctgtntncccaggtattttnttcttttngtggccatngtgaatgggngtncattcatgatttggctgttggcttgcctgtaggtgtataggaatgctggcaattttcgtacatcgattttgtatcctgggactgtgctgangttggttatctgcttaagaagcttttgcatagcccatactttttaccttactgcattcttatgaaaatnattcactgagtctcaagaacgtattcattctttntttccagttcacacttgtaacactctaggaagtcacaaattctcaaatgaatngttccaattggttgctcattatncatgggctctgttagaatgtanctgtgctcctccttagagggcnaanagtggattagtagtggctaatgataagaggagtttacttcctctagtgaaggaatttgattgtgtgtaaattaac

SEQ ID NO: 604994 - DNA, 675 bp, Homo sapiens
ttgagcggggatgtagaggcggctggcagcatgatggcggcactggcggcaagagcagacgcccgagcctgagctgatgaagagctggcaggatgccttatcccactgaagccgtggccccgctgtccagccctgcccatgccctgctgcccgatgccatgctgctgcctgccgtgctgatgtcctggtgctgcctgcacggctgatgcccttcctgcctcgctgatgcctgcggctcaggctcgcgggtgtgacttacgttggcttattttgtacgtatcttactcaagtatttgggcggccagccggggggcagggcgcgcgcagagtatgcgtgcgccaagggccttgggtctgcaagctgccttaccgcgacccccacatacgcgcagcggcccaccacggcgccaccacagaacaactcataccaatgatctgacctagacacatcccctcacgacccaccccggttccaccacacgcggacggcagaggacgggaggctcgcgccgcggccatcttgcaacgggcatgacgccgcgtagcgcgcgataacgccagcagcggggcggctgctctgcaccgtgcgcgcggcactgcgctcgctcagcgcaaagccgcgcaaccgctccgacggccgggggagcaggcgacgcgcctgccgactacgactcg

SEQ ID NO: 604995 - DNA, 327 bp, Homo sapiens
  misc_feature (35)..(35): n is a, c, g, or t
  misc_feature (85)..(85): n is a, c, g, or t
  misc_feature (195)..(195): n is a, c, g, or t
  misc_feature (210)..(210): n is a, c, g, or t
  misc_feature (275)..(275): n is a, c, g, or t
  misc_feature (294)..(294): n is a, c, g, or t
  misc_feature (306)..(306): n is a, c, g, or t
aaccatacactactcttttttgataataaaaaatntatttactgagccagttgtggtggctcacgcctataatcccagcaccttngaaggccaatgagagtggatcagttgaggccaggagtttgagaccagcctggccaacatggtgaaatgccgtctctactaagaatacaaaaatgagccgggcacggtggncacgcacctgtaatnccagggtactccgaaggatgagggcaggataattgtttgaactcaggaggttggaggttgcagtnagccaaaatcatgccactncactccagcctnggggtgacagagtgagtctct

SEQ ID NO: 604996 - DNA, 446 bp, Homo sapiens
tcgcctttgttgaggcagctctgtggtggtggacggcagaatacaatctcctgtaagtggactttctcagttctaaaggccaactgtgactgtatgttttcctggcacatagctcctaaaacccttggaatctccaatgtgttatgtctttttgtatgctaatgaatgactgatgggagatagatgaatggggggactcctggatggtctcaggatggaggctggtaccaggggaacctactccctgacctcaggagaggagatgggctgaaggttgatctgatcaccaatgaccaatgatttaatcaattgtgcatacataatgatgcttccataaacacccaaaacgactaggttctgagagtttctgggctggagagcaagaatgtattcaggtgatgggagggtggcacacttcaactccatgggaacagaagctcctacaa

SEQ ID NO: 604997 - DNA, 1997 bp, Homo sapiens
cagcggcagtcgagcatccgctgctgctgaggagcagcgagcgctcaacacgcagccaccactgcggctgacactcctggcactcggcgcacacacgctcgcaccactctaactcatacctcacttactctcccctccaccacgcaactctctgctacttccctccagcaagctactcccacgcgcctcccctctcctccactaagacactctcacccacacagtaccctgcctaccacgcgcctgcgcaaccacacctccccacacagcctctctctacaccttcacaccacgcacacgcgcctgcgcctgctctccacgcctctgccttggccatccagcacacctcacgcctcctgcacttacccgcgccacgcgcaacttctctgcgcacgcacctgaaccacggcctgcgcacttaacactacgcctcaacagctctgccccctgcgccccacggcccctctgcctcccacctccgcaccccgtaaccaactctgcacttacgccctcaccacactccctggaacgggcaaccattaacccgtaacccacctgcccaggcaacactcccaaccgcacgccctggcaccagccacgcaaccgacttccaagcaacctggccccttggcacttaacaaccacggcgggctctggcaccatcgcctggcttccgcctactcctaacttacccctttttcccaccctactcgggccctcctccccgctcttcccaacgtgtgtaaatccaaacgtggaggaaaacccgtttctcagtactacaccccaactattctgggccgcagtcttaaacttatgggaaacgccctatgttccctaccttggccaacaaccggccccggccttacatctggagccaggttggcaacaacgcaggccaaccggcctgggcaccaacccttaaacttgccaaactgtcccccgcccacacgcccctcctcaagctcaccggacccaccccaaaagacacggcacccacagtcaaacccaaaccccaaccccgttgcccaccccgagcgtcccccacagacgaaagcgcgggcaagaacgctgggccgccccgagaaacccccaaggggcccttcttctgacacccacccatcaacacaccgcatcgggcaaaattccagcaccgcggggaccacacaaccggccaagcacacagttccccccacagaaggacaaaaacacgcgtaccttcagcaccacgcaacgcttcctagccaccgcccagcttaagcgttaacgccggcaaccacctgtttgccccaccccccaaacgccaaacaccacccgtacgggaaccctgggcaacgtggccacaacccggcaacacaacaccaaccgcacactcaccttagcccgacgcccctccgcgcgcctcctcgccacgccccagccgcagggcacgcttgaccaacgacggagggcaaatctcccggcgctcgccgtcaaaacccccccttccccttcaaggcaccctcaaggacccgccgcgcctacacgccgggcctaaacgccccactccacctctacccccttcaaacccttccccaaccccctgccgcgcagcacggcctcctcaccaaaccctccgcgcgcccccccaccaccagccgcagccgcggagcgcctcatccgcagccgcaaccgagcagccgcaacatgcgtggcccccacgaggagccgccaacttctccccccctctgcggcggcgccgcagccaggctcgttgcggccatctgcggacccccctgtcgccaacacacccggcctcaccttgcggcagacctccagcaaaccactggcgcgccccgccgagagcaggaccccaactcttcgcgagccttcggcaaccctgccttccgccagcagcacccacgaaaatcgtcgcagcaccccataagacgagcggcagatcacgacgacacaccactaggcgtcatcgggcaaagccgccagaacgccgcaaaacc

SEQ ID NO: 604998 - DNA, 427 bp, Homo sapiens
  misc_feature (82)..(82): n is a, c, g, or t
  misc_feature (97)..(97): n is a, c, g, or t
  misc_feature (280)..(280): n is a, c, g, or t
  misc_feature (409)..(409): n is a, c, g, or t
acaaaggatggcttttactcagcaatcatgtgctgaacatctgctacattccactcttagcactagtgaaacaaacgcgtanaacaagagccccagncctcaaagctcacaatggaggtaactggtttccaggttaagtgcactaaactgtgtggaaggtgttatgatagtacctctacaggttctgatggaagcatcagtggatgggattgggctttcccattggggagaaggagggctataaaaaaaccttccctggaagggacggtggggctcattnctggatttcaccagaccagggtccaggcccctttcactttctttacttttgaactactccatctggaatccatagaaactcattaagcagctaaagtgaagtccgtagaccctggttccctacagtttncaaacaaaaccctggaat

SEQ ID NO: 604999 - DNA, 184 bp, Homo sapiens
gaggacattgcagagctcacgtgcctcacacgaagcctcggtgcttgtacaacctcaatggagcgttactactcagggctcatctacacctattcaggcctgttctgtgtggtcctcactgtgagggggcatctcgtgcctcttcttgcccttgtacttttccacaatctcttcagagtagata

SEQ ID NO: 605000 - DNA, 106 bp, Homo sapiens
tgggccgggatccccccggtttgtttttttaaaaaaggtgtccggccttcttttttggggtttttttttgggttaccggggattaaaacccttctaatttcctgga

SEQ ID NO: 605001 - DNA, 178 bp, Homo sapiens
  misc_feature (16)..(16): n is a, c, g, or t
  misc_feature (64)..(64): n is a, c, g, or t
  misc_feature (114)..(114): n is a, c, g, or t
  misc_feature (159)..(159): n is a, c, g, or t
  misc_feature (173)..(173): n is a, c, g, or t
gaattaccagggtttngcaagcgtaagtaggggatgaaagaaagctaaggtagagcttttattnggggtttcctcaggaaagggcaagggtaaactgtttagggattggctagntatgaatttccatgggactttggagcataggggatgggtctcccnttgtttgggtaccnggccc

SEQ ID NO: 605002 - DNA, 154 bp, Homo sapiens
gcagtggtcgcttctactccttggattactaaaggattccaagtaactctaattgggagagaagacgatctgcacttcgcatttcggcattacattaaatttaagggtccttaatatagaaggaatagtaggtaaacctattcaatccctaaca

SEQ ID NO: 605003 - DNA, 536 bp, Homo sapiens
agggggttctccaacgcctatgctgccccggcccagtttctgggtaaaaacaaatcgaagcccttccccggggaggggtgaaagacacttgtggggcccaccccaaacagtcccgggactgctttggacgcctttgaaagtggtgcgaccccttcttttgatgctttttgggaagctttcaatccccagccctcatccagagtttgcagccgagtagggactcctcccctgtcctctacgaaggaaaaaattgctattgtggtactcccctccgagggattccggggttttttgggggtttttccccccaaccatttcaacttttttttggattttcgttttggcaagccccccccgccctttttcccttgccagttccctggggccagttcccagctttcctgaatggattcccggccccatccctccccccccccctccctttcaatccgtttgaacccatttggccccttttttggcagaacagtcccggcccttgtaaagttttttagatcaaaaaagccaggggctttcca

SEQ ID NO: 605004 - DNA, 108 bp, Homo sapiens
cacgaggatgtcgccacaccctcggcaccagcactgctcatcctcacgatcctccacctacctgaggtgcccgactggccggcagccatcgccgccctcagggtgggc

SEQ ID NO: 605005 - DNA, 1094 bp, Homo sapiens
gccactgtctgagttccccatctgaggcgttcgttgcagctagcctgtccacttctagattcatctatcttgtgagaccctgggcttactggagtcaccatggcaactgaagagttcatgcatcccgatcctccccatagcactatatccattgttgcttggtgaacagaacagcgaaccgttgtcccgtgtggatggtcgggccaaagacctatgatccgggaggatgaatgacagggtccttgtttgcccgacatgcgcaatggtgaccgtccccgccatgatactagatggtggagatggcaagcctgtgtctctgggatggccaggggctgtaggtgcttggttatgagtggtcacagggacaaagttccggcattcgggcacagcatgacctcgatgatccggacatggcccatggaccccgttcacaccctcggtgtaccccaggtgtcaggtgctggaaacaggagcatcagaatcgccatgcatggctgagttactgagctcaactattgaccttccattctacaggcagcgtgcctctgagttcctgaggactcacgatgcgatgacagcaggtggttgccacagtgagcatcggcagtggatgttctacggaggagaccattgtggtacactttaccattcccactcgggacagggaccgtcggcaagcagtaaggtacgcaggggacatcccactgtgcaccgcagccgacaccgaatgccaactcgtagggtccacccaaagccacagaggcctcccatgcggcagagccattccacggcgaacccccacgtcgacagagggagggcagcccttcgcctataccccgggtgcaacaggccgggaaaagcgcaacgacacgaggcgatgaaccaacagagagaggaaacagacaaacatcggccgctcgggaactcctaccctaacacagtgactacagacacgaggcgcgaaacgcgaacccacccagcggctggtcaatgcaccacacgaaacgcggcagccagcatccatgtgccacctctaaggagtcggagaacagccccagcgaccaacacccgtatcacagcaaaagcaagcacag

SEQ ID NO: 605006 - DNA, 372 bp, Homo sapiens
accgagctaggtagccaaagctgcactcctggagcgccctcacagctggcgtggcttggttaatactgtagcattgatctgttggtagcctgcagccctagcccctttctcgttggttcttagagcaattgacaaccattgttgattgagatctttttgctggcatttggaggaaatgtgtttgctggcttattaatgtctatttttttcttcctctacaaggtgacagtttgaaaatcttatttattggccgggcgcagtggctcacgcctgtaatgccagcactttaggaggcaaaggtgggaggatcccttgagcccaaggagatcgataccagcctgggcaacacagatgggaaatcccatctctacc

SEQ ID NO: 605007 - DNA, 326 bp, Homo sapiens
  misc_feature (163)..(163): n is a, c, g, or t
  misc_feature (176)..(176): n is a, c, g, or t
  misc_feature (193)..(193): n is a, c, g, or t
  misc_feature (230)..(230): n is a, c, g, or t
  misc_feature (241)..(241): n is a, c, g, or t
  misc_feature (259)..(259): n is a, c, g, or t
  misc_feature (264)..(264): n is a, c, g, or t
  misc_feature (274)..(274): n is a, c, g, or t
ggggaactggggataattatatgtacacgttgttgcaagagatgggggtgcagtctggtaaaatacgccgaacgtcagcaacttgatcggatgattgcacgggcgacccgtgatttgacaagtggtcgtagtggtttaagtgccagatttatgcgtgattttngtctgatgatcanaatcggcctgacagccnagatgatggggtcaaaaggagatgtatgagtatcctngtgttcagcanatgtaaaccagcgtacanttttnaaaaaggcgnaacatgggacggttggacttgatttatttaccttttttatattggcatgcag

SEQ ID NO: 605008 - DNA, 368 bp, Homo sapiens
accggagtggcgacatttcaagaatgttggctgggtacagtggctcacccctgtaatcccagtactttgggagactgaggcaggcaggagtttgagaccagcctggccaacatggcgaaggccgtctctaccaaaaatacaaaattagcctggcatggtggtgcatgcctgtaatctcagctactggggaggctgaggcaagagaatcgcttgaacccaggaggcagaggttgaagtgagccgagatcgtgccattgcactccagcctgggcaacaagagcgaaactccgtctcaaaaacaaaaccaacaacaacaacaacaacaaaaaaatatgggtgaggtacaataaaactgtagaggaatttgg

SEQ ID NO: 605009 - DNA, 757 bp, Homo sapiens
cgtggtggctcacacctgtaatcccagcactttgggaggccgaggcgggcggatcatgaggtcaggaaattgagaccatcctggctaatatggtgaaaccccatctctactaaaaatacaaaaaattagccaggcatggtggcacgcacctgtagtcccagctacttgggaggctgaggcaggaaaattgcttgaacctgagaagcagaggttgcaatgagccgagatcgtgccattgcactccagcctaggtgacagagcgagactccatctcgggggaaaaaaaaaaaaaaggggtccgggccggcgcgggggctcatgccttgtaattcccagcatttgggaagcgcccaagggttggggcagatcacgagggtcagcttagagaccatcctggcgttaacacgggtgaaaccccggtctctactaaaattccaaaaaaatttacgccagggcgtgttggcgcggggcccctgtagtcccagtctactcaggaggctggaggtagatcaattgggttgtgaaccccggggaagcagagtggtcgccagtgacgcgggaagaactcaacggccaagtgtgttccctccaagccttaggcaacaggaagcgagaactggtgcttcttcaaaaataacaatgtgttgcgcctatccggttaaccactattttgggcttggttcaccaaatgtgctttttttcccctttggggcgaaacaaacttctttagggactaccttgggcttaaaggttccta

SEQ ID NO: 605010 - DNA, 142 bp, Homo sapiens
agaaatacaaaaggacacatcaaaggatgaatgctttacacgttttggaatgagtccaaaccctctttgataataatggggatagagccaggggcattttgaagggggtgacggtgttccatatcagaattgcagaagcaaa

SEQ ID NO: 605011 - DNA, 108 bp, Homo sapiens
ccgtgctgctgcggtcgctctcgacggctcccgcctgacgcgacttcggtctgttgtcgtcggccgactggtcctgtgccgggtccgacgctcgaccttcgtcctcct

SEQ ID NO: 605012 - DNA, 373 bp, Homo sapiens
atcattttatgagatgtattctctttccatctcaataataagcatgaaaattaacacacatttcttggtaggcatgtaagtgcctgcaggcattattatttaattcttttgtttgtttgtttgtttgttttgtttttttttgagacagagtcttgctttgtctcccaggctggagtgtggctagcgcgatctctgctcactgcaagctccgcctcccgggttcagggcattctcctgcctcagcctcccagctactcaggagactaaggcgagagaattgcttgaacccaggaggtggaagttgcagtaaaccaaggttgcgccactgcactccagcctgagtgacagagcgagactgcatctcacaaaaaaa

SEQ ID NO: 605013 - DNA, 251 bp, Homo sapiens
taagctctgtacattcggccgcgataccgtatcgatggcgcagtgcaggcggcgcatatgcatctaggctattaatattcggagtatacgtagcggctacgttacaaccggtactctagaactatagctagcatgcgcaaatttaaagcgctgatatcgatcgcgcgcagatctgtcatgatgatcattgcaattggatccatatatagggcccgggttataattacctcaggtcgacgtcccatgttcat

SEQ ID NO: 605014 - DNA, 218 bp, Homo sapiens
  misc_feature (27)..(27): n is a, c, g, or t
  misc_feature (33)..(33): n is a, c, g, or t
  misc_feature (56)..(56): n is a, c, g, or t
  misc_feature (92)..(92): n is a, c, g, or t
  misc_feature (201)..(202): n is a, c, g, or t
  misc_feature (210)..(210): n is a, c, g, or t
cccgggcggcaactgggcgtttcagtnagtccngctctcccgcaaaaaaaaccccncggcgggcgcctttcggtgtgtaaccctttttaacntagcctttcgggagcgccgggtccctcgcctggagcccgcgcctgttctccctcccttcctcctcttccaggaggcttcgccagtgaggtgcggctcagggcctcgagnnttcgagcncggccgat

SEQ ID NO: 605015 - DNA, 112 bp, Homo sapiens
tagagcatcccctagactgttgctgaagggagggccggacgtctgctgaagagagtgcgcctgcaggagcctcacacctgcacaccagggaccttcttgatcaggggtatct

SEQ ID NO: 605016 - DNA, 729 bp, Homo sapiens
  misc_feature (9)..(9): n is a, c, g, or t
  misc_feature (16)..(16): n is a, c, g, or t
  misc_feature (22)..(22): n is a, c, g, or t
gctatatcnaagaggnatattntgaggtggcatatttaggtctcctgcctagccaagatgttgctttggaggaaagaaaaaccagtttggtgaatggctagttcatctctgctcaaaaatggtactttgcctcaataaaaattagattgaaaagacacaagataaaaggactgtagcagtagtccatgctagaggtgatggtagcctaaaagtggtggaaagagagattagagaaataatataagaatgattacagagacagaattggcagacttgacgtatggatgggtgaggaagtatgatgggaaggagagagatgaccctgaggtttctggcttggatggatgatgcaatccaagagagatcagaaattacaagagtaggaacaaatttggggaaggagtagaaattggcgggagatgataaacgtggtttggggcatgttgagtttatactgttcatgggacaagtgaccatgtgagtgacaggctgggttcggagatatgaccagattagggagagggctgagtaggaagattaacatttaccaagccaaataaatatccttctttcattaaggaggaaaaggggacaaaagagatctcaaaagggagaagaaagggtactctccatagatattaagccatagactatctggagaattcgagtttctcctgtaagatttggggtacaggctgtttaattaccatgcaggacatgtggcgggaa

SEQ ID NO: 605017 - DNA, 1970 bp, Homo sapiens
  misc_feature (228)..(228): n is a, c, g, or t
  misc_feature (1482)..(1482): n is a, c, g, or t
cttacgtggtgtgtgttatccctctagctccgtgtgtgtgtcgctccagctcgttgtgttgttgttgtcccctctcgcttttgttcctgtttgggggtccctcagttgcgcttgtcgtcctcttccgctctcctcgtgaccacttgtttgtcggcctcttccgggggacagccatggcgcgcttttatatgactgttgtgtgttgtgtagccttcctggtttgtgtgngtccttccgccacctcgtgtggttacgccctaggtatagcaggtaattaggctctacaatttggtggtgtcccccagccatccccgttgcggtctttcccgttgagaagttgttgagttgtggcccccttctgaatttgggtggcacctcggtcgcgcgagtgtgtgcccggccaccacaatcctgtgggggccgcctcgatagtcgcccgccccgctacagtctcccgagagtgtcctccgttgtttgggccgcctccaatatgtattggccccctccggtgtgcctgtagttctttcgtttgctgctgtgggtggtgagagatacgccgctcgtgtccgccgatggggacccagacgctgtgttgtctgtggttgttcgcctctagtgtgtagtcttgtcgccccgatgtgggcgcgtgttgccgttgttgtggtgatggctcgccgtgcctcgccttgactcccctagaggattggtgcggtgtgtcatgcaaaatgagggtgggtaccctccctgtttcgccccccctttggggggtggtaaaatatacagccacgatgtgggcccttttgtgctgttgtcgcccctggtgttgttggtgtgcaacacccgttgcggggttttaaccacagttggggtggtgctcccccccgaggatgagattagttgctccacagtagccgcttgcgccgcccccattgtgtgcgcccgacgccctattctgtcataggagccaccattcaggacgcggttttacccccactccccgccacgatttttgtttgggggaaatatttggggtggcgccgcccccccacccctctgggccgtgttttcacaaacaagagttgtggtggcggctacgtcttcctctatctgtttgcgcacagcgcggctcgtcgcccaccactgctgttgtggggtggcgccaacttctggtgttgtgggaagagactacctcctctggtggcccccaccacagggtgtacacaccagaaaggagacgctctgtggtgtgggccactaggtctgtggagaagtccctacacacctctcacacacagccccactgtggtgcttcttgagagcgtcactctgagggtcgtgtccccctctctgggagcccacacacacagtggtgttgtgacgaccctcctgagtatgttgattagtgcgcgccacaatctcgtggggcgctctgtgtggtgtgtcacactctgggtggacacccttttgtgggatgatagagcngagagtttgtgagagagattagaggtgtgatagtttttgtctcacgagagaggccccgccttgtgaggaggtacacactagtgtcgtcgtcccactctgtgagatgatagagagatatatatagtgagaggagaggtctcgtgtcgtgtgtgaaatatgtctcgcgtctgtgataagagatgagatagagggtgttcagagtatagagatagagagagatagagatatatacctaaaagttataaacacgtctcaccaaaggtgcctgcgttttacactgggaagaccttatttcttggttttaacaccacttgaaaaattgtggtcttgatccacggtaaatttggtaatgtacgcacgtgtaatcgtcttccaataaaccaattactgacctatagcttttaaacactgaatagccttgttcaccagaccccaacatgtccctttctgttatgggttttgaattaagtattccctgtgcctttaaa

SEQ ID NO: 605018 - DNA, 620 bp, Homo sapiens
tttttttttttacaggttcagctctttattggctaacttaacaaaagcagtttagtcaaaaagaccaaagcccatgtcatcttcagactcctcggactcttccttctttgcctccactttcttctcctcagctggggcggcggcagtggatggagcagcaccaccagcaggcgcagtccagctgctggagctggcccaccagcccctacattgcagatgaggctcccaatgttgacattggccagagccttggcaaacaagccaggccagaaaggttcgacgctgacaccagctgctttaatgagggcattgatcttatcctccgtgaccgtcacctcgtcgtcgtgcaggatgagggcggagtagatgcaagcgagctcggagacggaagccatgctgtagactgccggcacggtgctagtcgccggatgaagtgagcatcattcatgctagaagctgtgttctagccatgcagttacatctctttctaaatgaggtcaggtttgcaaataataacaacaaaaaagctttgtttagtctttgttttgttttccaggacaaaaacaagcttccctaagcttgaatttatagttataaaatgaaaacaaaaccaaaaaaaa

SEQ ID NO: 605019 - DNA, 787 bp, Homo sapiens
cttcatggtactaaatgtcccttgagttatcaaatcaggccgggttgaaatcccaatagaacacgggttcttccctcaacccttccagtactttggctttaaagcactcgcaagtgtcttcacagtttccccccctatcctgaattgcttggtccccccctcctcagtaacttgttcaaccctttcggcgttattccccaagattattcttgtcccccctttctcatgcaacgccccgactggttatgtcctcgagttgaccgcctgtactcatacctctatccccagcacccgctatgaaaatgtgtacttatccgtgcatttacattatgcgtctacgtattttcaaaactttttcacgccacacgaatacggcaaaactcttttattctagaaaagctccccctgccccctttaacaaagataggacccccaaaaagggaacacgaacgtctatttcccccgtacccgatcaacctttgaacctccccctcattgctaattgagcgaccataattgggtacaataacattgattagtcggcctctcatctcttgtaagaatatgacacaccaagcttcttttcggaaggtctttgaaaaactattttttacaacacttgtctccctttcggcagcacagccactccctcccgcacccccatgaaatcttgcccaccattttccctcgattattcttttctttctatgattctatgtcatcatcttctagtaaacaattctcacaaaacacacataccagatcctattccgcgcccaacaagaca

SEQ ID NO: 605020 - DNA, 495 bp, Homo sapiens
tttttttttttacaggttcagctctttattggctaacttaacaaaagcagtttagtcaaaaagaccaaagcccatgtcatcttcagactcctcggactcttccttctttgcctccactttcttctcctcagctggggcggcggcagtggatggagcagcaccaccagcaggcgcagtccagctgctggagctggcccaccagcccctacattgcagatgaggctcccaatgttgacattggccagagccttggcaaacaagccaggccagaaaggttcgacgctgacaccagctgctttaatgagggcattgatcttatcctccgtgaccgtcacctcgtcgtcgtgcaggatgagggcggagtagatgcaagcgagctcggagacggaagccatgctgtagactgccggcacggtgctagtcgccggatgaagtgagggcctcaccccaacgcgggcttagcttcctgggaggaccgagcaccttggcttgtgc

SEQ ID NO: 605021 - DNA, 127 bp, Homo sapiens
tgctaggcagcaaaggcagagcaggttttgttcaggacgacctttgagcaagagtaattcgctaaaactgctggtccacatagtcggtgatgggcttccagcactcggtgttgttgacagcgtcccc

SEQ ID NO: 605022 - DNA, 176 bp, Homo sapiens
  misc_feature (168)..(168): n is a, c, g, or t
aaggccccgtgtcgttcttacggggtggatgtcagtcagtggttctcaacgggacggagggagagactgccccaggtgatcttggggaactgtctggagacacttctggttggcacatcttggtggggaggccgcggacatccagtggttttgacggccgggaatgcntgctgaac

SEQ ID NO: 605023 - DNA, 581 bp, Homo sapiens
  misc_feature (187)..(187): n is a, c, g, or t
cagatatcccaagctttaccgccactaaggagttttgtattatcaggtgtatgtatatgccaataattctgtaaaagaagaattttccttacttgagatatattgtttctgtagccaaagactggagtttagttaattctggaagctttttttacttagttgaaatctgacagctagtacacagtcnatggattggtaaaactgctgccaccttagtataaaccaaggcactacctccaaaccaatacaagtaagcagtcatcgtgttctgtatcatcacctactcgcggtaaaagcatggcagtttcaccttagaagtttcttgaagtaaaacaccttagttttattatatcttgtccatgaagtcaacattgtttttctattctctgtgatgaagtgggaagtacacgtaaagcagtttctttgcatactgatggttatcttgagttaaagcactcatgcaactgagtttcaagctgaactatccacattgttcatggaacaccgtttttaattgtaagagttactgataaactatggttattcatgcttggatatttggcagacatttacttgaaaat

SEQ ID NO: 605024 - DNA, 456 bp, Homo sapiens
ttgaatttgagacctattgtaagcatgatccctacctacaaccctatttttacatacccaattccagtaactctcaaatccagtattttactcaaactctgttggggcattttactaaccttgttccctttttggcctgtaagacactttagagattcctaacagagtttactgttgtttagaaatttgcaagggctttttttcagcaatgccaccagcagattataatcttgtcaacagttcattgtctcctcttagtaccaccagtcacctgcatcattcatgctagaagctgtgttctagccatgcagttacatctctttctaaatgaggtcaggtttgcaaataataacaacaaaaaagctttgtttagtctttgttttgttttccaggacaaaaacaagcttccctaagcttgaatttatagttataaaatgaaaacaaaaccaaaaaaaa

SEQ ID NO: 605025 - DNA, 399 bp, Homo sapiens
gctcacgggtccttccctgtcttccacgggcaggaaaagcgccacgtttctggcaggtgtggaagtgaaacctacccgatagaactattagatgtaaagcattgaactgtctactagtaagtacaactcagagagagctgtatttatgaaggataaaatgtttattattggggagtggggagagaagaagaaattattgttcatggctgcaagatatttagcaactatggtattcttattctgaagatttttgcacactcaggctatctgaggaatactggtaatcgatcctgtgaaaaatgttcagagatgcaggtctgtgatattaaaatcttggaacattatatagttcttcctgcactggattctttattttcttattcatttggtatataccca

SEQ ID NO: 605026 - DNA, 195 bp, Homo sapiens
gcacgaggttgctatagacacattctgtgatcctttccatctgcaaaaatggggctaatacccaccagaggctgcaacactcattatcattcccagtactaacaacaggttttgagcgcctactgtgtccaggcattgttcaggctctggagatttagtagggaactaaacagatctcttctgatctgtacccct

SEQ ID NO: 605027 - DNA, 236 bp, Homo sapiens
  misc_feature (85)..(85): n is a, c, g, or t
gcgtcgacaaagttgcaaaattggatcccccgagctgacaaggtgaaaatctgtcgttctgcccctgaacaaggcagttaacccnccgttcctaggctgtcattgaaaataagaatgtgttcttaactgacttgcttagttaaataaaggtgtaaaaaattgtacaaaaattgtttcgaaaacttgaaatcggccctaattaaatcggccattccgattaatcggtcgacctctac

SEQ ID NO: 605028 - DNA, 907 bp, Homo sapiens
  misc_feature (97)..(97): n is a, c, g, or t
  misc_feature (229)..(229): n is a, c, g, or t
  misc_feature (234)..(234): n is a, c, g, or t
  misc_feature (281)..(281): n is a, c, g, or t
gaggttgcgaagatggcgacggccttgagcgaggaggagctggacaatgaagactattactcgttgctgaacgtgcgcagggaggcctcttctgaangagctgaaagctgcctaccggaggctctgtatgctctaccatccagacaagcacagagacccagagctcaagtcacaggcggaacgactgtttaaccttgttcaccaggcttatgaagtgcttagtgacccncaaancagggccatctatgatatatatgggaagagaggactggaaatggaanggatgggaggttgtggaaaggaggacgaacccctgctgacaacttcgacgaggacgtctcgacgcggctgcacgagacgagagagacacgacgaggacgattcgcagcagcgaaccaatcccaaggcgaacgatcagcgttggacgtagactgccaccgacctttctgcatcgctactgatgaggacgtatgaaccgatgtgctccggcaggtagctttccgacacgactttgaacacttaataacaatgcaacataatcccagatccattgaggcacccttgacagcgacagacacagacatcctctctggaagcctctcaacccagaatggaacatggaggaggttccattaactccgcgctcagacgcagtaacttcgcgccaaagcggatggcgaagagctcggaatcaggagactggcacgacctacacggccgcctttgtatcggtactcaacgctgcttccgctaatctcacaccaacgatgccttcggcgacaaccacaccgcgctctgcagtcttcactaccgtggacatccgacccggcctgaccactgaccacacccggcacctacacaagaacaccgcgcagcaccgcaccggcgagcggtatccagcccccca

SEQ ID NO: 605029 - DNA, 884 bp, Homo sapiens
  misc_feature (97)..(97): n is a, c, g, or t
gaggttgcgaagatggcgacggccttgagcgaggaggagctggacaatgaagactattactcgttgctgaacgtgcgcagggaggcctcttctgaangagctgaaagctgcctaccggaggctctgtatgctctaccatccagacaagcacagagacccagagctcaagtcacaggcggaacgactgtttaaccttgttcaccaggcttatgaagtgctctatcagattccggggcgtcctgcactcaggtgactggtgcgtggactagtgaggccctccggataccaagagcagtcccagcaggatcgatacatgatggataaactgcgcaaggaaccagatttttaaaaaggccgctataaaaattcttttccgtgggagtctacaatatttggacaatggaaaaaacccagacatcagcatgtcttttattgttatattagttagtatatagaaggtggtaccattagtcaagttatgtgaagggactgtgcagacaccccagcgttttgagggtgctgggggtaggactgacggcatgccccatctgggaaccagatctgcagcctgggccatggctgttttcccaaggatcagtttcctggagggaagggctctggccctgactccgcctgtgtcccgagcacacgttgctgacctgtatgccgccgtctggtagttcttgcgctgggtctggcaggtgtctgtgggcaccctggccttcccacaggatcgtgggccccttctgcttcccgctggcctggggacacacctaaagccgggggctccgggaggggcctgtggggttccggagcccccttggcgttcggtgatcgggagaggggtaacacggtttgagacggggaatagttacccagtttcg

SEQ ID NO: 605030 - DNA, 133 bp, Homo sapiens
  misc_feature (69)..(69): n is a, c, g, or t
  misc_feature (74)..(74): n is a, c, g, or t
  misc_feature (107)..(107): n is a, c, g, or t
gatccgcaagaacaagtaccgcccgacctgcgcatggcagccatccggaggcccagcggcatcctgcgnagccnagaagcctgtgatggtgaagaggaagcggtccngcccaaccaagagctccttgaggccc

SEQ ID NO: 605031 - DNA, 446 bp, Homo sapiens
tcgtacagagggtggccgtcgtactgatcgtagagcgggtctggccggcgtgtactcaatgtagggcgaggacatgcgaacgggacatgggagcgtgctggcgactcaccacgctgtggctgcacgatggctggctgtggtagacttagtgcggggtcagccacggcccaggaggactcattttctgaacataaagtcgcctccgtaagtccgctggatcaaggtggtgttgcagctgttgcaccccagtggcaatgcccgtctggaggctccgcggcttggcgcccagatatgccatgttcacgttggtcttgtcggccgtcgatgatggggttcgggtctttgcaatgccctctcagctgccgcccggtcggccatggtcacgaagccgtatccgcgggacttgcccgtctggcggtcggtgatgaccacgggcaccccctgct

SEQ ID NO: 605032 - DNA, 681 bp, Homo sapiens
  misc_feature (29)..(29): n is a, c, g, or t
  misc_feature (134)..(134): n is a, c, g, or t
catttaatgtcaaggctttgactccagtnaacctaccatccatagcaagtgtcagagaatcgtctgcaaattgtcatctctctcctttgacctagcagtgtgcatgcagattgtgcacaataaggcctgtccangtacgcatgctataaaaggttacattcttttacagctttctgataattattattatttccagaaagatatttttgtttgccccatttaaaaaaggttaaattgagtcactgtcttcactttcatgagtaccttgtaggacactattaataatgataaatagctaggcttctctacattaccttaatttttctgttgttgttctcagtacatctaagagagtagcatataggccatgtgtatgtggtgataaatggaaaggcaggggtcttacttggttatttagaacttaagattttatacagtcattttcaactgtaattgaacacttcactttaactcccttcagaaactctaagctcatagtgtatcccaggtagtagaatttctgttcatctgtttataggcctccaccgcaagaaattggctcccaacctattcccattacatcatcacccggtaatgtcattacaccagaatgaaatttgcttccaggcttgtattgttgttttccttcatttctttcccctcatcatttcctttagaagc

SEQ ID NO: 605033 - DNA, 1142 bp, Homo sapiens
cacgatggagctgccctgcatttaacctgtgtgacagcaagactccgtctcaaaaaaaaaaaagaacgaaagaaaagaaaagaaggaaatgaacgctggggcacagtgtgctcagtcctgtaatacccagcaccttgtggaaggccaaggtgggaagatcccttgaggctaggagttagagacaagcctggccaccatacgacaagaccccatactctacaaaaataaaaattataaaaagggctggggcatttgagctgggtcccaagaagatagacaagtagaaaaggcatgtgagagggcataccaggtggagaggagctgtgtgcaaagggcctggagatggaaaaacatgctggccaccagcttctgacaagcagtataaaagtatagaaccggttatgcatgggaacagatggtgaatggtagggcaaatgtgtgtgatgcgacactgagcaacccgtatagtgataccttaaaaaatgaccagcattgaggaacctggtactactatcctgaagaggaccctagaagagccatggaaaggtttaaaagtaggagtgggtcatggataaggaaaaggagataaagagatgatcccccaaaatagcactggacaaaggtggaagcaaagcaggagtacctgaggacaggagataacatgatgagcgaggcatggagcattacacgaccatgagccaaacaaaagacagggcccaaatagaactaggccaaataaacaaaatcagggacaacgctgaaggacaccaagacgaacaagagaaagaaacccgagcagaccccaaacaacacaaagggaaatgggagcaaggacaccggaacagaacagcacaaaaagacaagtattgcaacaacgacaaaaagcaccaggcaaagactgaacagggagcccaaagaaagcagaccgcgcaacgggaacaaaaacgcaacgagccaaaccggcgggacaagagccacaccaaacgacaatgggcccagagacaaaacacaaaccacacagcaacaagaaaacaccccaaacaacgacagcaaggaaagagacacagaccaaaaacaccagaaaatgtaaagaaaaaaacaaaagagacagagaccacaaaagagaagaaacagaaaataat

SEQ ID NO: 605034 - DNA, 638 bp, Homo sapiens
tcctacccctatctggggacattcaaaaactgccgtgggtggtttgagaagagacaacccagtttgatctgcaatacaaggatccattcgtaatctctctctcacgtgatgttatccccccatctgccgtctgggttcatctcaccacagagagggcttttagtcctacccagccatcggctgcgtatgacagcgaggagtggcacttcccatttctcgtggtggttagtgctcgagttgaaacccttcttttcagcgtgagtctcctcgtggaggtctcgtgcgtgtgggagtctccgtgggtgtggcgtgagtggcaagtgcatgtgaggaggctcgtggtctccacccttcaagccgcccgttctttcgccctgttttcccagtgggcctctcgtgtcaccacaaaaatgtgaagaacacagaaagatgtgttaggaactttaaagaagaaagtgtttgggaaatttcaaccacccctctttggcaagtctccttttttcagagggcttgcagtgcctcgtggtgcctggtgttccccagtgcattgtgtgaaaagttagaacgctggtgaatggcgtgcgtgggacgcttggcaaaagcaatcagtggtgtttgaaaatggcagcacaagaacc

SEQ ID NO: 605035 - DNA, 753 bp, Homo sapiens
ctgtaatcccagctctcagggaggctaagaggcgggaggatagcttgagcccaggagttcgagacctgcctgggcaatatagcgagaccccgttctccagaacaaaggaacaaaaaaaaaaaacaaaaaacaccaaagcgccaaaaaacaacaaaacaaacaaaaaaaaaaaaaaaaggggggcggcgcccgcgccccgaaaaacactccaaaaacacacgggggggggcggggggcccacaatggagtactagagacaccgctgtgacacaagcgagtgggacccacaagaagaaacccctggggcgaagaaagaaaaaggcggcgggggatactcccacccaaataataaaaacccgccggggggggaccaacagggtgcgtcttggggaaaccacaccccaagagggggggcgcagacgggcccacaccaggagggacacaaaaacacgcagcggcacacacaggaggcgggcccgactaacacaaaaaataaagagccccccactggggagggaacaacaacacaagcacgcagcgcacgaaaaacggcacccccaaaacgcgagcgaggacaagaagacgaagggagcgaacgaacaccaagcagggcaacacgagggaacaggagccgccgaactagacaggcagcaccacctaccgaccgaccaggaagcacgagaaagcgacgcacaccgaaccggacaacaaagaaccgcgcagaacaaccgcacgccccagaacaccagcaac

SEQ ID NO: 605036 - DNA, 199 bp, Homo sapiens
tctgctctgacatttcctctagaaagaaaaagaacacatatagaatgaaaatacaaatcagatgtatgggtttccttccttccgtcaactatattctgttatatcactagcccatgttacttaaatacctgttcctgattattccattacaaaggagaacggtacataaacaagaaatattgcctttttggttgtgtgt

SEQ ID NO: 605037 - DNA, 1002 bp, Homo sapiens
gatcatccggttggataatggttctagatggcgtgcttgttggacaccccgatccgcatgagcgtacttttcggaagtaacagatagcacgtgcgccgactatgtagactggctatttgaccctgatcccacagaaagttctaccataggtcgttcagtaagcttcatcgtataacaactgctcgtacatctggtaaagcataccacaatgcagcaatagctcacattactccatttgttctttatggacgcatgtacctatgcatgttcgtttctgtgctctcagctatagataattgcatctagcctcagacgctgagactatttgatatgtagcagagagcgtctgggaaggtctttgcctatggtgtactgacataacaatgtccttggtgtctacctggatctgccgggattattcctgctctgtcctgtgcgtggtacttaccatgtctcccgagagctgtaggtattattgagcgctcagcccttccgtatgtccatgcgttacttgatcttacacacagttcgctgtacactctctaggaggtgctactgtatatcgagagtgctcacctgttgataccggctacctcatgggtactgcttagaaggtcccgatatacccatggagtacttctgttcagatcttcttagaactgctgtagaaaggggcagatctatcatacaaatctctcatgtaaaccacggggcagtcagaatatgtcacgtacgtaggcctagtctacaaagttgaggcagcaaagcaggttctcaggctgctgggatcccctagttgaggctggaaaggtcgcggagggaaatgtggcccattgggaaggtcgcggatcgccttgagcgggcaccggggtacccctgtggggggtacggtagggtgtagaacccttcttatgtagaagtgccaccattgaacttgtaagaacttagacacctcccgtgtaaaaaacgtctgcgtctgttatatggtggagatattttgga

SEQ ID NO: 605038 - DNA, 1861 bp, Homo sapiens
  misc_feature (458)..(458): n is a, c, g, or t
  misc_feature (542)..(542): n is a, c, g, or t
ctccagaaggtggctgaataacagtcaccacctggaaagcatctcttctacccacaacgtaagactcgacttggagctgtcgttttccattcgtcatgtcaccagtctgcatgccgctcccatgaggagtgtattacgggtgggaattgactaaactgagggaaccattgcaatctcgtcacctgtgatccacctgttgtagcaagcatgtgatgagctggcctgtccttgttgcccgctagatagcacgagaggccttcgagtaatggctccactctatcctcatacgagatcgtctaagaaggatgtcatgtatctggtataggactggtctacgcttcgtgtgaaatgcatgtcggcatagtgatggtgaatgacactagctcacagatgtagtgaccaacaagtgtaagcctgaaaggattccatgggactatagggaagattgtacctcctantttgtggtttgcctacctgctatacagacttactattcacattacagattcactcacaacaattttccatatacagcgtcgccnttggcatatacatagtgcttgacatacacagagacaatcccacagtgattccatacagttcgcgtattagtttggcaatctttaatccattggaatatccggatactcactaagaccctcctggagtatggaaacatggtttgtgaaaaaaagtgtggcttagtcgagggcacgcaacaaattacttaatttataggttaatacgcgattacaaaggcaaggggcctgaagcaccagttccagcatgtagcctagtgaaccttgtaacacgtaggtttaccctccggttggggaagtggtaagcgtcccgaattgggtgggcaatctataagccttaataacgtctctccgaatttgataaattgcacgtttgaagcgaaaatcgacaaggtttgggggaatagcctttggcgcgggtgcaaacttatgggagacccacgggaataatggaccggttgccattctttgggtatattgtagacacagcacatttgggatttgcccagagacacagcacattatcttttggtgaacgaataaacccaaggcccctaaagaccaaaaagtctcgtggtcggtccccccccaggaaaaattcccacagcgggtcaccttggatttcttcctttggctagggatgggtgacgggagcctttgtgggtttcccttgggaggcagggcccggttaattccggcatacatagagggttggtcgaagctccaggacacgtgaaaattacacatcggctagggacttaaaaattcgtcccttcccccagaggaggtagggaatgccccccacagaggtattatgtaaggcgcatgtagagattacagtatattacacccgcgagggaggaacaccccaaggagttatggctagccacgcggcgagaagaaaaggacgcccacacaacaggcacatacgaggaagaccctcaaaggaagaagacagcacgacacaaactaagaggcacacagaacataaccaccaaaagaggagggagtagaaagacccaccccacaacaaacgcgaggcaaacagcagaacacacacccaacggtaggattcagcaaagggagctcacaagagagacgcaaatagacaacaacgagaacgcagcgtacaacacaatacgacccaacaggaaatagacgcaaaagaaagagaaggacaaacacacatagtggacgatgtgtgagaaccaaagaaccaaaggcaaagagaagaaacacagagtagctagcgaacacacaataaccgaagaggatcaacaaccaacaaacgcagaacaacgacgaccacaggacatgacaag

SEQ ID NO: 605039 - DNA, 774 bp, Homo sapiens
  misc_feature (18)..(19): n is a, c, g, or t
  misc_feature (26)..(26): n is a, c, g, or t
tggcaggcttggtacccnncggttantgggatggcggctctgaagagttggctgtcagcgcagggtaagcttcattcttcaggtacctgctgggctccgagttatgagttatacagcccctgcaagtaaatccaagagcctgttcacagattcggcatgtcgtgccttatgaaatctgacttctacttccagtaaatcagagcctcataacccttagtagtgaagcattgatgaggagagcagggtctccggtaacagatagcacctctaccttgctctctcagaccacatatgcgtcgacttgaagctatgactgactatactaaggctgtttataccttaacttctcttctaccgaacaatatacaagtattagcttgggaaaatgaatacagaggaggaagatgaaggtgtggcagagtgatcataggaagcacagagctgagatgacttcaaaaaagcaagagtacttgacagctggaaaacagttggatgactgcagaggtacatcaagacgatggcagccagaaacgctaggatagtcaagactggacagatgtaatggcgatcgaacagattagacaagacggacgagaatgcacatgcacacatccgtcccaagtaaacatgtcggaacatagggaccctggaaagggtgcctgggagcaacgcagggaaaaactcagaaaaaggagcatacaagacgaaaattgcacagaaaccgatgtatagccaagaaaggggaaaaaacacaaaacctagaaagaagaacca

SEQ ID NO: 605040 - DNA, 119 bp, Homo sapiens
gtttcttcactagtattagtatcatttcaatattctaggatttcaaagattactaatacaataaagaagacaataacgcaataaagaagcgaaaatagcaataacagaaggaacataag

SEQ ID NO: 605041 - DNA, 261 bp, Homo sapiens
cgatatagaagagacgagatgggaacgttgcttaacagaaagcctagggaaactttagtgctagatacaaaattcacacagtggaatacggcacgtgactctggtgtgagactggtgaatgtgtcctcagccattcagcaccatgcggatgatgctccgccccatggtgcccgtcaccccgactggatatgcctcacaaacgcttcatagttgatacaaccattgctgtcctcatgccctgccaccagcatctcgtctctt

SEQ ID NO: 605042 - DNA, 311 bp, Homo sapiens
atatgctgtctcaaaatgcaaaggaattaaacaatgacttcaaacataatagtttcattggttaggtaagcacatgtggggcacatcctcccccggctccctctttttaatgccagccacggtacgggccttcatagaagaatgagatcctgtagagaatgagattaagaatgactaatgattcttaatcatttttccggccaaatacccctctagcaaccgggtaaaacctatacacaaacctcttcttataaaaatgtttagaaacacttaaaatgaaattcatagaggattataaagtaaacttatgt

SEQ ID NO: 605043 - DNA, 147 bp, Homo sapiens
tgatgctgcaggtactctagaggagccctagggtcttagggaggtgggtggggagccaggtgcagcagcaggcaggtaaaggtaaatgaaggctgagtgataggtggggtactcagtgacagagttctgaggcagccatcgctcttg

SEQ ID NO: 605044 - DNA, 656 bp, Homo sapiens
  misc_feature (595)..(595): n is a, c, g, or t
gggaccaggcgcactccatctccatacattagcacactaatccgcggcccgccctgtggactcatgcttgtgatcccagcactctgtgagagcccgggccctgtagcacacaccgtgccttccctatagcccaggatgtgaatctgaatctacaggcagactggaccaccttttccccatgcccccagaatgtgcacaagggcttccttggctacacatagaaggattagaatcctccctactctttccacactgtgagagactgactggtgtgaaggtccggtggttttgtgtggattttactaccagggtcggctatgataagggggagctttcattacattctggaagactgtcccacgcacacacgcacaggcgtgcttccttcccccaacatctgagctaactctctctctgcgttgctgaagctgtgctggcctaagaggattagagcctttgctaaacgggaccaggacaggcagggtcagagaacccgctgtggggagacccacagcccggatggccactatggggcggcagaagaagcgagacacggagagaggtgtggagtgctcaggagaggcactccgccggnttagcagcgatcaatgtgcacaaagtgacccctgaagggttatatctttttttacctgtgg

SEQ ID NO: 605045 - DNA, 288 bp, Homo sapiens
ggatgagtggtccctttttctgaccaccgtgactccaccccttgtttccgtgatctgactctgcccgacttgatctccacctctagtgcgctgcgatctgactctgctcgacgtgttctccatctctagtgtcgcgcgatctgactctgcccggcgtgtcctccatccgtagtgcctgttatctgactctgctcgacgtgagctccagcccttgtgcctgttatcatgactgcgctcacatgatcctcctaccccttagtgactgtctgatctgacctgtccttaggc

SEQ ID NO: 605046 - DNA, 521 bp, Homo sapiens
  misc_feature (5)..(5): n is a, c, g, or t
  misc_feature (34)..(34): n is a, c, g, or t
  misc_feature (66)..(67): n is a, c, g, or t
  misc_feature (72)..(72): n is a, c, g, or t
  misc_feature (90)..(91): n is a, c, g, or t
  misc_feature (107)..(107): n is a, c, g, or t
  misc_feature (119)..(119): n is a, c, g, or t
  misc_feature (140)..(140): n is a, c, g, or t
  misc_feature (144)..(144): n is a, c, g, or t
  misc_feature (153)..(153): n is a, c, g, or t
  misc_feature (174)..(174): n is a, c, g, or t
  misc_feature (192)..(192): n is a, c, g, or t
  misc_feature (197)..(197): n is a, c, g, or t
  misc_feature (223)..(223): n is a, c, g, or t
  misc_feature (229)..(229): n is a, c, g, or t
  misc_feature (250)..(250): n is a, c, g, or t
  misc_feature (256)..(256): n is a, c, g, or t
  misc_feature (261)..(261): n is a, c, g, or t
  misc_feature (265)..(265): n is a, c, g, or t
  misc_feature (270)..(270): n is a, c, g, or t
  misc_feature (277)..(277): n is a, c, g, or t
  misc_feature (295)..(295): n is a, c, g, or t
  misc_feature (299)..(299): n is a, c, g, or t
  misc_feature (303)..(303): n is a, c, g, or t
  misc_feature (327)..(327): n is a, c, g, or t
  misc_feature (332)..(332): n is a, c, g, or t
  misc_feature (343)..(343): n is a, c, g, or t
  misc_feature (357)..(357): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (382)..(382): n is a, c, g, or t
  misc_feature (402)..(402): n is a, c, g, or t
  misc_feature (420)..(420): n is a, c, g, or t
  misc_feature (422)..(422): n is a, c, g, or t
  misc_feature (428)..(428): n is a, c, g, or t
  misc_feature (435)..(435): n is a, c, g, or t
  misc_feature (449)..(449): n is a, c, g, or t
  misc_feature (521)..(521): n is a, c, g, or t
taggnagcagttaggctgagtttaatgatggggnactgggccagaccaaacacagacctctgcccnnccccntggcctttggcccatggnnccaagaggccagaagnggcccagagggngccatggttcccccccaaggnaggnagccatggncccttagactttgtgcaaaanactaaatgctaatttggnatcgngggccagccctgaaaagagaaggggnaatccnctgtgcagccagcccaggggncaaggnaaggnaggntacgnggccccnggccaagagaaaaggggnaggnaggnaagaagaaggaaaagacccccccnccccnagcatgggggncacaggcacagggnaagtttntntnaattcctctggggnagagggcagacatccaagcngtggggattacagatccncntctccnatgcccncgaaggcgaaattnccgtggacatcactggcactggcatctgtgctgggactgccaattccccgcaagctcacggcacttagcttn

SEQ ID NO: 605047 - DNA, 449 bp, Homo sapiens
tgtcgacctcactccatcacgtgctccccactgtgctcaccactaccagccgtaagaagaagcccaagaagacagaccttgtgagtcccctctgtcaacaagccaaaagcatgccactgtctcaggacacgtgggagacatgacacatgttaaggtacaggacaagaatgtccccagtcctgctccttttagggtaacccaaactgattcaaacctgaagaagctgcagaatatgaagaagggttactagcagctgcccatctagcatctaattcctggccccctggtagggcgtggccaagcgtcaggctacactgctacagatgggtaccttggttaggactgtggacatgctacccactagcaactctgtcttagcgggtggtatttgtagaccaggccagacctctataccatgcacagcatacctcactctatgacctctacct

SEQ ID NO: 605048 - DNA, 141 bp, Homo sapiens
tcctacaagatcagaaaaaagttacaagataatctagtatacatgcaaaatctatgtgctagaatactttgtataaaaggtattttgaataccattaaaactgctttattttttccagcaagtatccaaccaagagtgtcg

SEQ ID NO: 605049 - DNA, 181 bp, Homo sapiens
gattgttattcctgtgtctggaacaagcagcagctgcatttcagcacatggcagtcctcatcccatacatcagtcccagtggcagtgttcagcacagtgggtctgtggagtgcattcagcacatctgtgcaccacagggttcatttgcacatttggtcatggccaagcatgcacaattttc

SEQ ID NO: 605050 - DNA, 697 bp, Homo sapiens
aacgtgatatttggttcatgaaagagttgttttcatgtggttattgtaggcagtatatataattgtggaaggggtatgggaagagttgtgtatagttagttgtcatctctacacgctcgaccgttttcccatccaacatcatcactatcccactgttccaacactccgcctgccggctattatccgtctttccctcgaacacaaatccacctcacgcccacctagaactagacactctattacacaccgcctatagatatacctatatcgcacaaacccacactgctcatgcatatctccatccctctctccgtcgctatccctgcatacacactgcgtctgtcacctgcatccactaccttcgccgcatgctaacatcttccgcccctgccctgccaactcccctggcgaccactccgtcccccttcagactaaccgcactcttttgccacccccagccctcaccgtcctctaacaggcccctccttcataactgtctcccatgccctccatcccctcgctcccctcccccctacacttcccaaccctactccccccacccaacctaccccctccacccttcccccgcactccacctccaacctccacatcccgcctccctccctctccctccccaatcacgtccctcccttctactccccgctcctctccctctccccccccccccgcttccccc

SEQ ID NO: 605051 - DNA, 3077 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605052 - DNA, 210 bp, Homo sapiens
actattgctaagtgaggacggcatcacagcaatctcagccatctgtcggtgacaactgttgaccactttggagcccagcgtggtaattagtagctagaatcaggtgtacggtgtcctttatgtcaacaaggacgctatcgatgatcttgaccaggtgtacaatagaaacgcgagcagactgctaatagccatcggctattctgatagggt

SEQ ID NO: 605053 - DNA, 3139 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgaaaaaaaaatacacctttatacagaaattttatacagatgtagctttaaaattgattgtaaaccaaaggaagacacattgcaaacatcaattaatttcccattaattgcataattttctaaggtgatctattagttttatttacctaagcttatttgcatgatagtaaaaattgcatacaacagtaagagtgaagcttatagtatgaattgctgtcgacgcggccggc

SEQ ID NO: 605054 - DNA, 3023 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605055 - DNA, 2387 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaacctctccatgatccgaagtttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605056 - DNA, 2053 bp, Homo sapiens
  misc_feature (14)..(14): n is a, c, g, or t
  misc_feature (20)..(20): n is a, c, g, or t
  misc_feature (22)..(22): n is a, c, g, or t
  misc_feature (25)..(25): n is a, c, g, or t
  misc_feature (31)..(31): n is a, c, g, or t
tgaatcgtagaccncatgancncancctacnagccttgtacgacttgaccattagtacgccaaccttggcacgagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605057 - DNA, 206 bp, Homo sapiens
tttaattcccgtgcatttgccagggtggggtacccccccctattttccctgcttgccctccagtgttgccaggcctagtgggccagccagggttcagccttcagtaaagggttccccggtttccaccccccattgcagggtttcccctaaaattgtgccctcttggagggggggggcccaactgcctttcaataaaggggttgcca

SEQ ID NO: 605058 - DNA, 171 bp, Homo sapiens
tgtgggcggcgcttgctttctgggagtggcgtccttgtgagcatcctggccggctgcctcctgaaccggcgcagggttgcccgctgactgcgcaagtgcgtccgccaagatccacctcttatcttctctccgaccgtgaagtcagctgcaccctctgctctgggctcaggc

SEQ ID NO: 605059 - DNA, 1226 bp, Homo sapiens
  misc_feature (5)..(5): n is a, c, g, or t
actcnagagcatcccctgtaacggttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605060 - DNA, 881 bp, Homo sapiens
ctgatgaccgaggcccccctgaagcccaagggcaatcagagagaagatgactcagattatgtttgagactcttcgaacacgcccgcgggcatgtacgtggccatccaggcgcgtgctggtcccatctacgccgtctgggcgcaccgactggcattgtcatggactctggagacggggtcgacccacaacggctggcccaagtctacaagggcatatgcgcctccccccaacgccaatcctgcgttctggacctgtgtctggccgggtacctgagcgatctacctctatgaagatccttctactgagacgaggcttacagttatcatccaccacggcggagcgggaaatcgttgcgcgacattcaaaggagaagtctgtgctaccgttctgccctgggtacctgcgacgcagggatgatggccatcggccgcatcacttcctcttcgtcctgggtacgcaagagctacgagcttgaccgatgggcaggtcactcaccagttggcaatgagcgggctccggtgtccgggaggcgctgtaccaagctcttccttccgtgggtatggaaatcgttgcggcatccacagatgagcaccatgctaaatccatcatgaagtgtgactgtgtatctatccgcaatagaaccttgtacgccgaccacggtgcttgtcgggcggccaccaccatgtttccgggctttgcgaggggtatgcagaggagatcatccgcctggtggcccagcaccggtaaggatcgtgatcctcggacccccaggagcgccagtactccggtgtggctccgggggggtcccttgggggctcctgggccctttcatgccgagttggttagccagcgggttcaacagattgggccctcctttttgg

SEQ ID NO: 605061 - DNA, 1284 bp, Homo sapiens
gttcgcgttattatatgttcacgtgttgctcgccactacagcctcctgacaaggctgaatccggagcgaggccgccgacgatagtaatttgagtcgccgctcaccgtgccatcacactagatatggcactgctcagctatccacgaacgctccgaagtcgttgcgacgcgccatttgcgtgatgcaagcttaagggtgactgtactatacttgcccgggttatgcgtgcacttggaggcattcacgattcgtatcatcacatgcagatcacaagcaacgggatacctgcggcagcataagtactacatgacttgactcgttacatgaggcgcatctgcgaggcactgattccatagaacaaccattgagtaagactgtgttgtagccagtctttgccatacaatacggaccatttctgccctgggttaatcggatccgttggtgtacttggaaatccattccctgaatagtcccgggagcacggtgtgatcccgagctgtccaggggtggcacccagctggaacatacaccatgatactggccagatattgccttcttggggaacgggtttggggccatatttgttaaaggggacaggtaacaagacctttacaaagtggtttgcaatggggcattgcttaacccaatagataccctaaaaattccgtggggagaactttgcctgggcaaactagtttccggtccctgcgtaaaagcccgggttgtgggtcctcgatctttgttgccaccatggatgtgcccactgcaatgtgagccaccgggcccttctttcgcttatcatttcaattcatttccacaacgagtccaattaccaccattacttgcattgagttacctgaagggccacgggggtatgtgtagtactatgttaaggacataggagaaaactcggcgtaccaatgggtacaaaagctcctgttggtcttacattgtttccagggaagcggtttggagggttaccggtcagggcaattccgttccattgcataactttttgtagaagctgcgatcacccggttcgtgccgctcacaggcaggcccgattatgacctctgggaggaaaatggcccacgttaccccggtaacccacctgggcttctcggaaaccatggccaaccaagacacaacctccagcaacaagcgggattcagcacgcgaccgccgcaatgcgtacagctcaaaaacagcacagaaagccaccaacgagtggagcgccactacagacacatataagtcgtgcgcacactccccccaccaacacat

SEQ ID NO: 605062 - DNA, 3019 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcattagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 605063 - DNA, 308 bp, Homo sapiens
aatgtgctgcacatgggactcgaaaggaaaactaggagcagcaataaatgcggaaatacattcttggatacattcacggccacagtgtaagcgccagtcccttcggatcttattgcaaaattagcggaagtataaaaggcattttactggagatgatatggctggttatacaaaaggacgatcctattaattctcgcggtcctactcatgtacccgtaagcagatctgtcacagtgtgctacgtacgcttagattggtcattataagtacgtacatacgatattggaggctccatgtggtgacgctaa

SEQ ID NO: 605064 - DNA, 342 bp, Homo sapiens
tgagatggagtctcgctctgtcatcccaggctggagtgcagtggcaccatttcggctcactgcaacctctgcctcctgggttcaagcgatgctcctgcctcagcctgctgtatagctaggactacagccatgtaccaccacgaccggctaattcttgtatttttaatagagatggggtttcaccatattggccaggctggtctcgatctcctgacctcaggtggtccaacggcctcggcctcccaaaatgctgagattgtaggtgtgagccaccgcttatggcagttaagattatttatgtcgacgcggccgctaatttggttttgttgtcgggccggtatt

SEQ ID NO: 605065 - DNA, 1247 bp, Homo sapiens
  misc_feature (252)..(252): n is a, c, g, or t
gtcatgggcagtgagtgcccctttaacagagtatgattcttccatgtgaacagtacttactatgcgaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctnctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcaggtcagttgtgtttcataagtggttctgtgctgtctcctattttctctttctttagtcccatctataactaaagtttattcttttacttctgtactaacattttctctctctcttcatgtgatcatattacctattcctggtggagcctcaattttaccactccttttcctatgatatacttctgaatcaagggaacctatgtgcagattgatcccaattcagggcctttgaaagactaattaaatgtcaaacgtactttaaactggcattacttatgcttttatataatggaatcataagctatagtagatggttaagaaaagtttcatgactcagtcaaggctattggcaggattccaggcttctagcctattgtcttttccatttatgttgttactacccatatcaaacttaggtatataaatgttccctcttaaagttctactgcagcgttgtgtagagtagtagtagtcgtgctaacaccttggaagcaattaatccacttaatttctaagcagccatttttgaacaacactacttatatgacttattaccataaatatttgtaagctgtgtgcgctcccctcatgctattgtcttccacattcattgtctagaccaggcatcagcaaactttatctgttatcgacca

SEQ ID NO: 605066 - DNA, 115 bp, Homo sapiens
catataagccagctactggggaggcaaggcaggagactcaatcacgagagatctggcccattagtactttcttctattttatttatttatctctattttttttgagacagggtct

SEQ ID NO: 605067 - DNA, 1538 bp, Homo sapiens
tcgctcgcctgtactacacttatgccgtcgttccgtgtcgactgtctcatacactactactccgtcggctcttcctttctatactgttctcttgtattgctggtctgagtctctctgtgcttgtatatcgtaccctatagtctcttctcgctatgtccgccttcttattatttgtcaagtcgccccgatacctttctttactacttgactgtgttaaaccatcttcttcttggttgctctcctaccactttcatttcttgtcattttttcccttgtcgcctctttatcttgtcgtctatatgttctctgatcgtcctcttccgatacttttgttgctattcactatgttgttccttatatataatgaatatatatagttattaactgtattctatctgaattattgggattaaattgatattagcgccttatcagtctggacttattctctcctttcttctatttggtatatttcctttgttgtttttatattgttgtgtttcaattgtctgtgtgcatgtattatgtggtttgtaattcttgttgatattcgttgattgtcctgagtttctcaagtgtcatgatttgtctttttctcctttttattatggttttctcatcatgggttttattatatgtcattgctactgtctttttcagtcctactactagtctcgttcctttcttcctgttgtattttcccacttgattttccttactagtatacagcctttctctgtcttgttcttctcttctatgtgattttttcttcttttctttcttgtaaacttctcttattctattgcggcatttgcggtatgtctttctacctctatcatgtagccatcatgtaatggtttcttattgctttattccatggatcatgattttggatttatctggtatggtctctagtgcctattggtgcgatgttatttgtcttgtcatgtccaccgtatctaagctattattatctttttcctgtcttttcttttatgttatattttattttatagatagtctgtatatattacattttataatgtatcatatgtagtctgtgtagtatattagatattgttagttagtattatttgtgtcttctaatcctataatttgtcactgtagttggggtaggtgttaccctatactcccagtctttcgtagttattgtactgtattactagttcacacctgctacttctccagtaattgtccttgtctgtacctgagctaccttgttttagttatgttcttgtgtaggtctatgctccaccttcctctgggcagatccatcttggtctaagactaaacatacccaaccctctaatttctgggaagatatcacctccgtgattaatctaagctcctagatctcccagagataatcatgctgaggctacattgtgtgaaactacatttttatctagcttcttcctttgccctttcctgctgtcctcacttccttatgaatttttttctgtaagatgcttgagtaataaattgatttaaacaagatgcgcccagtcataagttta

SEQ ID NO: 605068 - DNA, 294 bp, Homo sapiens
gttctaagaaggtagctaggaagatcgattgttcgcaaagactgcgatttcactatgtccggggaaatgctatcattccgagggggtgtcaactctcccagtctgtccccttaacaatttccttcgacgttcaagataggtgtctcgatcctgggggttccgatgtggaaatctttctatctgtgtaactagggccggattgggccgacttgtcgattaaaatggtatcccgcgggcttcgttcacagctaacttttgggagctatcctgtgtacctgtgggattgagaatggg

SEQ ID NO: 605069 - DNA, 966 bp, Homo sapiens
gaggttattgtcgccagagcagagagtgttgagtgaagactacccctaaaagccaatactggtaaatagataagactcataatcagagattgtcgtggcattggacacgtcacgattcgaggcaagatccacacacatactggttcaatctgatctcataaatgcgcgtggaatccgacaagaaagaaccgatttgaaacagagttaagaggaaatgagaggctggctgagtcaatgcggaaagggctcctttccaagtcctgcacttggagacattgcgatcaacactgaacagctgagccgtgaacgtggatatcaccgagttggatatctctgttgtcggtcacactgtgagaccagcaacgtactatgtgacctagtccattgtgatgccccgaggacgacgaggattattttatcaacagaacattgatcgacagggtacatactacgagagctggactgtgctgtcctgattgttgctgctggctgtccgcgatgaatggtagaacgctggtatctcccctggacatgggcagacccgacagcatgcccttctggcattaagacacttgggtgtgcaataccaactcaatttcgtcggttgttgacactgaagagtggcattccactgcaggccaccccctaacagaggcagacagcagatcttgtacgtggcaggctttgatctagggatggctccacgagccctttaccattccccgccgattttcgggggtaactactcgccggatagcagtcgaggcgtttgcttgccccactgttctcgggctgggtaatggtgtacccacgtgctgcgagagcctggtgacttaacatgcctcgggtgtccgaccgctatggcccacggttccccggtaaggatggcaatgccggtgggaccctctctgcttgggcgctctggatgatcctaccgacgatcggtccatgggcggccttcccctc

SEQ ID NO: 605070 - DNA, 80 bp, Homo sapiens
ggatttgctggtgcagtacaactaggcttaatagggactcgaattcgagcctcgaattcgagcctcgaattcttctaacg

SEQ ID NO: 605071 - DNA, 526 bp, Homo sapiens
  misc_feature (3)..(3): n is a, c, g, or t
  misc_feature (30)..(30): n is a, c, g, or t
  misc_feature (42)..(42): n is a, c, g, or t
  misc_feature (66)..(66): n is a, c, g, or t
  misc_feature (187)..(187): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (505)..(505): n is a, c, g, or t
tcncccctcgttccccggattcccctcctnatctctccctcnccccgctctgtctctctctccccngtcactcctctcctcctcctcgttcccctattttttggtttcccttaccctcctacctgtttaaaccctgttgccttcccttcctggattaaatacatttaagagcccattccctttatanggtccacatttccctatgactttacctcaattaccttttaaaatccctttcctattcctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcnangngcacgcctgtaatcccagcactttgggaggctgaggcgggtggatcacaagctcaggagttcaagaccagcctggccaacantggtgaaaccctgtctctact

SEQ ID NO: 605072 - DNA, 364 bp, Homo sapiens
caacaggttgatgcagatagggggctgtactagcctagtacggaaaggaccaacgatgctctggctgccctcaggaattccaaatgaccgaagggagcaaagcttcagggcgtatgggtggtgtctccctcgtattaaggaggtggtcggatggttccgcagcttcatttcgtccagtcatatctagttatctagagttgttgtcaagatgctgcattaaatcaggcaggtctacaaaggcatcccaagcatcaaacatgtctgtgatgaagtaatcaatgaaagaggatttgggattgggggatgctgcaggtatttctgtcaaacactggcatcaccacaggtaagccctgctgcttctctt

SEQ ID NO: 605073 - DNA, 870 bp, Homo sapiens
  misc_feature (18)..(18): n is a, c, g, or t
  misc_feature (84)..(84): n is a, c, g, or t
  misc_feature (98)..(98): n is a, c, g, or t
  misc_feature (106)..(106): n is a, c, g, or t
  misc_feature (130)..(130): n is a, c, g, or t
  misc_feature (141)..(141): n is a, c, g, or t
  misc_feature (171)..(171): n is a, c, g, or t
  misc_feature (189)..(189): n is a, c, g, or t
  misc_feature (198)..(198): n is a, c, g, or t
  misc_feature (211)..(212): n is a, c, g, or t
  misc_feature (221)..(221): n is a, c, g, or t
  misc_feature (232)..(232): n is a, c, g, or t
  misc_feature (244)..(244): n is a, c, g, or t
  misc_feature (246)..(247): n is a, c, g, or t
  misc_feature (259)..(259): n is a, c, g, or t
  misc_feature (268)..(268): n is a, c, g, or t
  misc_feature (273)..(273): n is a, c, g, or t
  misc_feature (280)..(280): n is a, c, g, or t
  misc_feature (332)..(332): n is a, c, g, or t
  misc_feature (337)..(337): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (384)..(384): n is a, c, g, or t
  misc_feature (402)..(402): n is a, c, g, or t
  misc_feature (405)..(405): n is a, c, g, or t
  misc_feature (407)..(407): n is a, c, g, or t
  misc_feature (413)..(413): n is a, c, g, or t
  misc_feature (416)..(418): n is a, c, g, or t
  misc_feature (421)..(421): n is a, c, g, or t
  misc_feature (427)..(427): n is a, c, g, or t
  misc_feature (432)..(432): n is a, c, g, or t
  misc_feature (435)..(435): n is a, c, g, or t
  misc_feature (439)..(440): n is a, c, g, or t
  misc_feature (442)..(444): n is a, c, g, or t
  misc_feature (454)..(454): n is a, c, g, or t
  misc_feature (460)..(460): n is a, c, g, or t
  misc_feature (464)..(464): n is a, c, g, or t
  misc_feature (471)..(471): n is a, c, g, or t
  misc_feature (476)..(476): n is a, c, g, or t
  misc_feature (479)..(479): n is a, c, g, or t
  misc_feature (484)..(484): n is a, c, g, or t
  misc_feature (490)..(490): n is a, c, g, or t
  misc_feature (502)..(502): n is a, c, g, or t
  misc_feature (586)..(586): n is a, c, g, or t
  misc_feature (704)..(704): n is a, c, g, or t
  misc_feature (715)..(715): n is a, c, g, or t
  misc_feature (719)..(719): n is a, c, g, or t
  misc_feature (726)..(726): n is a, c, g, or t
  misc_feature (737)..(739): n is a, c, g, or t
  misc_feature (748)..(748): n is a, c, g, or t
  misc_feature (799)..(799): n is a, c, g, or t
  misc_feature (808)..(808): n is a, c, g, or t
  misc_feature (854)..(854): n is a, c, g, or t
atggttgttttatttgtntttagtatgatatgaggttagggattatgtgctatattcagtcttaaagagctgcacaagatgttnttgcacttttaatnttttttgntctattttgtttttttttttatangtttttttctnctaattttttgaatgtttgtatgttggggntgcgtgcttggttttgtngtggtattntaagttagtttcnnttgcagtgnttctgtttacntgtgtatgattncnngatttgtaaagnaatatttgngaaanaatgctnggtctctctagtctgaatctgtatctctcacctttggaatagtaatgtgaanaatgntcagggactatgttcnaaganattnatttaatgcagtgtaagttatngggctggcctttgatgancantntgttcnaannntgntttccngaaanccngcanngnnntcactccgantgaaanaacnatttctncaaantcncatcnaaaaanaaaacttacctnaccaatcatatggtatcggaatatttttcttttctaagcctagctctatgccacttattcctcctctcatgcagtgtttaacanattcttttcttcctttgaacttttaaaatatatcatctgtatctaacagtattcactatttgtgatttatccttcctctacatataagttcctttggttcatgatccatgaatgcttnatacttgcaantctnaggggangcacgatagtnnnttgcacatnaaaaggggtcaataaatatttgtagaatgagttatgaatgaatatacagtnctggaagantataattaaatacaaactcctcagacttctctcaacctttcctcanagggctcattttgtaa

SEQ ID NO: 605074 - DNA, 510 bp, Homo sapiens
gccgctagatcacgttgatcgatggtattccattccattgtttatttttccccctaaagactcccctaccggattaataagacagataggcccgggctacacttcctagaatagggtttattggtccccttccgggacttaaacactatctccctatatttgggtacttactaaaggcatctattccgggccccaatgatgccatcaggtactaggttatgaccctgatggcctccggattcctttaagtaaaacacaattcgaagcagtattgcccagtatctatcgatctgcaaatagctttctctgattacacaggacaaataaaacatgtcctccctgctgataaaatccttgatttcttatctcatactctggtaatcttgttcaccaaaatagttcactcccccataccttatgctttaacactgtttattgatggttctggtaaacatggaaaagcagcagtctggttagggatagctgtcgggggtaccccacgccttcgaa

SEQ ID NO: 605075 - DNA, 507 bp, Homo sapiens
ggtcgacgatctatatagcgatcataaagtgattttatgatcgttatatggggcattttggcgaggtgctggatcagcgctagagcgagcggcgaatacgttctgcttgattggccacgcgttcggcattcccggacagcccttcaaaagcataagggttcagcatctgtcggcttttcaggacttgaaggtcgatctcactgatacccgattcggcgcagacactcgaccaatagatggctatcgcctccaactgctgttcgatgatctccagtgcctgtgcttcttcgagtagaaacttttcccgtgcggcaaggcaaacggagagtcgactctggttattgttgcccagtatcagcatggcctgtgtggcctcggttcccgaacgcatctgtgggcagatatcgtaggccggcgtcagttgataagcttttccatcaaaaatgcagcatgatttacgccatgatcgtcggaatgctgcacaggatgtttaagacagtcgtagaa

SEQ ID NO: 605076 - DNA, 202 bp, Homo sapiens
aaaaaaaaaaaaaaaaaggttttccggttaatttcaatttttaaaatccattgagcccggttccagttgaacgcttattttccaagaaatttgggaggcttaggccggagaatggtttgaacccaggaggccgaggtttcaattaaccgaaattgggccactgtactccagcctgggcgacagggtgagactctacctcaaa

SEQ ID NO: 605077 - DNA, 749 bp, Homo sapiens
  misc_feature (4)..(4): n is a, c, g, or t
  misc_feature (65)..(65): n is a, c, g, or t
  misc_feature (68)..(68): n is a, c, g, or t
  misc_feature (110)..(110): n is a, c, g, or t
  misc_feature (114)..(114): n is a, c, g, or t
  misc_feature (118)..(118): n is a, c, g, or t
  misc_feature (129)..(129): n is a, c, g, or t
  misc_feature (166)..(166): n is a, c, g, or t
  misc_feature (175)..(175): n is a, c, g, or t
  misc_feature (180)..(180): n is a, c, g, or t
  misc_feature (196)..(196): n is a, c, g, or t
  misc_feature (198)..(198): n is a, c, g, or t
  misc_feature (214)..(214): n is a, c, g, or t
  misc_feature (216)..(217): n is a, c, g, or t
  misc_feature (241)..(242): n is a, c, g, or t
  misc_feature (252)..(253): n is a, c, g, or t
  misc_feature (280)..(280): n is a, c, g, or t
  misc_feature (300)..(300): n is a, c, g, or t
  misc_feature (304)..(306): n is a, c, g, or t
  misc_feature (312)..(312): n is a, c, g, or t
  misc_feature (331)..(331): n is a, c, g, or t
  misc_feature (351)..(351): n is a, c, g, or t
  misc_feature (360)..(360): n is a, c, g, or t
  misc_feature (421)..(421): n is a, c, g, or t
  misc_feature (428)..(428): n is a, c, g, or t
  misc_feature (437)..(437): n is a, c, g, or t
  misc_feature (509)..(509): n is a, c, g, or t
  misc_feature (513)..(513): n is a, c, g, or t
  misc_feature (541)..(541): n is a, c, g, or t
  misc_feature (545)..(545): n is a, c, g, or t
  misc_feature (554)..(554): n is a, c, g, or t
  misc_feature (558)..(558): n is a, c, g, or t
  misc_feature (573)..(573): n is a, c, g, or t
  misc_feature (723)..(723): n is a, c, g, or t
aatngtgaccatagcaggattcagcgtgcatatcattttattatcagaattatctgtagtatttncantttacactaactgaagagaattgtatggattatattatgtantatncttntccttcatttnttactaagcaatatgttcactatacatatatacatcnttattagancacanatattacatgatcatncngccattcaaaattaangnnccacagttttattacaatcaaatnncatccaaaanncaatgttgctatgaaaattcaaaagtnctcacacattcccatttatnaaannngtaggncacaatgaaatggaatttnattttgtacaaatggaaaanatttatcanaaatatatagaccaatatataacattgaagaacaagaagcagaaaggaaacaatgctcttncataaanatcaattcnctttgctgctgttggaataacaggtttcgcagggggaggcttcttgttgttcttagcctgagatttcccaantccnttgttaacttcaatgggttttccatagnagtnataattgcnatanttcaaaatctcttgngtaagcttccaacaatgctgaagtcattagatctcagatcagacttagaagtacaaacttttttgcatctggtctcaccaacctgcaaagtgctaatatgaacaggagtccctgttccattcacagtattctttttagccacatttccancttttccatctgcctgcccagcctaa

SEQ ID NO: 605078 - DNA, 630 bp, Homo sapiens
gctggatataagaaaaaatccactcattgatcattctatgatgaaagcagttatcataaaacgtcctccagaatggaaggagtgccaaatcgacgagtaccaggggatacgttctccatcagtgaatggaaccatccaaaactgctaagcagataaggagaactataattctaggaagtggtcgcaaattggaataagctactattagaattggatcggtttacaaagaaacacatgtaagtagtggttagaaaacaactcacctttggtgatatgaatattatgcggacccgcaccgtctttcccaccgtggtgtgtctggtttctttgccggggcgtactgcagtagacgtgcaaagaagaccacaggggttgcgcctattaatcaaatggacgtgatatagtgtaagtcagttgtcagcaatgcaggttttcctgtgatgtgtgacagtagagagtctcttcatcctctgaaggttgaaggaggttgatgattcttacagagagtgttcagtgggagtgcctgagagaatgagtatagaactaggaagcattaggggtaaaaatcgggtaggaggtgctgatagccatgatatgtgataaaggagtgataaggtttaaggaggataa

SEQ ID NO: 605079 - DNA, 132 bp, Homo sapiens
tgggttctgaggctaccctctgagccagaagcagtgcctcttgtatccagcagcgtcagaggtaccggtggctcatctgccatcatgctcagaacagtagggggattggaatgagggtctggctgctcgtga

SEQ ID NO: 605080 - DNA, 599 bp, Homo sapiens
  misc_feature (599)..(599): n is a, c, g, or t
gtgcctagtggctgctgtattgggcagggcagaaagttctaccgggcagcactgtgtctacaggctaacaatctaatgaagattaaagacagtctcacttcttttctgtcctatttgctacttccttgcagttcattcgttccttggtacatgtgtgcctcttgctttctaaaagacaccctgagcagtttccagctttattgaggtcaaatgtgcatgcaatggatgcatccattctcatgcacaagtcaatgagttttgactcttgaacaattgtgtgaacaccaccataatcaagacacaggacatttatattttagcaaaatattccctgtgtcctttcccactcattctgttaccggaaaggggtcccgatccagaccccaagagagggttctttggattctccgcacaaagggaaaggaaatttcagggggccagcggtccttggtaaaaaggtggaacaggcaaagtttacttaacgaaagtaaaagaataaaagaatggctactccatggctctagaagagcagcccgagggctgctgattggcccaatttcttattcgggtttactttactcattttggaactttcacan

SEQ ID NO: 605081 - DNA, 542 bp, Homo sapiens
  misc_feature (354)..(354): n is a, c, g, or t
  misc_feature (360)..(360): n is a, c, g, or t
  misc_feature (369)..(369): n is a, c, g, or t
  misc_feature (423)..(423): n is a, c, g, or t
  misc_feature (429)..(429): n is a, c, g, or t
aactgcatgagtgagttcatgggactcatccaaggtcactatgaggcaaagcaaggtgggttcctgccagggggagggagtctaccagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagaatggaaccattgctaccaaaatnaaaatnaaattgtgnaaaatttctccaaatatccagccttttggtgataatggaagaaggggttggttnaaaagnaaaatcacttttcataagtcaagtaactcagaacttttatggaaacgcatttgcaaagttctatggctgtcaccttaattactcaataaacttgctggtgttttgtggaaaaa

SEQ ID NO: 605082 - DNA, 1416 bp, Homo sapiens
gcttgcatatgcctgtgtccgtttgtgttacagcgccctattttgtgttgccctcaccttataggggcccgtgtccccccgtgttgtatttcgcctgtggcaccctcttgtgtgttgtttcaggggcccctctcttagtacgctgtctcttaaccacggggccccttgggggtttatttttctggtaagagattggggccctcatacttttctctcgcggggggcacccttctgatgtctcggaaagacatttgcagaatataggaagggtccgtgtttcctcacacccccaacgggggggtttttaaggggtttaaccaccgtggcgatacactcaatgtccaactgtcttgctccctctggctccccaccacccacccggggccattttttgtcgctgcaaaacattccgcaactcccgctggggtcccccccttaagttctgtccgaattagttccgccccccggctgtctttgccaaggtggcgttcgccaaaaactttgttggggttttgtttacccggggtccccatagcggttgttggtaaattgaggcccctcaaaatctttgtggagatcccgctataagagcgccccagcaccctcttgtctccgccctatagcccaacggtccgcccgcgaagttgtttttttgtctcccacaccctctcttggagaagagagatacttgtttcccccactctctctctctctgagtaaacccccactaagagtgtgcctctccctctctgtgaagagtctcccatcccacacttttaactctctctccccctttcctcctcccacacagtgtgtaaagcccccacagagagccccacagtttgtcgcccccctatgagagcctctgcgctctcactgtgtgtctgttcgcctctggcacactttgggcccccctcggggtgtcctctggagacacagagttgattttaccccctcgaaaaaggcacacaagccccacaggagtttgagaccacacacagcccactctcacactccaccgcacagaattctcgtcacatcacagggtctctcgcacacaatatatctactattctatagaaaggaggccacaggagaggccacagagagaaacacatcttgtcacacaccacattctctctcacaacgcacaatgtgtccccgacatccacaccccctcataacacacaggtcttcacaccccgcaaccaagttctcaccacgctcacacaccctctctgggacacacgggatttggctcattctatggacctcgtggagccacgattctaacctcgacacctcgcttttggtgtcggcctttcgaacctgaaaaagggtttctaccatttttttaaaggattgttttaaaaagaagaaaaaacctgccagtgaggccctgtgtggcttgccaga

SEQ ID NO: 605083 - DNA, 108 bp, Homo sapiens
cgcgtatgcgacggcgcacgcacgcagcgcggtaggttacgtcgcctaggcacgcgccgtcgcctacgcactgcgatggatcttcttgcgttggtgctcgacagggct

SEQ ID NO: 605084 - DNA, 1690 bp, Homo sapiens
gtcaagggagagaagtcaagaaaaggtgctctattgtcggggcacgtagcagtgcactgggctgccgtaagtgaactcacgcattattgctgagcttccaatcagacgctgggatctcgtcgaatttggaggatcgaacggagaagcttggtgggggacaggagttagagacacctcgatccccagcagaactgggtaagcgggacaggcgagtatgctcaagtggtgcatggttcatcgcatcgaggaacgtgggtgtggagtgggagccctaggccatcatggatatgctagtgcactcagtagtaatgggagcagtatcatgagcaagcgaacctgtggctaagggagcttgggaggccacatggctgtgtaccgcttgcagtaactaggagataataccagagtgtaagataatccttagtgaagagtaatagaatgtattacatttaaagaaaagtaagaaacagaatcaatacagcaacactgagaacagacacactgtgagagggaccccctagtgggttagcgcgaaggagtgggcagcgagtgaactgagagagcgcacaggaaagaggaagtgcgcgcgcggaagtgtgtacacacaatacaagtgggtgctgacacgccacaggggtcccacagacggagatgggtgcttccaagtgggccgaattacacccgttgtgagagataagaggttcaagcgcgagcgaagggaaagcaccctggaaaacaagatgatgggaggaagcacgcacatgatcctcaatatattgcagggataattcaagcgggaacaatgtgagttgtgaacccaggggagagtctcataatgttaaaaaatgtgtgtgtgacaaacatttacttggtaaagggcacaaaggcgcgtattcaagcagtggcaattcgttcccgccaccctaaaacttatctccggaaaacaacccaattgacaattgtggtgcgcttcaaaaccaacttggggggtgagcgggcaaaaaaccccttttcattggactttgcgaaggaaggagaaaatggttcgtgcaacaacaacaagcagcatgcaagtaatgcagccacagcggtgtatgcacacaggactattcatgccgacagcggacacagccaagcgaatcaacattggcacacaaggaacgggagaaagaatatggcaacacgcctaacaaaatatgggtcaaccaccagatggagatggacggaaaaaaccgccacatggacaatggaatcggtacccaacagcgagacagagaaaatatccataagaatcaggagccaaacaagggagtacgcgacaagcacgcagcgtcgagagaagcaacagcacgccgagaagtaaagcgtggaaaaccagggtaggtagtgcaaccacaaaccgacataaagcaagcaagtcacaaggagcaagccgacgtcagcgagcccaagactgacaaggaagcaagccacgcagcgggacaaagaacaccgcatagtagacaggagaagagagggaaggaagaaaagagcgatacacagtagacagacggtgcgcaagcggagcagaagaccagacacgcagacgggagaaaaacgcgaaaactgaccagcgaggagcaacactttagattaagcagcaagagaaaacaacacctaccgagacaaaacagtcggaacacgacaacaa

SEQ ID NO: 605085 - DNA, 678 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (26)..(26): n is a, c, g, or t
  misc_feature (59)..(59): n is a, c, g, or t
  misc_feature (90)..(90): n is a, c, g, or t
  misc_feature (101)..(101): n is a, c, g, or t
  misc_feature (112)..(112): n is a, c, g, or t
  misc_feature (114)..(114): n is a, c, g, or t
  misc_feature (125)..(125): n is a, c, g, or t
  misc_feature (159)..(159): n is a, c, g, or t
  misc_feature (178)..(178): n is a, c, g, or t
  misc_feature (189)..(189): n is a, c, g, or t
  misc_feature (194)..(194): n is a, c, g, or t
  misc_feature (206)..(206): n is a, c, g, or t
  misc_feature (208)..(208): n is a, c, g, or t
  misc_feature (215)..(215): n is a, c, g, or t
  misc_feature (230)..(230): n is a, c, g, or t
  misc_feature (252)..(252): n is a, c, g, or t
  misc_feature (271)..(271): n is a, c, g, or t
  misc_feature (307)..(307): n is a, c, g, or t
  misc_feature (379)..(379): n is a, c, g, or t
  misc_feature (553)..(553): n is a, c, g, or t
attgattcctaatnaanagaagnggncccccttcccccatgccccaaaaggccacaggnctcctcggccacaaaaaggattaaatccccntcttctcccanacttaaagtcnantggtggaagtnccggtgtttgtgtggattttactacaaggtcggntaataagaagagcctttcntaacatcctgnaagtntgtccccggaananaggaaancggtcttcccttccncaaacatgtgatgtaattctcnctctgcttgctgaggctgncctggcctaaaaggattagagcatttgctaaacggncccaggacatggcagggtcagagaacccgctgtgggagacccagggccaggatggccactagggggcggcanaggaagcgacacgcggagaggggtgtggagtgcttaggagaggcactcgtcggcttagcagcaatcaatgtccacaaagtacccatgaagttttattcatttttaaatttacaatgtccagctaagttatgagaattcaaaagaattgaactaggttcctggaaacaaaataancagatcaactgaattctatgtgcaagacaaacttttttttaaaataagaaatttaaaataccatgtaaaatatcagtcaataataaaaatgaagtgcaagaagtaaatctacagaaagatgcaaa

SEQ ID NO: 605086 - DNA, 1423 bp, Homo sapiens
  misc_feature (147)..(147): n is a, c, g, or t
  misc_feature (288)..(288): n is a, c, g, or t
  misc_feature (293)..(293): n is a, c, g, or t
  misc_feature (319)..(319): n is a, c, g, or t
  misc_feature (429)..(429): n is a, c, g, or t
  misc_feature (519)..(519): n is a, c, g, or t
  misc_feature (541)..(541): n is a, c, g, or t
  misc_feature (867)..(867): n is a, c, g, or t
gaagcttcagtgaaacatatagttagtctatcaagcagaacattcccgcattcccgtgtcagctatgcttgggttctagtcgtgaccttggaaccacaagcgtcgacgctaatcgagttggccacgttaagacatggcatgtgccgntatgcgcgtataattgcatcgttgttccatgacaactcgcattcattccaactctcatgctacttgatgattcgctctccaagacatctctactgtaggttagatgacgcagtcattgacgatgacttcgcgtgactgctnctctnctcctgcacatagggttcccgtaccntttcgaacacgcttctccctctgctatgctcgatacctcttgacataactggcaacaggatgattccctgaagtgcacttaccacgttatgctggtacaatattcagctncgcaaagcactctacaatggtatactttgatcgacactagacaagtttattccccccagtactagacgagacagagggatagagtacatnccacactgggtcccctactcgntatgctatactctctcgcgatatagttttctcgaagaaattactaagggttaatttctctgagcgaacattctctgtcgactcgataggtggctaataccaacattagataagtcacgcgctacttttgttaatccccagcgcttggataccagcgtggatatcgtcaattttgcacttattcagaccgaaggcgaaggcgtgcactagtgtcaaacagactttcttcgaaatgggtttgaatccacctcaaacggcaattaattgggttctaatcaatttataccctttgtggattgcattttaatacccctcaggtgtgatccnttttggaataaaagaaccaaaagaacacaacgattattatcaacccaggcataacaacaggaacccagagaggtgggttttgttatacttagagccggggcttcctaaggtgggccttcctttgaaaaaaaatcccttggtttgtgaatgacaacaaaaaactcctacgcgagtttgttgcgaactcggccgccagagttccggtccccttaaggaagaattaaacagtgtccccgcgccgttgaggaacgaaaactctgttgtggacacacttaaaggggggcccaccggtctcattttgtagacccccgttaattaagccacggcggccgcagttcgttaataccccccccttcttaatgaaaggcccaggacggcgccaggggggagagacaccacacaaagggcgtcgttgtcgagacacaaatatgttctccgcgagagaggagcagtgtctctcagagagggggagacaaaacaggggggggatatgacaacacacaacgggggtgagttctgcccgcgcggaggccccacgaattactacattttcacg

SEQ ID NO: 605087 - DNA, 685 bp, Homo sapiens
  misc_feature (66)..(66): n is a, c, g, or t
  misc_feature (185)..(185): n is a, c, g, or t
  misc_feature (196)..(196): n is a, c, g, or t
  misc_feature (201)..(201): n is a, c, g, or t
  misc_feature (213)..(213): n is a, c, g, or t
  misc_feature (215)..(215): n is a, c, g, or t
  misc_feature (222)..(222): n is a, c, g, or t
  misc_feature (237)..(237): n is a, c, g, or t
  misc_feature (259)..(259): n is a, c, g, or t
  misc_feature (278)..(278): n is a, c, g, or t
  misc_feature (314)..(314): n is a, c, g, or t
  misc_feature (386)..(386): n is a, c, g, or t
  misc_feature (560)..(560): n is a, c, g, or t
atatttaacggaaaaggggcccacctttcccccggcccacaaaagggccccgggggctccctgccnaccaagaagggtttggattcctcctccttcttccaaacgttaaaagtggaaggggtgaaggtccgggtgtttttgtgggtttttacttgcggggtcgttaggataagaagagcctttcntaacatcctgnaagtntgtccccggaananaggaaancggtcttcccttccncaaacatgtgatgtaattctcnctctgcttgctgaggctgncctggcctaaaaggattagagcatttgctaaacggncccaggacatggcagggtcagagaacccgctgtgggagacccagggccaggatggccactagggggcggcanaggaagcgacacgcggagaggggtgtggagtgcttaggagaggcactcgtcggcttagcagcaatcaatgtccacaaagtacccatgaagttttattcatttttaaatttacaatgtccagctaagttatgagaattcaaaagaattgaactaggttcctggaaacaaaataancagatcaactgaattctatgtgcaagacaaacttttttttaaaataagaaatttaaaataccatgtaaaatatcagtcaataataaaaatgaagtgcaagaagtaaatctacagaaagatgcaaa

SEQ ID NO: 605088 - DNA, 629 bp, Homo sapiens
  misc_feature (141)..(141): n is a, c, g, or t
caaaaaagcgcgggtaaagcccctggattgaatcccacacggctccactggacgcaagtttgttaggctaaaggaaaagattgttcgccgttctggtaaaaagcggggagatggccctaaattttgagagtttgggaacgncccccttgtcgagagggttcctggcaagcccgtgggtgttgagagctttcaaaacaatccccctttgggtcgctttgctgttcgtaaaattaaacaaacagttgcggggggggtcatcaaaccaatggacaaaaaggctgctggagctggcaaggtcccaaggtttgcccaggaagctcagaagggtaaaggaatattatccctaaaacccgccccccccctttttaatcaggggggaagacgggtttcaaaactgtttgtttcaattggccatttaagtttagtaggaaaagacgggttaatgataacaatgcttggtaaacccttcaaaaggaaaggagaatgttttgtggacccctttggttttttttttgggggggggcagttttaaggtattagtttttaaaaacaggactttttaatggaaacaacttgaccaaaaatttgtcccagaattttggggccccctttaaaaagttgaatgggga

SEQ ID NO: 605089 - DNA, 457 bp, Homo sapiens
agaaaggttcatctctgttagttgaatacacacatcacaaacaagtctctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttctatgaagatattcccgtttccaacgaaaccttcaaagctatccgaatatccacctgcagattctacaaaaagagtgtttccaaaatgccgtatcaaaacaaaggttcaactctgttagttgaggacacacatggcaaataagtttctgagaatgcttctgtctagtttttacttgaagatatttcctttctcgtcgacgcggccgcgaattt

SEQ ID NO: 605090 - DNA, 143 bp, Homo sapiens
gttactgatggagaccatgtgagcctttgctttcctctggccccagccccaatctgaacacagctcatacgcagaatcaggaccagcatgtgcagagctgtgcaccagcacaggcttagggcagttcagaacccacttgtttc

SEQ ID NO: 605091 - DNA, 180 bp, Homo sapiens
  misc_feature (13)..(13): n is a, c, g, or t
  misc_feature (43)..(43): n is a, c, g, or t
  misc_feature (68)..(68): n is a, c, g, or t
  misc_feature (71)..(73): n is a, c, g, or t
  misc_feature (76)..(76): n is a, c, g, or t
  misc_feature (84)..(84): n is a, c, g, or t
  misc_feature (86)..(86): n is a, c, g, or t
  misc_feature (100)..(100): n is a, c, g, or t
  misc_feature (102)..(106): n is a, c, g, or t
  misc_feature (109)..(111): n is a, c, g, or t
  misc_feature (116)..(116): n is a, c, g, or t
  misc_feature (122)..(122): n is a, c, g, or t
  misc_feature (125)..(126): n is a, c, g, or t
  misc_feature (132)..(132): n is a, c, g, or t
  misc_feature (134)..(135): n is a, c, g, or t
  misc_feature (139)..(139): n is a, c, g, or t
  misc_feature (141)..(142): n is a, c, g, or t
  misc_feature (146)..(147): n is a, c, g, or t
  misc_feature (157)..(157): n is a, c, g, or t
  misc_feature (163)..(164): n is a, c, g, or t
  misc_feature (167)..(167): n is a, c, g, or t
cctgattggactnggttatactcagacccttcgaccaggagtnaaattgactttatcagctttaatcnatnnnaanaacttcantncattatttcacaantnnnnnttnnnatttnaacttnaannttaatntnntttnannaaannatcatatttntccctnnaanttaatataaatta

SEQ ID NO: 605092 - DNA, 259 bp, Homo sapiens
atcacaggatcctggaattgtgtggtgttatgttctcatcttcctcacaagaaaaagccgtgatgatggtccaccagctgctctctctctctctctttatgaataaaaaatagttgtgtcttcatggtacattggagcagcgttccactccttgaagaagctctctgcaacaattctctcacgccgcatgatatggaaccggcggctacgctcaccactctcctcttcctgtacctttcaccgccataacaccacacaa

SEQ ID NO: 605093 - DNA, 363 bp, Homo sapiens
ttcatgtagagatcgagttcgatctgattgtcagcagcgtgtgcccagactgctatctacccgcagcgcacgatcacagtgagggctccaagcctccgtccccagtgctacctgcgacaccaggggagactgcaggccctgagaccaaaggtcacctgagcagcagcgcctgtagccagagacgggccttaggactgtgctaccgttagctagcagacgcactctattgctgtttgctctgcccgcttggaagacgacgtgtgtcgtctacttgatggtcaaactgccgcctcccacagagctgaggcctccccccatggctctgccagtgctcgcactgaacccacctcctacgcccagacc

SEQ ID NO: 605094 - DNA, 700 bp, Homo sapiens
taggcctgagctgttatgaaggagaagatggggacagagttcaccagagggctgacaggggaagacgaattctgttcctgtgagccgagcagccatggttgagagatggaagcaggcatgcaaagcaacgcctcactccaaagctgttccatgacgtggtacaggctggttccgagcatgctgtggccaccacccgaggggaccatgtgaaatgtgcttgagtgccaacaaattccatggtcacaggacatgtgcttgcattcaatagcatctggttaccttcttgcatcatgagacctcattggctgtctcccagaatgctgcatgttcttgtgaaatggttgtgcaaatgtgatagcatgcagcaaatgtgtgtgccaaatgtgaaaccagtcttgctggcagtttggttggttgcctggtgcgacacccagatggatgctgaatgcgcgaaccagcagccctgctctggtgtggaatgcacttctgtgttgtgtaccatcaaagtgcttaccttgtgtgctcttgccatatcatgcttggttgtccttgtacttgtctgtgcagacgcaagtggttgtagggcaggcctgtgcttgctggcgaattcatctgtgctggtgccctgccttccttgaccttccccaagcaggtgccgcatgctgctcctgagactggtggtcgtcttgggcctgcgagg

SEQ ID NO: 605095 - DNA, 505 bp, Homo sapiens
gctgaagaggtcgaggctgcagcaagctgtgatggcaccactgcactccagctaggtgacagagcaagaccctctctcaaaaacaaaaaacaacaacaaaaaagaaaagctgtactgagacagccccaacccaccagaaataactttcagagatacactgtaagaagcagctcgtgggttttatagatttgcaaagagtagagctagctcccagtatgcaggtgacattcagactgatgacttcttagattcaaagctaactaacagtctttctggtaaaatgaaatgggccaaaagataaggcaggacattcctcatggaactggagacatctgtaattcaatgcccaggcattacacatacgttaggacataacacctgtccctcaggtggcagtggacagaagcagctaattaaagcctaataactattgaccaataaaatagtaaaacaaaatacttagtaccttcttaagcatgttactcatctatcagaggcaagaaag

SEQ ID NO: 605096 - DNA, 102 bp, Homo sapiens
ggtggctccatcaagcccatgctggtcttggcctcaggtgacaaccagggcatccccatcatgtccagcatcaagctgaaagaggagcagcgataaccacca

SEQ ID NO: 605097 - DNA, 398 bp, Homo sapiens
ggcaaacggatcacgaggtcaggagatcaagaccatactggccaacatggtgaaaccccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcacttcagcctggcaacagagcgagactctgtctcagaaaaaaaaaacacaaaccagtttaagctgggtatggtggctcaccagcactttgggaggctgaggcaagtggatctcttgaggtccggagtttgagaccagcctgtgcaacatggtgccctgtctttactatacctaggcgccagaatccttg

SEQ ID NO: 605098 - DNA, 148 bp, Homo sapiens
ctctatatatagtatactatgaacaaaggtgggggaaggggaattgttactaaaaattcaacagtgaaatctatcttctgtaagtaggcttgataagaaacaccatctgcagcctggcgtggtggctcacacctatgtgacgttcctc

SEQ ID NO: 605099 - DNA, 385 bp, Homo sapiens
tatttccccctctattgatccccacctccaaatatctcatctaacaaccgactaatcaacacacacacaacaatgactaatcaaactaacggtcgagaaacataatgcactcatactctatatcagcaacacttttaaggacgaacctacacccgcttatcccctatactagttattactcgaagacgcatcagcctactcattcaaccaatagccctcggccgtacgcctaaccgctaacattactgcaggccacaatatctcatgcacctaattggaagcgccaccgctagcaatatcaaccattaaccttccctctacacttatcatcttcacaattctaattctactgactatcttaaaatccctctcgcctaacttccac

SEQ ID NO: 605100 - DNA, 533 bp, Homo sapiens
ggacgtcagtgcgagcgaccccgggccggctgcgtggagctggcgctgcctctcctgaagccgagggctaacttgagtgaagaggtctataggctttttcacttttggttatctgctcaggcgctccttggggtcgcgcatggtctcggacagggtttgcaaggacttcggagctaaccagtttggagccataaccctttcgtacttgccaaaaaactctgggcaagactcttgaattttgagccgcagtattctcgttcataaggtgagaataaaaacatcacctagggttgatgtgaagagagatgaaatcattgtgaaataggagagttattgctttcaaccaatgacattttctggaaacgtgctggagatatggctgcagcagtgacgcctgcaaacgacgttcctgtcatcatgatgctgacattttaattgggaagcagattgaaacgataactaaggaatttgacaggagcatttagtaggacctgtaaagaaattaaagcaggtccgaggtggagttttgtaaa

SEQ ID NO: 605101 - DNA, 120 bp, Homo sapiens
tgagggagtgttaccagcttacaccacctagtaccaccatgggccccgacgtggggcaggagcacgttgtctggaaagcgatccagatgatgggggttactccgtggacaaagatgctgt

SEQ ID NO: 605102 - DNA, 233 bp, Homo sapiens
cgactctacaggatctctccccgtacgccaacgtggtgaacctgtctctataaaacatacaaaaatttccagcctggcaaacatggcgaaaccccgtctctactaaaaatacaaaaaagttaggcgggtgccgtggctcatgcctaataatccccagtttctttgggcaggctgagtgtgggagatttgcttgaacctgggaggcggaggttgcagcgagccaagattgtgcc

SEQ ID NO: 605103 - DNA, 715 bp, Homo sapiens
gctaactggaagcttgccggtaaatggtgcatgatcgtagaggccgacgagtacatggaattgtccacttctattttgccacctcgacacaatgccgatgggtgcagtttggactgacacatcctaccactttatgtatcgtagcgatcagtgggtgaccgacgctgtgaggtactttgtcatacgacctccacgatctgtggataaagagcccgatcccttatatctgtgccaccatttgggacaccccgcaaggactcagtgcgggattcgcactgacttcaaggaaggactcgaacccttatctgaccccagcttgggcggacacctgtctttgccgcggtgacccttctctcatgaccctgcggagccttgaaccctccgagaatggaagggatggtacgcggagccagtgggggaccgcggtgtcggctgaggagccatccactcaggaatagcttctggataacgccctgcgggagctcggtcatacaggatggtactgaggaagtatgactgtgaatgagaccaaagagttaagagaggcaccagaaggaactgtcttgattagagatagctcgcattcagactacctactaacaatatctcgttataacatcagctggaccaactaatgtgccaatccaatacctacaccgcgagtggggtcatctgatcgactactatggtaacatgtgccaagatgccgacggtc

SEQ ID NO: 605104 - DNA, 186 bp, Homo sapiens
ctcatgcatgttcatcatgttagtgtcgtattttgagctggggttttggggctgcccttagagatagagaaacagaccctagcaatgtgctctattgcaatgggccacatacctagatttccagatgtcatttccccttttttattttaagttatgttaagattaataaaacaataaaagatcata

SEQ ID NO: 605105 - DNA, 116 bp, Homo sapiens
ttcccgattgtcttttccttaaggaaataaaatattatagttagggtagattgtgccataggaatagtatggagtgctagtgataagcatctcaggtctgcctaacctatgtgggc

SEQ ID NO: 605106 - DNA, 136 bp, Homo sapiens
gaattctctcactgctgcggacacggccgtatattattgtgcgagagatcgcgggggagtcatagacggcaactatcgcgaatattattatggcatggacgtctggggcccagggatcacggtcgccgtctcttca

SEQ ID NO: 605107 - DNA, 696 bp, Homo sapiens
cggcacgaagtatttccgatctagtcgcgcaaatttctcacatcgctcttcaagcggattgtcaggggcatttttcacttactcgggataccccacagtgacttattactctctaattatattatttatcaccatgctcaaaatacaatgccaagaaccatttttgcttaacatatttcatttatttataccttgtcacccagtttcactctaatcttttcttaagttatacaccttaccatcgcttattttcattaattaagaaaagaaccttattttttcccctaacgacactgaatactttattacaatatatcaattttttaatacaatcttcgccctctcttataaatattaataaaattcttgttacttattttttcccttttgccaaatatataacataagttttcttacatattagaatacaatcttaacttgacccttctgtacccatatatatacatccatctaggatgttctctctcagttccactcttttcttctaacttatattaactgtgtgaatacctgttcgacgggccgtacgtccactaacttaagtttatcccccaaaccctttccctttccgttatactcactataacactataatctgatatttgtcacatatttcaactactcacaatgttacttttaacatacttggatgactaactttaattgccacagatt

SEQ ID NO: 605108 - DNA, 388 bp, Homo sapiens
  misc_feature (158)..(158): n is a, c, g, or t
  misc_feature (336)..(336): n is a, c, g, or t
gcctaactcgtctggtcagtgtctgtgctactccatgtgatcagcgccacaacagtatttgatctagaaacggttgcatgtgcggtgtctgattctggctaagtatcgccacttgctccaagtgtggataaggtcgtcacacgctggtattttgattnagtaagatgggtcatatgtggcaggtggcttgattctgactagatgtctgctgctcgctccaagtgtgaatacagctggcacggccgcctgaatcgtataataagggctcaagaataatcatcgaaatgctctctctgagctctgatctcatatctgtcaactgctgcattcatactntcatgtcagatgcatagaattatgcagcaatacatgctgcgatgttagagtg

SEQ ID NO: 605109 - DNA, 136 bp, Homo sapiens
agaggataccgctcaccgtctccgactggcagcttctcgcgtggcccatggtcggccaggaccgccacccctatccccggtgaccacggcatatagcgtgggaaacggattactggagcggatggagcaactcatg

SEQ ID NO: 605110 - DNA, 1069 bp, Homo sapiens
ccgtgtaaatataacacgaccgcgtcggcttgtttgttgacttccccctccctatgagtgtccgcggcggcaacccacattcaccaacccccgttgttggtggtcccccctcccatatagtaggagcacaccgcgggggcgcgggtgatcaaagtccccgccggcccgcgtttatattcatagttgccgccgccgggcgggggggggagtccatcagtttgtctcacaccacgcctgctgtctctcggtgtggttagtacgttcgatgtggcccccgtctttgtgtggtggtggcacgctatgcatgtgacgaccagtgttttgtggtcccgactcaaaaagcgactttggggggtgggtgttgcgtgccgcgcggattttatcctccggcggggtgtgtttgtgtctactcccacgcggcatgcttttggtggggggcgcgcccacctctcatagaggtgtttattgactactacttctcgctgatgccacactcgatgttgtttgttctttggtccgcgccgctcgagtctcgacccaccccccccccctctcgcgttgaggtttgtgtatggttgttttgtattgttgtattaccgcagcgtgctagttttctctcgttctcccaccgctgtcggggtgtgggactagtgggccccacacacgtgcggggtcctccgtttagcgatccgccactcacctctcgcggggtggggaattgactccacctccccccccaccccgctctctctctctctcacataggcgggtgggtgtacaccactggtggcgccccccccccccggcgaatatttttatgtttttattataataaaggaggggtgttcttcactcttcttttcgccaccagccagcggtgttgttgtaatcactctctcgggggtagaacagggtgtgccccgccgcctctccccgctcccccgcacagtggcgggggttgggcggcgcgacgggagccacctccccccccccccctttttttttttttctagaaaaaatttttttttttttttttttttatagaaaaaccacacacaaagatgagata

SEQ ID NO: 605111 - DNA, 305 bp, Homo sapiens
cctgactgcatcttgctgaggggcatttccatgcccagaggaactagtgaggataggagtagtcaggacggaggtccgaacgtgacatcactctcgcctggctcccgcgtcccccacaccaatgtcagcttcagcgccttgagagcaagttcccttttatacgatgagtctccctggcaggcctttttcatcaggagccgcgacaggtgagggagagtgtctccggcagtgctggggatagtggcacccatgtagtgtgagcttactatccgggagcacagggcgacctgggcagcacaggtgaa

SEQ ID NO: 605112 - DNA, 160 bp, Homo sapiens
  misc_feature (34)..(34): n is a, c, g, or t
  misc_feature (153)..(153): n is a, c, g, or t
atatcacttgaatcacactatcagagcacagcgnatagtgacagagaaaacgctatgagtagtgagtgagtgcaggagcggcagcaggtccttggagtcactcagaggctgtggagatcacgcgggtaaagctgagctgattattgaatgaanactcact

SEQ ID NO: 605113 - DNA, 441 bp, Homo sapiens
actggggttattgagggagataagtgaaaggcaattttaatgtttatctttatactttgtaaaaagtattcattttaaatatgaaaattataaaataattcaataatatgtcttttttagaatatacccagatgttattagaagttttatattatggtataatttatatcattacataatttataacataatcagtccaaacacacatacttcctctatgaacttcataactatttagccacattcaagcccagagattactgaaatgctggaactgctattatgagacttttagtagggcactcccagaacactcctttaaaagtatctctgtacatcaaacccataatagttacctcagtttgtataaagttgcctgtagattcacatgagacaagagtgtaacatttggagcccagatcatttcttagcatggtccaa

SEQ ID NO: 605114 - DNA, 206 bp, Homo sapiens
cataaggcttcgatacgggataatcctatttattagctcagaagtttttttcttcgcaggattttactcgagccttttaacacgtccagcctagcccctaccccccaattaggagggcacaggcgccccaacaggcatcaccccgctaaatcccctagaagtcccgtacatacaagcacgcgtgattgcaggccggtacatgccag

SEQ ID NO: 605115 - DNA, 254 bp, Homo sapiens
agatggtcagcagacgtaagagtcagaagtaggaagagaacgctcggaaggctggttgggtcatgcgagatcattaaaaatggctgaccctaacaatatgtacaagaaatataaaatgtagataaagagatacaaacaaatgtcctttttagagtacttttaagaaaaaaagcagggccgtggaagtttgggttcttttttcctccccggttgcaaattctcatggtttgggttgggtggtggagatgtgcgag

SEQ ID NO: 605116 - DNA, 282 bp, Homo sapiens
acgatactgaactttgctagactacatgggccatcaatttaagaacaaagcttggaagaaagcctttaagtaggcacttaaaagaattgagaaaataaagtgtaagttatttccgttttatggtactctccaccctcattacagaactgcatattttaaagcattctcagtgctagagtaagtaggtgttacaaagatgctgctgctgaagaaaagatgaatggaactaagatgtcagcatactgcagcccagtgacagaaccagtctcaaagctcttgcag

SEQ ID NO: 605117 - DNA, 352 bp, Homo sapiens
  misc_feature (8)..(8): n is a, c, g, or t
ggctcagnagacccaccccaaaatgctcacactctggctactgctactgctgtgagtagttaactgtctttcatcgctgagccaggagtctcttgttttctaccagcatccatgaaattgtgacaggttaacttgttagccacaagcagggtaaaatctcacgttcttcacacatcttgacactggtctttatttttattttattttattttatttattttttgagacagagtctctctctgtcacccaggctggagtgcagtggtgcgatctcaactgactgcaacctccgcctcccaggttcaaccaattctcatgtctcaggctctccgagtagctgggactgcaggcc

SEQ ID NO: 605118 - DNA, 763 bp, Homo sapiens
  misc_feature (47)..(47): n is a, c, g, or t
gggagtgtcaaacttgacatcagcctgcgagcggagcatggtaactnctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattctatttggcatttcaagatgttggtgcttgtgttgccttggtgtctgtgagagtatacttcaaaaagtgccatttacagtgaagaatctggctatg

SEQ ID NO: 605119 - DNA, 768 bp, Homo sapiens
gggacagcgaagcaaggacgtgtcctgacgcctgtcctagagcctggagaggaccagaggcgacggctgtgatacacgggccaggcaaggcggtgttggagacatggtgtcgcgatgtctcgacgagaagagaggacagagaggatcacggagcgtgacgcgcatgcgttgccggctggccggagaggcagcgacgtgcggagcgtccggcaggacagtgccacagatagtcgctcggagagacgcggcgtcccatggagaaatgagacgcttggaccagctagtgcgtactcattgcaacgtttcgcgctgaaccaccgtgacgtctgccattgaaggcaaggatacagaacgacgaagtcaatcgagcagcttgtgttggttgcactttgctcgattagttacaaggccaatacaacgtctactctaggaatttcaagacaacgggcgtagtggcacaggcaaaggctgggtaattgtaccaatctcgaagttgcttgtgtcactataccggatcgaaagcatcgcgcgtggaatctcagagctcgtgtaagtgagacggaagatagtacagggccattatgttccgaggcttgggggctaccctggaccttgtaccgaatagggcgttacgggagtagatgtgccgcaaaccgaaacactttggggggaattcaatgcttaaacatctggacgattccaatggcatgcacttaactgtcctgaccagtatcatactaatagtagtaatgctgtgacacctaatag

SEQ ID NO: 605120 - DNA, 387 bp, Homo sapiens
actttcttcatatgtatacgagcataaagggaatcaatgcaaatggccgctctctgttataaaaagctgtgtataagccaccttccccttcaccaatcgaaatgaacaaagcatccaatcccgtggagagtaggcatccaggtcacgccagaggatgacgattgtttattcaccgtcatctacagtgaatttgccccacacaggaacacatagcagcaggatgtgggaatgaccatttccatgtgttgtcttgttgactgtgagaggaacaattaccagcaagtagtacggcatgtattaatgacagtcaagagcaggcggtaggcgatttgtcgtcttcggagatctcaagccttgcttactcaccaaatattgagtaacacttgc

SEQ ID NO: 605121 - DNA, 306 bp, Homo sapiens
cgtcgttaaggacatggaggaagaacagcttacttaatggggtgtgtgcctgacttcgagctgctcagtgacccttaggatgaacacttgtatgccaccctgatgcagctgttgagggagagcctggccaggcgcggttgggctctcgatgccctgcgcggcttggtgatcgctagccagttggtaagccaggtgggcaaagaactactgggcctggcctacagcgagccgtgctggctgcggggggcgctgctggacgtctgccgtggagcagggcaagagctgccaaagcggtggccaagttgg

SEQ ID NO: 605122 - DNA, 254 bp, Homo sapiens
tgtctttaatgtagggtgactcagtgctctgtcttagaacttgcatactataactgcctcctgttgacaacacttagttattggctatcacactgttaaggattatgtgagttcctttcttctcgcaaaccctttcacttattcatctagtgttgctccttacgctggatcatgtccagtgtactcgttctcttatcattatagggatgaaagcgtgtccacaagaatctatcaggcttcctgtgcccgtcctt

SEQ ID NO: 605123 - DNA, 742 bp, Homo sapiens
gtccgtcttttgatgggcaccggcccttctgaactgtgatgggacctgccttgctccactagtagctgggcagctcacaattcacaccttgtgtacctgccacatcccctcacttggttggaaaacatcccagaaggtcttgagtcccaccacccactgggtgtcagtccaaatgactgtataggaggcccttattttggtcacagagcaagctggccatgaacgaaggagagaagacgccacagatttccttccctctcctccaggagactctataagatagatcccccagtcctgctcagcccgtattcccatgcctccctctcattggaggagctgaccaaagcagccctaatcgggccataacacttgaccaattcagctgctggcagagggaggaaacaagtgttttcccaagtggcattgtcatctcgctttcaccctgactaaagacttgtcttaaagcagcagcccgagccgcgtcccagccccaggtgcgttagtggcggaggagagcgtggcacttcctccatggtcggcaaatggcgactctatactctccgcgccgcacccagggactggatggactagaaaggatgcctactttttcttagtatcagatgcagagactctatgtatctcccaaagagcactattttctgcagcggtgatgaacccctgtatatattccgtactgtcagagctaacaccaaaattgaagaatggtaatgttcgagctatc

SEQ ID NO: 605124 - DNA, 222 bp, Homo sapiens
gggacttcgatttcgaaatgaggagggtggtactatgtaggatttctagtacatagtctacaggttgtgatctatcactgtcatttttgagcctcgcgttgtgccatagtgtggccagttggtgacgcctgtgttctatttgacaagatcctaggtctagtcaacactttaatggcaccaacaagacagttcccatgagcactcagcccatctccttgcctg

SEQ ID NO: 605125 - DNA, 209 bp, Homo sapiens
  misc_feature (1)..(1): n is a, c, g, or t
  misc_feature (198)..(198): n is a, c, g, or t
natacgccttgcaggaactagtgcccatgatatcagccaagcagctctgtgttctagtgcccatcatcatcagctgagcagctctgagtgtctactgcccatcatcatcagccgagcagctctgagtgtcctaggtgcccatcatcgtcagccgaggcagctctgatgtgtcctagctgcccatcatcatcagccgangcagcacttag

SEQ ID NO: 605126 - DNA, 939 bp, Homo sapiens
gctcggcctcccacgatgctgggattaccagggcgtgacccaggcgcctggcttcgccctttgctgttggataccctggaattagtttgttgctatgcttattggatgaagtctggttgcttggaagttcactcaccggcttgccgatctgttgtatgcccttcccatgtccgttcttattagtcactatcttacagtgccgttttgagattaagattgttcccttcttccagaggatggtgctttaaacactgattttccatagctgaggagtctaatctggtgctgaatctcttttggctttaccctaataccagttgtcctcgattcagtcataaaccacttgggatacactgaaaaggctaggtttactaaaatgtgctcggagtgtggaggattcaaacgtgtgttgctcatggagaatttagaatcgcctgtctacttgtgtttcattattcttctaagacgtattttgaataattacctgcaagttgttggaataggtacttctcgaaattcttaagaggttaaatgtattatggtcttcatttgaggggtgcttatatcttttggtcgttgtagctcctatggttgcgtctccaaaattttagggggcaataatgttccggaagttttgaactttatagtgtttacataccagtctgtagcgtaatgagtccctgtgagataattcataatagttcagtgtggtttgtaccagcaaggaaccataaatgcacagtgaatccaactctaagttgatcgtgctttccaaaatattttacgttttcctttgttacttcttttacaaatctccttgctttttgtgagaaattccttgaggaagggttttaatatgggggccttcctgtcgtggctttccgtgttaacttaaaggtctatttgaattttcaaggggcgtaatatggttgagtaatg

SEQ ID NO: 605127 - DNA, 960 bp, Homo sapiens
  misc_feature (758)..(758): n is a, c, g, or t
agcgcagtggcatgatcttggctcattgcaacctctgtctcccgggttcaagcgattcttctgcctcagcctctgaagtagctgggattacaggcacgcgctaatttttgtatttttagtgcagacgggatttcaccatattggccaggctggtctcgaactcctgacctcgtgatccaccctccttggcctcccagggtgctgggattgcaggtgtgggccaccacgcccggtctctttttttttttttttttttctccccagttttgttgattgaccatttttaaaaaaggcttgtgtggctctctcctattctattacagacctccagagtctgggaacaatttggatgcgcttttactggaatctcttcctggaaatgttcacattatgggagtggggaatcagtttttggtgcctaatttttattcacgaagaaggcttcctcttctctactctccctttgtgtgcaaaccccattcttcgtggattagcttagaacaagggaacctttcagaaatgtggccttctttggttgcattgacccaccttgttttgccacctcataggcctctaatcggtcctcatattaagtggggggcgacataatttctcagaagttcttaccccttttcgtgaagttagtcacataattaatttcccatagtgccaattttctttataaaggctcctcgtgaagtgctttgccccttttttcaacactcttggggcgcctatacttttttatagcccctctntttagccatactagagggacgggggagcgggtggacattttccctatagatacttcctcacagataacacagttttgcggcattggtttagtttgaccgagcgaaccattggtggtgaattccccttattttgtcccccacttcttcctttacgctttctgcggcgatttggggtgaaccccctttgtttcccttaattctg

SEQ ID NO: 605128 - DNA, 469 bp, Homo sapiens
  misc_feature (32)..(32): n is a, c, g, or t
  misc_feature (45)..(45): n is a, c, g, or t
  misc_feature (69)..(69): n is a, c, g, or t
  misc_feature (179)..(179): n is a, c, g, or t
  misc_feature (199)..(199): n is a, c, g, or t
  misc_feature (301)..(301): n is a, c, g, or t
  misc_feature (334)..(334): n is a, c, g, or t
gaatggaatggaatttaatggaatggagtcgnaggaatggacagnaatgtagtgtactccaatggaatngaatggatcaaaatggatttgaacagattggtatgaagtcgaatggaatgcactggaatggaatggactcaatcagaacggactggagaggaatgtaaacaattggaatngaaacgaatggaatggaatnaaatggaatggaatgcaatggaattgaaaggaacggaatcaaatggaatcgaatggaatggaatggaatggaatggattggaatagaatggattcaaataanatagaatcgattgcaatggtatacaatggaagngaaatgaatggaatggaaagcaatggaagatattggaatcgaatggcatcgaatgaaatgtaatggaacggaatggaacggacccgaatggaatggaatggactcaaatgtaatggactcgaatagaatcgactg

SEQ ID NO: 605129 - DNA, 814 bp, Homo sapiens
cggaaggccttagaggtcagcatatgtgatgttaatggccctcagtagtccttgagtactgagtgatatcgccccggtaacaggtgttgctagaatgggctatgaaagcagaggagaatagctgccaaaggaagtatgtatcgcattaatcagggcgataactaagtattgctcggctgtcagaataatacttatttcacgtgtgaaagcaacatggatgtgattccgaacacagaagttagcatgacccgttttgatgtatacaaactaaatagcataacgagttactatggttagacatacagaagttctgtgatgcatgactatgatggttatccacttaagatcaataggtagaaggggatctgagaaattatgtaatagggagtgggaataaaagtacttaattcctgtggggaggttatatttgtaagttcaaatgcatggttgaaccttggttagttttattctgttaggacagaattgaaggaaagagtattatagccagagtgtagtaggctagggggatggtaagaactctgtaatagaatgtcgtgtggatgttacctttttcgagatccaagcatatgaaaagcctgtatattttttctaaagaacacatcttaagtaccacgctttacgagattataaccagttgactggtccctctggtaaggatatggttacaagtgctaggaaataactcactggatacctggtgaacatacttgtttggctagagaggggcataaaaaatgcaccaggggattttccgaaaggtgacacaggggttagaagcccgaccttagggggg

SEQ ID NO: 605130 - DNA, 837 bp, Homo sapiens
agagggagtcctcgcggacgtcagccacgatgccagactgactactatcttgacgttgcccctttctagaatcgtcccagtgcatctaaaatggtccctcagattttccataagacctcgtgagctgttcgtcccgagtcgtacgagctgtccccaagcgtgtcccgagaccaaaacgaatgaagacgttagccaagacccaatatatggaatgtagtggtggctggatggtgtccgcactccatttttgctgtcgtggcacttcatataaacgacctgatgccgacatgattgtggtctagagcagcgctctacgggttagtgcatcggagcagtgtccctaaggaagtagttgatcatatcatctgtggtacagtcacattcaggaagtgaaagcaagcaatgtggctagagaggcggcccttggagcgtggcttctctgacaagactcctgctcacactgttcaccatggcttgtcatctctggcaaccaagccatgagccacaggtgtggctggaaatgctcacaggccagtgtgatgtgatcgggaggtggcgccgagcaagaggtcgggatggtcccctattcggtcacttcccgggaaaccgaggaaaaatggactggctgatcctccaatcagggcacatcaagggccaggcgactggctagaacccgaaaatccgaccacatcatacattgaactccggggtcgccgacaccacacatgaccaggccacttgcaaccaggccgggccagcggatcgccgaccgcacacaccgcgcccacaccacaaggcacaagaggcctcagagggcacccgcacgcagaagccaac

SEQ ID NO: 605131 - DNA, 117 bp, Homo sapiens
agagttacttaaaaaaaaaaaaggaaagcaagcaacagtaactgggggtttgggggcagcagcatctgaattttatttggtggctgggggacgtggtttcagaaactttgcccaaac

SEQ ID NO: 605132 - DNA, 387 bp, Homo sapiens
  misc_feature (187)..(187): n is a, c, g, or t
  misc_feature (224)..(224): n is a, c, g, or t
  misc_feature (299)..(299): n is a, c, g, or t
  misc_feature (301)..(301): n is a, c, g, or t
  misc_feature (304)..(304): n is a, c, g, or t
  misc_feature (318)..(318): n is a, c, g, or t
  misc_feature (333)..(333): n is a, c, g, or t
  misc_feature (354)..(354): n is a, c, g, or t
  misc_feature (358)..(358): n is a, c, g, or t
cttcccctatcatagaagagcttatcacctttatgatcacgccctcataatcattttccttacctgctcctcgtcctgtatgcccttttcctaacactcacaacctaactaatactaacatctcagacgctcaggaaatagaaaccgtctgaactatcctgcccgccatcatcctagttcccctttnaattccgggcctcccatcctacgcatcctttacatanagactaggtaaacgacccctccttaccatcaagtaattggccacctggtactgaacctacgagtcaccgactacngnggnctaatctttaactnctacatcttccccantattctagaaccaaggcgaanctgngttccttgaccgttgactcgagtaggctt

SEQ ID NO: 605133 - DNA, 2191 bp, Homo sapiens
attttttaatccattctgtggcttgttccatgcctgagaacttttgacatcctgtgcccagacttaaactcaccccttcagtgtgtgggtttagggggagaagtgaaggttgacacattcatatcaacaacatagtctactttaccatccaacgatgtattttgatatcagccaagtatttctctctacaactgtgagcaatgctaatccactccagccttcttacactgtaatgataccttttctttgtcctctctggaagtttctagtagcatatctccaaataattattgaatttgaaagcctcagctggacaagtcttctctgtggttgaattgtgacaatgtctgtgttccttaaaaaaataaaaaataacataaaaccaagtaaggttagacaaaacagttgaaagtttaaaatcccttggcctcatctagttcagtggagacaaactttctaaatgggaggagggccatgtaatgagaggagaggagaggagagaagtatttgatgcactcatggcctcagggtcagggagacctggaggagcagtggagatggtggagagccagagaacaggtgccacctcccaagaggcagcctttactcacctctggctgattggcggggttggggatgtgggtacaggcatatcagacctttagatttttttttcaagaaaagccagaaatctggatcttttttttttcctttaagagatgtcatctcactatgttgcccaggctggtcttgatactcctgagctcaagcaatcctcctatctcggccccccaaagtgctgggattacaagtgtgagccaccgtgcccagcctggatttttttttttatgttaaatatctcgattttttttctagcattggctgacttcacatgtataaccaccacttgcagacaaagcgaaccaccacgtctccaggccaaattccagctgccagcatgcagcctctgatctgattctcttgtagaagccattctatgaaaagaagggaggctatctggaatgttattggatgccctctatctgccagttactttgcaggggtcagcttttactagtttgccttttttttttttcagatgaggaaactcatgcctacagagtggttaaatgtgaagtgacttgtcaaatcacacagctagtaagaggaccagtccaagcacctgcatctcaaaggcacagatgttttgtcctacaccttactacgtagggatttcgaatctgagtgtatactcaagattctgaatcataactcaaggttgacaccagtaacaaaaccgtctggttggatgagttcaccagatgggcctcttatgggaccatcccaaaatgacaacatacatactcactatgaaattcattggcaggaattttgtagggcatgtagggtaggaagatgggagggtgggggaaacctacaaacctagtattttgtggggtatcatcacagctctggactgcttcagttggcaaaaaaatggatgtattgccaaataactatcccacttaggtttagggtaattaattaaaggctagagtgttgccagcacctttgatatggggaaccggatgcattattagctcagatctttgggtgtggtgactcatgcctgtaatcccagcactttgggaggcagaggtgagcagatcacctgaggtcaggagttcgagaccagcctggacaacatagtgaaaccctgtctctactaaaaatacaaaaattagggccaggcgcagtggctcacgtctgtaatcccagcactttgggaggctgaggtgggtggatcacctgaggtcaggagtttgagaccagcctgaccaacatggagaaaccccgtttctactaaaaatacaaaaaagttagctgggcatggtggcacatgcctgtaatatcagctactcaggagactgaggcaggagaattgcttgaacccgggaggcagaggttgcagtgagccaagatcacgtcattgcatcccagcctgggcaacaagagtgaaactcagtctcattaaaaaaaaaatagccaggtgtggtggcaggcacctgtaatcccagctactcaggaggctgcggcaggagaatcgcttgaacccaggaggtggaggttgcagtgagctgagattgtgccactgcactccagcctgggtgacagagcaagactctgtgtc

SEQ ID NO: 605134 - DNA, 1525 bp, Homo sapiens
  misc_feature (185)..(185): n is a, c, g, or t
  misc_feature (198)..(199): n is a, c, g, or t
  misc_feature (207)..(207): n is a, c, g, or t
  misc_feature (234)..(234): n is a, c, g, or t
  misc_feature (762)..(762): n is a, c, g, or t
  misc_feature (849)..(849): n is a, c, g, or t
  misc_feature (876)..(876): n is a, c, g, or t
  misc_feature (909)..(909): n is a, c, g, or t
  misc_feature (942)..(944): n is a, c, g, or t
  misc_feature (947)..(947): n is a, c, g, or t
  misc_feature (950)..(950): n is a, c, g, or t
  misc_feature (952)..(952): n is a, c, g, or t
  misc_feature (955)..(955): n is a, c, g, or t
  misc_feature (958)..(958): n is a, c, g, or t
  misc_feature (963)..(963): n is a, c, g, or t
  misc_feature (966)..(966): n is a, c, g, or t
gggggctgtgacgctgatgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtantggctacccacgnnagctggangctaccctgcgcctggaggttatccangcccctggaggctatcctggtgccccgacatgcgcatggggcgagctcctagtccttattcgccggtgagtgtcactcctatgtgcacacaggactttaggaagtgcccactcagggtggcatgcacggactgtttctcgcgtgtactccacagcgcaccttcacagtcttaatggaagagtaggtccagtcacatggttccatctacctggtggctttcgctgtgatggactagatgtcgcttcatcagtaatcctgtgatggaccagatcgctatcttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaantatggaagaactgatcctggccctcttcatgcctcctacgtattacgatgcctggagcttacggaaagcaatgcagggagcaggaantcaggaacgtgtattgattgagatttngtgcacaagaacaaatcaggaatccgagaaatngtcagatgtatcagtcagaatttggacgagacnnnganatngncantangtcgnatnacatcaggacattcttgaacgtttacttgtgtccatgtgccagtggaaatctgtgatgagaaccagagtataaatccaccaaatggctcaggaagatgctcagcgtctctatcaagctgtgtgaggggagactatggaccgatgaatctttgcttagcatgatccttgccagaataagtctttcctcaggtgagaggtaccatggaggcttattctaggatggtaaatcgagacttgtttatgcagtgtgacccgtgagttttccggatttgtgcaaacgtggttgacgacatcttgcctgggtcctgaaccggctgcttcttagtggagaggcttatatagtatgaaaggtgtcgggcagatgatcccccctgtgcgagtgtggcacccaaaggatagcctggtcacgaacacatgtggctagtttttaaaccggcggcgttcgtgcgccctcgggacacacacactttggtgggggcagagagcgtagaaaaaacaaccctccccaacagggggaacaacacaaaaacgcgagataggagttgaattccacacacaa

SEQ ID NO: 605135 - DNA, 1550 bp, Homo sapiens
  misc_feature (185)..(185): n is a, c, g, or t
  misc_feature (198)..(199): n is a, c, g, or t
  misc_feature (207)..(207): n is a, c, g, or t
  misc_feature (234)..(234): n is a, c, g, or t
  misc_feature (267)..(268): n is a, c, g, or t
  misc_feature (288)..(289): n is a, c, g, or t
  misc_feature (300)..(301): n is a, c, g, or t
  misc_feature (305)..(305): n is a, c, g, or t
  misc_feature (311)..(312): n is a, c, g, or t
  misc_feature (787)..(787): n is a, c, g, or t
  misc_feature (874)..(874): n is a, c, g, or t
  misc_feature (901)..(901): n is a, c, g, or t
  misc_feature (934)..(934): n is a, c, g, or t
  misc_feature (967)..(969): n is a, c, g, or t
  misc_feature (972)..(972): n is a, c, g, or t
  misc_feature (975)..(975): n is a, c, g, or t
  misc_feature (977)..(977): n is a, c, g, or t
  misc_feature (980)..(980): n is a, c, g, or t
  misc_feature (983)..(983): n is a, c, g, or t
  misc_feature (988)..(988): n is a, c, g, or t
  misc_feature (991)..(991): n is a, c, g, or t
gggggctgtgacgctgatgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtantggctacccacgnnagctggangctaccctgcgcctggaggttatccangcccctggaggctatcctggtgccccacagcanngggagctccatcctatcccnnagttcctccanncaangatttnnagtcccaccaggtggagcaggcttgtcggtgggtatccacgaggcgacgccttcagcaggcttgatggaggtgggtccaagcgaacgaggttccagtacctggtggctgtcctggaggacaggatgcccttctcagtatccgggaggacgaacctacttaccctagtcagatcaagtacagattctgttgtcttcctatccctgttttctctcctgttcgttggcttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaantatggaagaactgatcctggccctcttcatgcctcctacgtattacgatgcctggagcttacggaaagcaatgcagggagcaggaantcaggaacgtgtattgattgagatttngtgcacaagaacaaatcaggaatccgagaaatngtcagatgtatcagtcagaatttggacgagacnnnganatngncantangtcgnatnacatcaggacattcttgaacgtttacttgtgtccatgtgccagtggaaatctgtgatgagaaccagagtataaatccaccaaatggctcaggaagatgctcagcgtctctatcaagctgtgtgaggggagactatggaccgatgaatctttgcttagcatgatccttgccagaataagtctttcctcaggtgagaggtaccatggaggcttattctaggatggtaaatcgagacttgtttatgcagtgtgacccgtgagttttccggatttgtgcaaacgtggttgacgacatcttgcctgggtcctgaaccggctgcttcttagtggagaggcttatatagtatgaaaggtgtcgggcagatgatcccccctgtgcgagtgtggcacccaaaggatagcctggtcacgaacacatgtggctagtttttaaaccggcggcgttcgtgcgccctcgggacacacacactttggtgggggcagagagcgtagaaaaaacaaccctccccaacagggggaacaacacaaaaacgcgagataggagttgaattccacacacaa

SEQ ID NO: 605136 - DNA, 1467 bp, Homo sapiens
  misc_feature (185)..(185): n is a, c, g, or t
  misc_feature (198)..(199): n is a, c, g, or t
  misc_feature (207)..(207): n is a, c, g, or t
  misc_feature (234)..(234): n is a, c, g, or t
  misc_feature (267)..(268): n is a, c, g, or t
  misc_feature (288)..(289): n is a, c, g, or t
  misc_feature (300)..(301): n is a, c, g, or t
  misc_feature (305)..(305): n is a, c, g, or t
  misc_feature (311)..(312): n is a, c, g, or t
  misc_feature (704)..(704): n is a, c, g, or t
  misc_feature (791)..(791): n is a, c, g, or t
  misc_feature (818)..(818): n is a, c, g, or t
  misc_feature (851)..(851): n is a, c, g, or t
  misc_feature (884)..(886): n is a, c, g, or t
  misc_feature (889)..(889): n is a, c, g, or t
  misc_feature (892)..(892): n is a, c, g, or t
  misc_feature (894)..(894): n is a, c, g, or t
  misc_feature (897)..(897): n is a, c, g, or t
  misc_feature (900)..(900): n is a, c, g, or t
  misc_feature (905)..(905): n is a, c, g, or t
  misc_feature (908)..(908): n is a, c, g, or t
gggggctgtgacgctgatgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtantggctacccacgnnagctggangctaccctgcgcctggaggttatccangcccctggaggctatcctggtgccccacagcanngggagctccatcctatcccnnagttcctccanncaangatttnnagtcccaccgaataaagcaagcttttctagatatccacagccaccttcacagtcttataaaagtaatccagcacaaattccactacctaatagactttcctaaaagacagataccttctcgatatcctagaaaacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaantatggaagaactgatcctggccctcttcatgcctcctacgtattacgatgcctggagcttacggaaagcaatgcagggagcaggaantcaggaacgtgtattgattgagatttngtgcacaagaacaaatcaggaatccgagaaatngtcagatgtatcagtcagaatttggacgagacnnnganatngncantangtcgnatnacatcaggacattcttgaacgtttacttgtgtccatgtgccagtggaaatctgtgatgagaaccagagtataaatccaccaaatggctcaggaagatgctcagcgtctctatcaagctgtgtgaggggagactatggaccgatgaatctttgcttagcatgatccttgccagaataagtctttcctcaggtgagaggtaccatggaggcttattctaggatggtaaatcgagacttgtttatgcagtgtgacccgtgagttttccggatttgtgcaaacgtggttgacgacatcttgcctgggtcctgaaccggctgcttcttagtggagaggcttatatagtatgaaaggtgtcgggcagatgatcccccctgtgcgagtgtggcacccaaaggatagcctggtcacgaacacatgtggctagtttttaaaccggcggcgttcgtgcgccctcgggacacacacactttggtgggggcagagagcgtagaaaaaacaaccctccccaacagggggaacaacacaaaaacgcgagataggagttgaattccacacacaa

SEQ ID NO: 605137 - DNA, 111 bp, Homo sapiens
ggcgtatgatatcgtcgaccacgcgctcgcccacgcgtcgcccggctccggcccccagccccggcactcgctctcctcctctcacggaaaggtcgcggcctgtggccctgc

SEQ ID NO: 605138 - DNA, 902 bp, Homo sapiens
catgctggagtgcagtggctgggtcttggttcagtggatctatggttcactgttgcctcgatctcccaggcccagaggaatacccagcctcccaggtagctggtgaccgcgggtgtgctgccgcacgctgctctggctactgtttctcggtttctgtagagtacggggcctcccttatgttgccgcggagctggtcttggcgctcctggatctcacggtgatgctcccggagtatgggcctcccaaatgtgaggggattgtagggcgtgagccaagcacgactcaggccttgagccactagtcctaaacaactcagaatggagcagcatctccctccagccattgtttcaccttgtgaagaaccttaagtgggctgcatcacaactgcaaaggaggctggaaatgcgatttgaggccagttctttgaagatacacgtgcacatggatatggggcagatagtcgtctcgtaccccgtcacctttacctcatggctcaaaaagtgagcaggcaatgagggaatcactggacaattagaagctactcagctggtgtgtgcgcacacaaagcacacattgacctggcaggtcacgtttacttttgagcttgaggaactaggtatagaggcagcacctgacactctgatcccacaaagggtggagtagcaagtgccttaccaagcgggaagcaagggttgagtacaggggcttggcttcccccagagaaacgtccctccagaagaaaccttagtgtaagacaaagaacgtcagggatgctcacacggatggggcacggcggccaccaaggcaggcaggtggatcagacatgaccgggagggaatggaggacccgggtggcatctgaaggacctcatgacacaatccggatcggcctaggacacagga

SEQ ID NO: 605139 - DNA, 514 bp, Homo sapiens
tcgtgtttgcagtatgcacctttgtaagttacatatcagctctccaatatcactcttcgtcagtcacggtgtagagatcttacttcacaagaagtgagactcagagaggtgaagtgacctgtgcagggtcacgcttattacagtgccggagtgggaactaaaggaagttgcagtctgtgaacttcagggtctacccagtaggatatagggagcagaagagtcaggaatgtagtgagctgcaagtctcactagaaccagatgaccttctggggagagtgtaagcccagccttaaaagagaagctcttcatctccgtgaagtggcgaggtgtctgccctcttcaggccaatatcgagaattacctctataactgagcaaatcctcagaacccaggtcagaccttggattgttgctttgcacgtagttcaggtccgggctgtgtctctaactcgtgctgtgggaccctcagggagagtacccaaccccttcaacccagctgaatgagaggagttctg

SEQ ID NO: 605140 - DNA, 408 bp, Homo sapiens
gaagatgcgcgccggtccatgctcaggccctataggaattgcagcgccaaaaggcgtggttccgcacccgggggcattggctgacgcgcgtcagccagagctcgaagaaccgcggctccttcaagcaggcggcatagcctatagcgtggatgaccaccgaggcgcccagggtccagaacgacttggtgatcaggaacaactccatcgtcgccacggcgttcagcacgaaatagttgaaggtcacgcccgcagacatctgcgggcgcgccagggcgccaaagatcggatcacggtcgagttcgctcatcagagtgaggaccccgaggccgcggacttgatgccggcgacaatggccgcggcgccaaagacaatgaagctgccgatgatcacggtgatgccgcgacgcca

SEQ ID NO: 605141 - DNA, 200 bp, Homo sapiens
aaagcaaggaaaaaatggaatatctggtttttgctgaatgcttaatttattttttactgggcccctcccatttttatccaatcccaatagcatgaatgcttctctgtagtaatactaattttgggccttttgtctgcttttttaagacccgttgttccccctttgtagatattaggccaatatatttcgattggatccca

SEQ ID NO: 605142 - DNA, 313 bp, Homo sapiens
cacgaggaatattgcaccaagtattcttcttgccctgagcccatatgaccagttggatagacgtttagaggttctacaccctaaagacatgatgtgtctgtggcatttgcctgtctcaccaacttctccatgaacggtcacaagtctgtttggagtcaagcatctcctgtgtgggggacgacacgactacacaacctgtgtaagtgttttccctcacgaatgtccagcacttcgtatggtccacaatggacatcacacaagtgagaaagttggggccattgctccatgattgtctgtcacttacagctgtgaa

SEQ ID NO: 605143 - DNA, 213 bp, Homo sapiens
atactaaatatcgcaaccacctagcgacagaagtcgcccaacaacaatagacatccgagaacacttacataagcgatgcctgttagacacagcaaggggtataaaagagatccaaataatagaagtacagaagaacagaaaaaaaactcagcagatggagattaccattcccaatgcctgaacttcctcctgctattaagattgcggtgtttg

SEQ ID NO: 605144 - DNA, 410 bp, Homo sapiens
  misc_feature (46)..(46): n is a, c, g, or t
  misc_feature (149)..(149): n is a, c, g, or t
  misc_feature (207)..(207): n is a, c, g, or t
  misc_feature (265)..(265): n is a, c, g, or t
  misc_feature (303)..(303): n is a, c, g, or t
gacaaacaccaggcggcgtgacgaggtacgcagcgcctgggtcggngccgtgcacaggacgcatattcatgcacccgccagatcaacccgtcgcgcaccgtaatggcctcactggtacgaaacgacaccaggccctggccgccacgcanggtaatgcggtactggataaacgcggtatcgccatcggcgcggatgcgatcagtgtgntcaatcgcctcatccgcctcacggggcatgctggcctgcaggtactcgcgcaactcgncatagcccaccacacggttctggaaaaaatcgtggtanaggatctcggggtggtagtaagccatcaccccgtccagatcgcgatgtcgccagcacaggtgatggcgcagaaccaactcgccggtagcgtggggcgtccgtagcgg

SEQ ID NO: 605145 - DNA, 371 bp, Homo sapiens
ggtaatccattaccaagcatgatacactatcctctcgacccttccaagatactgacagtttcagtatattcctcttgattaacgtaatgctaaattatttgtagtgatctttaggtatattttatttcttgtcattaatattactgttcagaatttatcggggaatctgtcatccttcctgaatcttcagaatcacctggagtagggttcatttgtattcatggtcactgaccacgtggggtagaacctgcaagctcatggttccttcagtgctaagttaatattgttgacttggaggcctcttgatagagcagcagactccagaagccaatttgactttgtgatttctgaaaaaattacctgtcaactgt

SEQ ID NO: 605146 - DNA, 184 bp, Homo sapiens
atacaaatcgagctcggaccctagtttagaagtgtccatagcaagtgtgggggagcggcaatgaggtggctcttggtctgtgcagtattgagtctgaagctgaggggcatattaccatatgtcgctgacacgggtatccctatgctatgtgcttcctgtgctgattcttaattggtcttcactg

SEQ ID NO: 605147 - DNA, 511 bp, Homo sapiens
  misc_feature (33)..(33): n is a, c, g, or t
  misc_feature (43)..(43): n is a, c, g, or t
  misc_feature (58)..(58): n is a, c, g, or t
  misc_feature (70)..(70): n is a, c, g, or t
  misc_feature (187)..(187): n is a, c, g, or t
  misc_feature (243)..(243): n is a, c, g, or t
  misc_feature (264)..(264): n is a, c, g, or t
  misc_feature (270)..(270): n is a, c, g, or t
  misc_feature (274)..(274): n is a, c, g, or t
  misc_feature (287)..(287): n is a, c, g, or t
  misc_feature (292)..(292): n is a, c, g, or t
  misc_feature (295)..(295): n is a, c, g, or t
  misc_feature (300)..(300): n is a, c, g, or t
  misc_feature (309)..(310): n is a, c, g, or t
  misc_feature (324)..(324): n is a, c, g, or t
  misc_feature (340)..(340): n is a, c, g, or t
  misc_feature (347)..(347): n is a, c, g, or t
  misc_feature (367)..(368): n is a, c, g, or t
  misc_feature (375)..(375): n is a, c, g, or t
  misc_feature (380)..(380): n is a, c, g, or t
  misc_feature (387)..(387): n is a, c, g, or t
  misc_feature (391)..(391): n is a, c, g, or t
  misc_feature (399)..(399): n is a, c, g, or t
  misc_feature (407)..(407): n is a, c, g, or t
  misc_feature (409)..(409): n is a, c, g, or t
  misc_feature (417)..(418): n is a, c, g, or t
  misc_feature (421)..(421): n is a, c, g, or t
  misc_feature (436)..(436): n is a, c, g, or t
  misc_feature (440)..(440): n is a, c, g, or t
  misc_feature (448)..(448): n is a, c, g, or t
  misc_feature (464)..(464): n is a, c, g, or t
gagtgggattgggtgtcccggctgttcgcagtngccgcgagtncgcgccggacctggngtagtacctganccgctctggccgagccacgcgcggggccccggtctacaccgcgctggacccggctatgccgtgacggaattcccgaggccgtagcgccacgcgagacgcgcactggtggcctccgcngcgagtcctggggtctcgccagcctcagtcccgactgggcgtctggggggagccgncccagcgctgccagagcccanatgccnggcnggacagcatggcncatgnagncatgngggtcacanntggaggagagcgcnagatacaagaccagcngtgcacntctaaccccggggaacgccnncgtcaanaggtnagtagtntctncggcgtgncgtagtgngncacgtgtnngtntgtacgcgcgtctcnttcnacctaaantcacacaatacaccantagtcgcgtctgtgtcacgtccccaaatacacgtacactagcgcgca

SEQ ID NO: 605148 - DNA, 128 bp, Homo sapiens
aggggtggagagcaatttttggttttatttttgtttttgaagtggagcctggacctccagcccccagggggccttccctggccacacttttttgccccacccaggcatggccatcccagccctttgct

SEQ ID NO: 605149 - DNA, 313 bp, Homo sapiens
atgctacatgccagtgactataagtaccgcttggacttctgcagctcaaggtcaatcttgcccacgtaacccttggagcggaccaggtcttccatttcggctatgagcatcatagtaggccgctcgagcccctctatggcttccaaggcctctataagctcccgagccagggacaggtccttggtttccttctccctggcttctgcctcagctctgaccctctcatccgcgtattaggaagagatgtttttctcctcgactacaactgatcaaatttcctctgcttattttgcaggttggacacgagttgccg

SEQ ID NO: 605150 - DNA, 107 bp, Homo sapiens
gtacacattgtctatggaagatagcttctaaatgagtgggaagcaagtaaatgtaacactgtctgtacccaaccccgaagaatctcagcagcatatctttttttctt

SEQ ID NO: 605151 - DNA, 690 bp, Homo sapiens
  misc_feature (222)..(222): n is a, c, g, or t
  misc_feature (224)..(224): n is a, c, g, or t
  misc_feature (239)..(239): n is a, c, g, or t
  misc_feature (284)..(284): n is a, c, g, or t
  misc_feature (623)..(623): n is a, c, g, or t
  misc_feature (628)..(628): n is a, c, g, or t
  misc_feature (634)..(634): n is a, c, g, or t
  misc_feature (651)..(652): n is a, c, g, or t
  misc_feature (657)..(658): n is a, c, g, or t
  misc_feature (660)..(660): n is a, c, g, or t
  misc_feature (662)..(662): n is a, c, g, or t
gagatgagtttaaagaatgatatgtatgcaacgtttcatcaccaattagatggcaaggttcgagtcgatgtcacataccctgctggattcaccggatgtcatcagcatcgagtaagacagcgtgaacatttccgcctgtgtctaatgacaccaagggccgttcatcgctgtttaccgcatcagcagtggaagaggcaaagtacaagttgtagcatgtgaggnanttctgtgggagtgangggaatcctcactggtgactcatgatgctcgaaccatccgcgtanccgagatcctgtcatcaatggtgaactgatactgtgcagattgatttagggactggcaagataatcgaactttatcaaatttgatacaggcaatttgtgtatggtgataggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagancagtngggtanattgcagtacagcatannttttnntntntgcccaaataaacagtgaattttcgtta

SEQ ID NO: 605152 - DNA, 892 bp, Homo sapiens
gtttctcttggcaatgttaatttattgcaccggtggtattctatggcggatcaatcaacgcgaaccttttaattttcaccgtttcttttaatgcatatgtcaaacatgttactctgttggatatactggaagttccaaaagccattggtaccgtgggcgttcaacctcctctcgaggaatgaatgttttcctagtatggggcgtgcttcatacgctacattacgatcaatggtttcatgtacaatcccgagcgtttggtagggaatctgaaatctgaattgttcacggagttaactctacgtaacggttgttctctaggtttccactggtccaaatttcacttgttgttcgtcgtgtcaggcgatgtttgggtccgattgtctccaccccttaatgcgcggacgagcatgatcagcccgagtacaggccaaagagacgatgctagccgctccaagagcgtcctgcgaggggcaagacccggacatggtccatatgctcgagctgcatctgcgggccaccttcgccgaagcccaaggccccctcatgagcaggccaagaacgagtagagaccctcatgtctctcttccaggaaactgagcctagggagctcatctggcagcaatggcttattactcatattttaaataatcactttctttttccctcaagggagaatgttttaatttctgtttgtagtcagtagaattaaggtagttggactatcatctatagagtgcacagttccctgttgttgttaatattaaatatgttctcacttaattgctttgctgctagacttgcaaccttaatttttttcaccagtatagttccattaatgtttgcattttcgacctgtgtcaaaacgtgtgacagctctttactgtagaataaa

SEQ ID NO: 605153 - DNA, 581 bp, Homo sapiens
attctcctgcctcagcctccagagtagctgggattacaggcgcccaccaccacacccagcctggccaacatggtgaaaccccctctctactaaaaatacaaaacttaagccaggtgtggtggcgggcacctgtggtcccggttacttgggaggctgaggcaggagaatcgtttgagcccaggaggtggaggttgcagtgagctgagatcgtgccattgcactctagcctgggcaacaagagtaaaactccatcttaaaggtttgtttgtttgtttttaatccggaaacgaagaggcgttgggccgctattttctttttctttctttctttcttttttttttttctgagatggagtctagctctgctgcccaggctggagtgccaatgacacggtgttggctcactgcaacctccacctccgtgggttcgggcgattctcctgcctcagcctcccaggtgcctgtaatcccagctacctgggagtatgaggacacggagaattgcttgaaccctggcggagaggatgcagtgagccgagatggtgccactgtactcagactgggaagagtgaaaatctgctc

SEQ ID NO: 605154 - DNA, 330 bp, Homo sapiens
tgagtcgggattcagatcctcctatcggaatccagatccccactctcaggacctctcggggggggcaaaaaagtaaaggaaagagtcatgggaaacggtttaagtcacagtaggaacggtcccacgtccctgggtgtccggcttcttcttattaagtttacaagggtgacattcttttcctattttcccatgtctatcgggacacccgggtccaacccattagtttcgggctccatcaaagggaaaggggactcagaagtcgatgggggtccgtgaccctcatcggtggtagtgtctggaccagcaccttcatgtggtacaatagtgcag

SEQ ID NO: 605155 - DNA, 153 bp, Homo sapiens
actagcacttccagtggaggatggcgtactactgctaccctcatttaacctccggctgtggacactcagaacatccgcgtgttgttcaccgactgccgtcacatcattgcagcgcatgcaccttcgtcagtacgagctgctctaagaggggac

SEQ ID NO: 605156 - DNA, 236 bp, Homo sapiens
ggtagaaccaggctcaatcagtctggttgcgcgtcatcgctacagggaaatggggaatcctggaagagggatggtgcggtataacaaaacacacgagactcttttacattaagaaagtgggagaccaggaggcactcctttccacgaaacaaaggccctgggttttagcccacttttattaaggaagatgccttatgtagattagtgggctggagcaagcataggcaaagacaagg

SEQ ID NO: 605157 - DNA, 143 bp, Homo sapiens
  misc_feature (137)..(137): n is a, c, g, or t
cctaactagcattggcaaaggaaagtttacacttttttcctcattcagggaaaatgctttaaaaaatcctgcctttgtgcagcaaaggagttggaggcagctccccaggcatccctccccaaataaaggcttatgtnctggta

SEQ ID NO: 605158 - DNA, 115 bp, Homo sapiens
gctggagctcgcgcgaggctaaatcccctaagaaggtcccactcctaaaacaccatcccccgtattatcggcaataaggggtatcaataacctgagctaaccatagtctaataga

SEQ ID NO: 605159 - DNA, 200 bp, Homo sapiens
tctcaactgactctatgttcccatccatatacagaacttatattcctagtcattgcagcccatttgtcctggtcaagaactgtcgttggagaactggtacagtcatttgaaggacatatgacactctggccatttgagttactagagttcttgtgttggttatttctcgatcagtgtgtgtgggtattactttaactgca

SEQ ID NO: 605160 - DNA, 277 bp, Homo sapiens
gagagtatacccggtcgcggagggtaaatgagacggagtgtatacggagggctagtcgtactcagtatgctcgatcataacagcgacggacaatgctaacagtgtccagcgattaggtcgagctggagtgacatcaagttcttccagtctgacagcccagtggcccacccatgtcaagcactttccagtgggactcttcagttggcagcaaggccacctgaggccctgtctcccagccacatttccctccgtggcaatgtcaccagtcctcaaccgc

SEQ ID NO: 605161 - DNA, 847 bp, Homo sapiens
ggcagacgcggagggaaggagctacgagtagccgccgagaggccgggagccagagagaccgaccagccgagccgcgccgccgccgcgcccccatggcgtgcgccagggacactcatgaggaccattgatacttccactgagaatacagacgagtccaaccatgaccctcagttgtgagccaatagtttctcttcctgagcaagaatattaaaacactggaaggaagatgaagaggaccttttaaaaatgcgggcaaaaatgtccgattgggcctctgagaacgatctcccagaatgaaggacgcgaggcactggtgacgtcaagctcctgaagcacaaggagaagggggccatccgcctcctcatgcggaggggacaagaccctgaagatctgtgccaaccattaatcacgcgatgatggagctgaagccaacgcaggtagcgaccgtgcctggttctggaaacacccacgctgattcgccgacgagtgccccaagcaagagttgtggccatcggttcctgaatgctgagattgacagaatttcaaaccaagtttgagaatggcggaagagatcgaggagagagaaaagaaagcggatcggcaagaatgatctgcgaaaaggtgggcaaagtagaagctctttggtgaagaggaaccagcgatgtgggagaagcaaaacgtgcattattgtttcccctttcgtcttttaaaaatacccgcccttgggggtgatttcacttagcggggttaaacagaacacagggtgtttttgcaattcgcgcgcgaaggaacaccacgagaggtggtgttcggagagttacgtacagcagcaaaaaaggcgtgtggg

SEQ ID NO: 605162 - DNA, 594 bp, Homo sapiens
tcgggagtctgtaccctacaagcgccacgcgtcgaatagccccacatactttcagaagagctcagcagggccctgcctggtctcccgagcatcaggaggaacgagactgctcagactctgctgacaccaaagtattggaaacaaataaaaggtcttggggaattctgttaggctacctgggcacgccaggctgcaccatgtgtcccagcggcgcatgagtgactggcgtattaagcccgtcacatgacatacgctgaaggaaaggcaagagaggtgaaacatttatcgtactgaaaaaaaacgatctcagcgaagaacatagcgagtacggcagacttcaatcaacagcggctgaaactgaccactgagaaaagggtgagggcactgacagttctcccccataatccggccaggaaaggaactgggattggcaaaatcccctttaaccctggacggaacaactaaaagcagacattaataaaatcaaaacaaccaagtaactaaagacctcaagaggtaatacccgggcaaaagggactttcctaaaaaaaggactggacgcctgggggtactttaaaagccaagggaaaaact

SEQ ID NO: 605163 - DNA, 222 bp, Homo sapiens
ttgctgaggtactctagatgatcccggtccgctcggacgaggaagtgaagaacatcatgtcttcaagatcggcgatcgcaactgcaggcgaatgtcttactattgctctggcagtagtgatgctcccaagttcacctgcagccccaagtgcaagcaagcaaaaagcatttcccatgaaggagctttgccccttcagaatgggttggttcagcaccgggaaat

SEQ ID NO: 605164 - DNA, 147 bp, Homo sapiens
caccaagaatctgtacaagtcatggattatctattatctctatttcactcctagagaggaattgctatatgactcagaatgacacattagggcaccacgtgtgtagaaagcccccactgtaagatgagtgactcgtggaaatgtcca

SEQ ID NO: 605165 - DNA, 834 bp, Homo sapiens
  misc_feature (161)..(161): n is a, c, g, or t
  misc_feature (226)..(226): n is a, c, g, or t
  misc_feature (293)..(293): n is a, c, g, or t
  misc_feature (381)..(381): n is a, c, g, or t
  misc_feature (393)..(393): n is a, c, g, or t
  misc_feature (396)..(396): n is a, c, g, or t
  misc_feature (456)..(456): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (482)..(482): n is a, c, g, or t
  misc_feature (504)..(504): n is a, c, g, or t
  misc_feature (516)..(516): n is a, c, g, or t
  misc_feature (524)..(525): n is a, c, g, or t
  misc_feature (535)..(535): n is a, c, g, or t
  misc_feature (549)..(549): n is a, c, g, or t
  misc_feature (555)..(556): n is a, c, g, or t
taaagaaaagttattaccatgtatttggtgaggcaggtttacaacactacaagtcttgagttaagaaggaaagaggaaaaaagaaaaaacaccaatacccagatttaaaaaaaaaaaaaggatcatagtcttaggagttcatttaaaccataggaactttncatttatctcatggttagctggtaccagtcagtgattaagtagaactacaagtggtataggcttnatggtttatggctgggtttatgaccttaataaaggtgtaattatgttttaccagcagggtggttttnaactggtgactatggtataaaaacaaatctggatatccagaagcacatgaagttggcaactttccaccctgcccatttttggtaaaantgcagtcatctnggnccttttaaaacacaatttttaaactcaaccaagctgtgataagtgggaagggtactggtnaatactgggggtatngtnttnggatnacagcagataatgctttctttnccagtcgtcttngagaatannggaaaaaaantcttcagatgcaanggtttnngtgtagcatctggtctatacaggttgtggtaaatatgggaagaaggtttgggccaatttgggacttaaaagtgggaattgaaacttgtgtttacaaaaaatgggtatttacatccgtggtcagaggggtccaattttgtgggaggcaattaaaggcgaaaatattgtactcattgacaaaacaaaagaaaacaaaagggggggggtaaattcaccagggggcagcaagggcacacagtttggaaaaggccaatggggaaaaaaagggggggaaaggtg

SEQ ID NO: 605166 - DNA, 625 bp, Homo sapiens
aaattaaaagattaaataaaaaatattaaataaaacatggcaaaaaaaaaaaaaagggaaaaaaaaaaaaaagacatgaaggccccctaaggccattgcccttttcgccctatggtgtgccgttttcggccctcgtgtcgccgttttacaactgggtgcctgggaaagccccggcgtttcccgggctttgtcgtcttgccgccttccccttttcgccggctggcgtaatcgccccgcggccttcccctttccgcccttctgcacaggccgcacgcgcttgtgggctttggggatctttgcgcgctttgatattttgctgggactcggtttggtttctttgtttattcgggtcattttttcgcccctgggccgtcgccttcttcccttataattcaggcgtctgccccgtgtcagggttgcgcgtttttcactcggggccgtgttcccgtttttgggcccggggctccaggcgcaagccggtatccggctatggggccatggccactttggccctttcccgttttcgggttccggcccgtagccccttaagcgttcctcggccccttacgggttccccgtttcggggttaccgggtacctcgccatcttgcagaagggagggctgc

SEQ ID NO: 605167 - DNA, 834 bp, Homo sapiens
  misc_feature (10)..(10): n is a, c, g, or t
  misc_feature (161)..(161): n is a, c, g, or t
  misc_feature (226)..(226): n is a, c, g, or t
  misc_feature (293)..(293): n is a, c, g, or t
  misc_feature (381)..(381): n is a, c, g, or t
  misc_feature (393)..(393): n is a, c, g, or t
  misc_feature (396)..(396): n is a, c, g, or t
  misc_feature (456)..(456): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (482)..(482): n is a, c, g, or t
  misc_feature (504)..(504): n is a, c, g, or t
  misc_feature (516)..(516): n is a, c, g, or t
  misc_feature (524)..(525): n is a, c, g, or t
  misc_feature (535)..(535): n is a, c, g, or t
  misc_feature (549)..(549): n is a, c, g, or t
  misc_feature (555)..(556): n is a, c, g, or t
cgactctacncggatcccgaaaatgaatagaggcaggtttacaacactacaagtcttgagttaagaaggaaagaggaaaaaagaaaaaacaccaatacccagatttaaaaaaaaaaaaaggatcatagtcttaggagttcatttaaaccataggaactttncatttatctcatggttagctggtaccagtcagtgattaagtagaactacaagtggtataggcttnatggtttatggctgggtttatgaccttaataaaggtgtaattatgttttaccagcagggtggttttnaactggtgactatggtataaaaacaaatctggatatccagaagcacatgaagttggcaactttccaccctgcccatttttggtaaaantgcagtcatctnggnccttttaaaacacaatttttaaactcaaccaagctgtgataagtgggaagggtactggtnaatactgggggtatngtnttnggatnacagcagataatgctttctttnccagtcgtcttngagaatannggaaaaaaantcttcagatgcaanggtttnngtgtagcatctggtctatacaggttgtggtaaatatgggaagaaggtttgggccaatttgggacttaaaagtgggaattgaaacttgtgtttacaaaaaatgggtatttacatccgtggtcagaggggtccaattttgtgggaggcaattaaaggcgaaaatattgtactcattgacaaaacaaaagaaaacaaaagggggggggtaaattcaccagggggcagcaagggcacacagtttggaaaaggccaatggggaaaaaaagggggggaaaggtg

SEQ ID NO: 605168 - DNA, 363 bp, Homo sapiens
aaatacccgaattgaacgaacagcccacggacttacatcctcatatactattctgactagcaaactcaaactacgaacgcaccacaatcgcatcataatcctctctcaagagacttcaaactctactacccactaatagtcttattcgatgacttctagacaaacctcgtctaacctcgaccttaccccaccactattcaacctactggagagaactctactgtgctagtaaccacgtttctcctagatcaaactatcactactccatactctacatggactcaactatactatgtcacatgcccgtatactcctctctacaatatttaccacaaccacacatgggtgctctactcacccacc

SEQ ID NO: 605169 - DNA, 696 bp, Homo sapiens
  misc_feature (1)..(1): n is a, c, g, or t
ngggaaaaagccttgggtgattggggcctcggaaaccccgatgcattaaaggtgttttctaatgagccgtggtatacaaccagattttgcgaattccctcacgaatcaaatcgtaggtggagcggttatcaccctgtccgtctgacgcggccacagaataatcgagcaagctttatcatgtataagcgttccttgagtaagtccatgacatgggccgtgatttcccatattctgtaggcgaccctagtactcgaggagtttctgtcgatcataagtatacaacatcatcgctgggcgtcatgtagaaggaaaggcgtctgtcccagctttgattcagtacagtctgaccagagacactcgttccaggctggtggctcatcaagtgccatgttgcagcccatgcttgacaaccaggttggttctaagaacgtgccgtatgtccagcatgggacgctgtcagtgaacagaaccatgcgcatggtgaagaacgtcttcgtttatgcggatcacagagatgtgtacacaaggcacgcgcgccggatttgcatagtgacccaacagggcatcaggaagaaaactgtttccttaagccaggccagatctgggcgatttaagctcctgtaggtcaggacatgcccaatttggtgctttggccaggtccctgtatggtgttgcttaggaaaagaaacgctttat

SEQ ID NO: 605170 - DNA, 359 bp, Homo sapiens
acccgggggggacacaaagagaaccatcaggaagccagagtagggtatggttgtcacgcagggcagccagagagagcaggaaggcccgcatggatagctccgagtgtccccagcttctgataagcaggcgcacctagactccactctcgtaggaggcccgccgcagcccatcgtcaatggcaggccagaacctgtgagggtgggacaactcccagagtgggcaggtacttcatgacagcgacgtagatgaaactccgggcattgtccaccaccttgaatacacacttcaagtctggaatgcggccactaggacacaaagcccagagcccactcaccacatacaacacaacaaaactacc

SEQ ID NO: 605171 - DNA, 347 bp, Homo sapiens
  misc_feature (247)..(247): n is a, c, g, or t
  misc_feature (300)..(300): n is a, c, g, or t
aaaagtttgcgcttttttgcatgttaacctcatgcattgactcttaccttcagggacatttctaaataatgatgggttaacgtggcaaaagccatttattgattgattgatttaatcaacgaatatttttaagcattgattttgtgttaaatcacaattcaaatttcatttggagatacaagccattattaaggcataacttaaaaatgccattttcaatttgccctgtaggtgaatcacatcagcntttttgtggttttccatttgaataaaacttacaagttgatgtatacttggagncccatatacattttgaaagggttgtttggaacctccttggtggaaag

SEQ ID NO: 605172 - DNA, 942 bp, Homo sapiens
  misc_feature (190)..(190): n is a, c, g, or t
  misc_feature (206)..(206): n is a, c, g, or t
  misc_feature (211)..(211): n is a, c, g, or t
  misc_feature (214)..(214): n is a, c, g, or t
  misc_feature (223)..(223): n is a, c, g, or t
  misc_feature (235)..(235): n is a, c, g, or t
  misc_feature (240)..(240): n is a, c, g, or t
  misc_feature (242)..(242): n is a, c, g, or t
  misc_feature (269)..(269): n is a, c, g, or t
  misc_feature (281)..(281): n is a, c, g, or t
  misc_feature (283)..(283): n is a, c, g, or t
  misc_feature (298)..(298): n is a, c, g, or t
gcaaatatcatgcacaaatgagcagggccgcgggggagtgggcgcaggcgctgctgccactgaggtgtgtgcatgatgttggatgctagactagttgcatctgacgggagaagttgtgtgtaccagcgcatgcctggaaagacttaagtaatgcaaaaggttgtcctttttttttttttttttttttaantctacggacaattggntctantancccaaaaanttgagggaaaangcagntngcctcaccgcccagacttggattggtncagatgttctcnanggcctcaggatacantaaaaccacaaaatttttcttaacagttcaaatggtttataataagttaactagtgggcggggcatcagaagctacccagacccgctggtctctctcagtgtttcaccctcccatttctgccccaattctgaataccgtgtgggcggggagaacttggctgaagcagcatccccagttagcctctaaaaagccgggtagggcagttctctcccactccacggggcgacgggtcttgggaaagcaggcaggaagacgctcaggtcgggcctggaagcttctctcactgaagccggtggcagcagttctggataacctccggtggactcctggctctgggtaggtccagggccctagtagcaggagagatggatcctgaatccggtggaaagctggaaaaggcttgggaaagttggtcctcactgttcgaggcctccggctggatctgcagcagtttccaggggggggtcggtttatccccagagagtcgcggtctttccggttggcccttaacaaggcaggggaaggggtcagtccttgccatcggtgtggttctcccagggtgaccgaagggggtccttgcaaagcgcctcgttggtttgccactggaggcggttgggtcgtggtccccggtgggggggcttta

SEQ ID NO: 605173 - DNA, 359 bp, Homo sapiens
tggatcaggccggagtttgagaacagcctggccaagatggtgaaaccccgtctctactaaaaatacagaagttggctgggtgtggtggcgcacgcctgtaattccagctctgtaggtggctgagacatgagaatcgcttggacctgggaggcggaggttgcagtgagccgaggtcgctccactgcactgcaccctgggcaacacggtgagattctgtctcaaaaaataaaaaaagaaacatcctaagtcgaatcatggtaagttgggggctgcctttcccatttcccatgctgatcacattctctcgcctctttcttctggctacaacacacttcttcattccaaacccttccccctga

SEQ ID NO: 605174 - DNA, 460 bp, Homo sapiens
  misc_feature (418)..(418): n is a, c, g, or t
gtatctgcggtgtgtcggggacactgaaaaacaagcaaaagtataactacaatctggacttttttcttttttaaataaagttttttttttccatttttcttctcatacggtgaatggtcctggactccttttctggacattcagttttcagaatttccatctttcttcgggaactaaggtgcggttctctggacggccggcggggccagcatcggatggccagccagaaaggtcacacggcccaggatggccgggtacttcaaggtctggaacatgttgagcggagtccagtagacttacatgagtcccagcatagcagcatgtcccaggtgaaatataatcgtgctaggagcaaaagtgaagttggagacatgtggaccaatccggatccacagagcgaaagagcagaagcaacggngaagagatcagggccgtgaatgtatgggagggatcctctaga

SEQ ID NO: 605175 - DNA, 408 bp, Homo sapiens
taataatgtttcagtgaacaacagaccacatatattactgtgatcccatataatataatactgtatttttgctgtacattttctgtgtttagatacacaaatacttaccattgtgttacatttgcccacagtatttagtgcagtaatattctgtacaggtttgcagcctagatgcaataggctaccccatatagcctgagtgtgcagtagcctatatcatctagatttgtgtaagtgcactccatgatgtttgcacaaagtcgcctattgatgtatttctcagtacacctccccataagctaattgacgcatgattggagatatatatatatatatatatatatacacacacacatataaatatatatacatatgtaaaatagatgctataaatattttatacacatt

SEQ ID NO: 605176 - DNA, 247 bp, Homo sapiens
  misc_feature (139)..(139): n is a, c, g, or t
  misc_feature (148)..(148): n is a, c, g, or t
  misc_feature (162)..(162): n is a, c, g, or t
  misc_feature (196)..(196): n is a, c, g, or t
cgattcatggtgcacggggcagtactgcgtgcagtcacgccgagctatcgatgtcgctgtataactgctgttaccgactgtctggtagtaaaaattagcgagtaggattcaaaccgatgtcgccttgtgcttttgcatncctttgaancagctaaaatcaancccgggtaattctgctgcagccaccgacaacgcncggttggagcgaaagcggtcgtacaagccacccttgacgacgggcacctgc

SEQ ID NO: 605177 - DNA, 230 bp, Homo sapiens
ctcccggtttaccccattctcctgcctcagcccccggagcagctgggacccactggtgcccgccaccatgcccagctaatttttttgtatttctggtagagacggggtttcaccgtgttagccaggatggtctcgatctcctgacctcgtgatccgcccgcctcggccttccaatgtgctgggattacagggccatctttttgcttttttttccccatttgctgttttaa

SEQ ID NO: 605178 - DNA, 792 bp, Homo sapiens
gcttcaggcgagcgccggcgacgatctgtctcgtcgatgcgcacgcctgttctgatgtcccgcagataatgcatgggttacccgcattctatcgccagatgatagcggtgtacatgatactggctcgcatcatctcacccgggactcatgtcgtagatgtcaccgaatgcttggtgaatgagtgcccagacgctcgctatagtgcttgcttcaaggtgtatgtagcacccgctttgacgccggactgcgtggtggcactgtcacaattgggggcctaagagggcagaacaggtcgatggtcgagcacgaagttggggaagatccgcgagagagactagacaagatacgtatgggggtgacgctggttgccctagtcagatctgaacctttagctgattccctgtatcgtgggaaaccacttagggtgactagaaggcgttgagttcagtctatggtttggtgtgtaaagcccagaattgagaggaaacgctctggcgtaatgggtacttaggcagctgcttaggatgctacatagaggtacgagtctgaaagacgtaaggcaggggttccaatagagatgaggtgaaaggtgggatagagcgaggtaggggacatgcagtgaggagggtgtgagtgataactgggtgtgaaaatagatgggtgctcagttgggactgtatgaagcggtgaaagatctgtgaagctccctgggaaagattcgggggggtgagataggattactgggaaagaaggaggacaagaactttgggatgtatccagactcgtggtgga

SEQ ID NO: 605179 - DNA, 330 bp, Homo sapiens
ttagatatctgtaacgaggacgggcggctgggcgccaggcttcgtgtcgtcatggccaacaagcacgccgtctgctggaatcgaggccacccaggtctaccagctggacttcggggggcgggtgacccaggagtccgccctgaacttcccgattgagttagaggggcggcaggctagacctcagaccaggtcgcgctgctgagcccgggagggcgagggttccagtgcttcggccttcaaggagcatttctcaaaaggcccaattggaaatgtggaagacaacgaacacctcttaggtcgagctcatggggtcatggttgccagtgtgcc

SEQ ID NO: 605180 - DNA, 123 bp, Homo sapiens
aggccttctctcacttgacacatagtttctcttttctttaaactagttctcatgtatactaaattttgctcgtctccctacttgtcttctattatctttatctttgtcctctcactttttcct

SEQ ID NO: 605181 - DNA, 390 bp, Homo sapiens
  misc_feature (204)..(204): n is a, c, g, or t
  misc_feature (218)..(219): n is a, c, g, or t
  misc_feature (236)..(236): n is a, c, g, or t
  misc_feature (242)..(242): n is a, c, g, or t
  misc_feature (254)..(254): n is a, c, g, or t
  misc_feature (286)..(288): n is a, c, g, or t
  misc_feature (298)..(298): n is a, c, g, or t
tacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaagnaaaaatggggtggnnaaaaaggggtggggacncacaanttaacgtaaaanaaaaccaagcgggcccaatttgccggcaaacnnnaaaacatttnaaacaaatgccattttttttttgttcaaatgattttaattattggaatgcacaatttttttaatatgcaaataaaaagtttaaaaacttaaa

SEQ ID NO: 605182 - DNA, 722 bp, Homo sapiens
ggaaactcagagaccaagtccattgagagactgaggggaaagagaggagagaacagaaaatagagagtgggaacagtaaagagaaaggaagacaaacctccagagaaagcccccggagacgtctctctgcagagaggctggcagcacccggctcagctgcgaagcgccgtgggaagcggagtgcccctaatcatgcggctgtctgcatgcttgtgtccgggggagtcctgctggtggctctcctgcccatgtgccgcatgcatgggcgctcctgagccgtgggcctggtcccgggagctcggcaggcgccgaagcacctcaggccttgattcttgcagcctgcgtcgtagtccgagcagccccagctagccgcaggctcggcaggtgctgcttccgcgatgggagaggagtacttcctctggcctggtggagaccgtctacaagagcccggcgtcccctttcgcccgcctcctcgctcctcgccggaggcagcggcagccgcccttcgccggaacaggcgacgccaactttttccgcgtgtgctgcagcagctgctgcttgcctcggagctcgctcgaacagcccgcggtctcgcggagcgggggctaggaatgccctcgggggcaccaggaggcaccggagagagaaagggggtccgagggagctccatctcctggatctcacttccactcctccgggaaagtctgtggaaatggcaggcg

SEQ ID NO: 605183 - DNA, 146 bp, Homo sapiens
  misc_feature (7)..(7): n is a, c, g, or t
  misc_feature (66)..(66): n is a, c, g, or t
  misc_feature (96)..(96): n is a, c, g, or t
ggctcgnaattcaagcttctaaccgatgtacgggggacatgggccgacgaatgcccaagaatccangaactttgtctatcactcctccccaacaancctaagatgtgaaaacagaataaacttcacccagaaaacagaaaaaaaaa

SEQ ID NO: 605184 - DNA, 156 bp, Homo sapiens
ggaacgagaccgtgctgtcaacgactaccccagtcctgctacctcccttgcctttcgatggctgaaggcagctgccctattgggttgccgggcttgaggggccttcttggaggcctcaaggtgctgtccattgggaaagaatgggttggggatcct

SEQ ID NO: 605185 - DNA, 389 bp, Homo sapiens
gtgctatgctacttattcataggcagacaagcgtaatgctttcccaagttcaggcgttgccagagactgccgctgtatctctcatcctgtgcttcatttttggattcttgtccttaccttcaacatggtgtggagaattacaggaatttcaagttgtctccctagaccatacccctttgtgctcttctactcaaaattcaatggtgtagagatgtgtgtggatgcccgtactttcggtaactgatgctcggtacatcagaacgggatcatgtacaccagaatgcagaggtaagatctctgtagcaacttccctttgactggaaccatcaaatgacaagcttactgcagaagcagtgtgacacacttcactcagcttaaggtctgtcgat

SEQ ID NO: 605186 - DNA, 126 bp, Homo sapiens
tgcacacaattctaccgagtccgatccctcatcaaactattgaggcgtccactgccctattactatccagtcctcaatcctagcaagtaattcccatccgtccatatatccaacacaacaagagca

SEQ ID NO: 605187 - DNA, 327 bp, Homo sapiens
ctgatatgtgacctagttgtagcccatacccaagcaaccccggtactatagagtctcacaggccatgaatgtacctttataaggataccgactagtcattggctcgcagggatcggcctagtagcccaggtagcaagaatcttctatcttggtgtcatcagtcaccagttgccaaccaccggatccttcctcttctatgggatagctcagccttcgtgactctcggttgtaaaatgggctctggttcctgctgcacagggacacattcacctcggtcagccatggttaagatggagtcctcaggcatgaccgcgtgatgggcagcct

SEQ ID NO: 605188 - DNA, 262 bp, Homo sapiens
ataatttattaccatatattgttatagtttattttagtatgtgttaatctcttactctgcctaatttataaattaactttaccaatggatatacatatatatggaaaaaacacactatacggggtttgatactctccctggttttacacatccatgggagtcttggattcccccccataaaataaggatgagctaatgtatactccacaataattgtaagccggggctctcaaaaaaaatttggggacttagtggtcctaag

SEQ ID NO: 605189 - DNA, 712 bp, Homo sapiens
atggctgcagtgaccaaagacttagatcacaacacccaagttccttcaaatacctagaaagccttctcaagaagaaagtctcaaagctagggcctaaaataggggtacaaacaagtcaaaactgtgaagactacaataaactcttcaatggccagacactgacaaacaaccacaagcatcaagaccctccaagaaaacatgccctcaccaaacaaactaaataaagtccaagtgaccaatcatagagagatagagataatgtgatctttcagacagataattcaaaatagctgtttgaggaaactcaacaaaatttaagataacacagagaaacaattcagaattctatcacataaactgaacaaagaggttgaaataaaaagaagcaagcagaaattctggagttgaaaaatgtgatgatatattgaagaatgtatcagccttactgggaatttatcaagcaaaaagaattagtaagcttgaagacaaagctatgcacagaaggagacaaacaggacaacataaggaaagaatgagcaacacctgaagatatagattgtgcctcaaaggcaaatttaagaattatgggtcttgaataccccaagacatttaaaaatgaactcccaatgatcaggagatacagtcagaacataaaggcggaggagaaagaaccaatttattaacccgcaccaggtccagttgttcagcagat

SEQ ID NO: 605190 - DNA, 201 bp, Homo sapiens
aatataatcgtacaaatcacgcacgtcatttttttaaagtcccaatctaaagccttaaagaaaaaaaaaaggacttgaaggaaccaaaaacattcttggatttgggtttgacgttgtccagtccaacctcctcctacccaggggaatactttttctcgattatatttgataacaaacacaaatcactgtgagcagcgtggg

SEQ ID NO: 605191 - DNA, 247 bp, Homo sapiens
atacgaggctagggtataattgtctgcgtcgcctaggaggtctgtgtgctgaatagttgttactgtcattacaggagagaaggacgagacgtaagccgagcgcgtctttctattcgcgtatcaggttggacggtgcttttatcagtcatggcacgtgattcctagggcgttgtttgatcccgttacgcgcaagaataggacgtggagtgctgctagtgtgccttgctattaccttaagtggccaata

SEQ ID NO: 605192 - DNA, 153 bp, Homo sapiens
agagctagtgtggcaatagtatagctgagatgcattactaagttgggtgttcgaaactggatggcaaagtttattgacagagcttagctcatttgattaccatgaatgggccaaagattggtgacgtgcctttctttgaacaactttttaatc

SEQ ID NO: 605193 - DNA, 677 bp, Homo sapiens
tctcatttaactttttaaatgggtctcaaaattctgtgacaaattttgggtcaagttgttccattaaaaagatggatcgccgtctggtaaaaagctggaaatggccctaaatttgaaatcgggtctgcctgtgatgccctggaaagcccatggtatgtggagagccttctcagacaatccaccttggggtcgcttgtgctgttccgtgatatgacgacagacagttagacggggggtgtcactcaaagcgtctggacacagaaggctgctgaagctggcaaggtacaccaagtcgtgccccagaaaagctcccgaaaggcctacatgaatattatccctaatacctgcacaccccacgtctaaactccagtgcgtgaaacaacacggcaccacaaagcgggcggtctacaaatgggccccaatcaacagttcaagctactagacagactgtgtacatgcatcaccaacagcacgtcgctaaagcccctcaagcaggaaaaggacagaatgttatcgggggcacccctacggtcacacaaatagagcgtgatgccaggtctaagatcatccagatccaaacaacagcacgtctataggggaacacaaattgcaccaaaattggcacacaactcagaagacccataacaagttaactgaaaaacaagcaaaagaagcac

SEQ ID NO: 605194 - DNA, 160 bp, Homo sapiens
  misc_feature (105)..(105): n is a, c, g, or t
gaggatccctcccttccaccagcctgggcaacacatgcagacctgtctctaaaaaaaaaaattaattaactgggtatgtgtggcagcatgcctagtagtcccagnctactcagagaggctggtggacagggagtgggtacctgagctctgaattctgtaa

SEQ ID NO: 605195 - DNA, 163 bp, Homo sapiens
ccctgaagatcggcgactttggaatgctcagtatgtgttcctcgtgcgtgtgcaccgagttatccataccaaaatctgccgatcttcacgtgcacacgccgagcacccaccctgcacacgccgaggctccagactgagcaggccataatcgccgatcttcacg

SEQ ID NO: 605196 - DNA, 122 bp, Homo sapiens
cacagactgtatctaatgtattcagaatccacttttttaacttcattgtagtacaatatcttgcatttgtaacatctcttcacgagcaattcttttttcataagtccccataaatatttcag

SEQ ID NO: 605197 - DNA, 360 bp, Homo sapiens
atatatccatagacacagtcgtgactatcgaagcaaacttgcccaaagatactgacacatataccactcggagctaggagaagtatgagcaggtcaggagagtgagtgcttgggtgggtgaagggaagtgctcttgcaggagaatcccatggtcaaagggctcctcctcaacaggccactgacccccactacaggcatgtaatgagttcacgagccatgtcatgaacctgctgagtggagcagagccgaaccagtgcccgtggaccccaaagagatggaatgcatggtgcgcatcatccatcgacagttcaccgacatccagatacagctgaaagcaaaccacctgcgaggctgtaatga

SEQ ID NO: 605198 - DNA, 415 bp, Homo sapiens
  misc_feature (35)..(35): n is a, c, g, or t
  misc_feature (215)..(215): n is a, c, g, or t
tccgagttagttacagcgcaggtgccgggtgttanttaagtaggtcgccacaggtgtctacaggtcaggatgctgggctgtgaattaatgtagatctacacaggggtttacacgccaggacacccggtgtgaattaaataggtctacatagtgagtctacactgtcagtgatgccagtgtgcgaacttaagtagtgtctccacatggggtctacnacatcagtgacaccctggtgtgaaattaaagtaggtctccacagtgagtctaccatgtcatgattaccctggtgtgaattaatgtcggtctccgcagggggtctacacatcatggacacatggtgtgacattaaagtagagtctccaacagagagtctacgcaatcaaggacacctggtgccctgaaagctgtaaaactg

SEQ ID NO: 605199 - DNA, 1269 bp, Homo sapiens
tttaatgttcatgtagtgttaatctgcccatagaattggatatcctattttttatatctcctatatcttatgggttactccgattatattctgcttccataatagctgttcctgaattcaaagacgagctgagttcgtgatctagcacatttagattcgcacagttgatcactgtctgtagagatattacgttagaccagccattcaatgttttctgcgtactctgtgctcattgtgtgcggctgcctttatttcccgtaattccttaaactcttttttcgtgttactctaagccaaatgcatattcctataaacgttcatgtgtttgctgtttcctgccctggcgctattcattttcttaaaacgatatttctctctactttgttaatactctagattgttaaacctaggcgtgtgttgcacgcatctgtttcataatttccctcacgttacatacagggaagtgctgtgaggtctactagttaactaggagtatcactttaacgtcaaggagtctagaggtctgcagtgaagccgagtatgtgcactctactgcacatcctagcttggcgtgtatataaatatgaattactagtatgtcgtgaatacgtggttcaacaatgcagacttcctcagacttcgataatcgagagctcagactgtggtactagggctccaggaatctgtgtggtacaaacctgcatggtgtttatgcacacagagatctgagaaccattgttctgaatgctgcttccatgtcgacaaagctgccgtgactaatttttgcaaagagatagcaaacaatcgcgtgtctcttttatgttcagcttataactgaaatctgtttgtagacttattaggactttgaattatttctttattaaccctctgagtttttgtatgtattattattaaagaataaatgcaatacaggaattattaaactatgtaaactacaaattgttgtataacttttgatgaccttgcagtgaaattcttcaggtagctctgagtaatagattgctctttgcccaactgtagaatacgcactttcgcccaccattagtatatctacaagaaactaacttgttggagtatttagttgtacagtctattcgttcactctgttactctaatacagaaattataaagccttccagagggtttggaccacatctctattggaagaatagttagcaacatattaaagagatacttgatgccaaaatgactgttatacaacgacttaacttcgtacgttttgaaaaa

SEQ ID NO: 605200 - DNA, 102 bp, Homo sapiens
ctgagtggttgtgtcggtcgcgtttcgacaaccggtagcgctttgcagcatggctgaccaactgattacggagcagattgcagatttacaggaggtttttta

SEQ ID NO: 605201 - DNA, 351 bp, Homo sapiens
ttattagacgctggagtgcaatggcatgatcttggctcactgcaacctctgcctcccaggttcaggcaattctcctgcctcagcctcccaagtagctgggattacaggcatgcaccaccatgcctggctaattttattttattttattttatttttttgagacagagtttcgctcttgttgcctagactggagtgcaatggcgcagtctcggctcactgcaacctctgcctccagggttcaagtgattcttctgcctcaccctcccaaatagctgggattacaggcgtaaaccaccctacctggccccccttccttgtatcattccgtccagttgctctaactccagcgtg

SEQ ID NO: 605202 - DNA, 314 bp, Homo sapiens
ctgggaaagcatccatgatcaagcaactgtgtatactagtgatatgaacatggtgtacaaatatctcttctagactctgctttcatttgtatggggcatatacccagcaagtggaattgccgggtcatggcaattagatttataattttctgaggaaccaccatactgttttccacagtggctgtaccattttacatttcctccaacagcgtgcaagacttctgatttctccacgtcctcaccaacccttgttattttctggtagtttattgttggttagccgtactgatggatgtgaggtgaccattattcac

SEQ ID NO: 605203 - DNA, 386 bp, Homo sapiens
ttatatccccttggattataagatgccataataattattaaaaataagacaaacagaaaaccagcattgataaccacagtgacaactttggtccccaactgcatgaaccctgcctacttttcctcttgcctttgtcagaaactctcatacttctgatgtcagaagataatatgaggaacgaagatacaaatttgtgtgcctttgatagtattagacacatcttataatctgatttagtttaatccttatggccacctgtcaaaatgggtagaattattcccattttaccaataaagaaattaaggctacacaatgtgcttaaagtcatataattagtgagagtgaaccagacttcaatcaggtgtgtctcaaatttagatgatgcc

SEQ ID NO: 605204 - DNA, 103 bp, Homo sapiens
tatcccaaacgcagagaggaaccgccgtagcagagaggacgcagagaggttcgcgttaccaaggaacgtcatactcctgtcttgctgatcctctctgcgtttg

SEQ ID NO: 605205 - DNA, 347 bp, Homo sapiens
ccaggtgtagactaacattgtaacttactactccggcaaaaaagaaccattggatacataggtatggttctgagcgtatgatatcaagttggcttcctagggtttagcggtgtgagcacaccatatatttagcagtaggagatagacgtagacacacgagcatatttcacctccgtctaccataatcatcggcgtatccccaccggtcgtctaagtatttagctgactcgccacactccacggtaagccatatgaaatgatctgctgcagtgctcgtgagccctaggattcatctttctttgtcaccgtaggtctacctggaggtctacctgggttaggtcagctgg

SEQ ID NO: 605206 - DNA, 1155 bp, Homo sapiens
  misc_feature (903)..(903): n is a, c, g, or t
cgccatttgagagtaggcgtgagaacgttgctctgtgatgctgatgcgttctaaaggaaggcgtccgttggccgttcgatacccgtcttgagtgagggtttcaaagccagaggagataaaggaaatttgttccccttgcaaagatgaatacattcatgatttgccctggtttctggttaatcgaagtattagatacgtttgttccttactttaattcttattattataattagcctccagttaccatccatgttgctgcaaatgacgaggatttcattgcttcttatatggactaagactaatagttccagctctgtatataaagccacttatgttctcttgttatctaagatgagcagtctggtgtcatgtcagccctaggctggatgtgccatgtgggcggcgactgttcacgctcatcgtgtaaggcgtcctggtctcaccagggtctcacacggtgatgttctggcggtggtacgtcagctcatcccgtggagctcgcgtaattagtgaccagggagtgctcggacacgcagtagccatgggcataaatttcttgctacgttattagctataagagtggccgtttcatcgcatttgttgtgggcccacgtgccgtggtcttgtgagaactttcactgtggaccgatcacggcttgcaatctttgcgctcaggctcatacggacactctcgcctagaaaagcagcgttttgaaggccaaatttgtgagccccaagcacagggttcatgtcccttaaatttaacgcggctgtgggacagtggcagcgtcccccgtgtaaagtatggcgcccctgtgtgttaccagtcgcaaagattccgcaagcactttcgggaaaactcttaaaggtcgccgtatttgacacgttcccaatacaaagggncgtttccaagaggcccgcagttggaaacggaatctgaggtaggggtccccgcctaaaaaagtgatgtctgcactccttttgaagaaagacaaggcagcaatttttaattaagagagccaaaattggggggctaattaaatggacagggtatttacctgggggaaaacggaaattccgaggggacttttggcatggaaggttattcgggggaagaaagaggattcccattgccacggttatagaaatgaccgg

SEQ ID NO: 605207 - DNA, 413 bp, Homo sapiens
ttagttatgctgtgcatatttaattgatgtactatgtttgatttgttgctgatactttaaatttgaagtttttctgagaaatggagcagcaatgcagcatcaacttgttaaattacatgttaagccttgaaaaaaaaaggagatcacatcagtaatcccagcacattgggaggccgaggcaggcagatcacgaggtcaagagatcaaaaccatcctgtccaacatgttgaaaccccgtctctactaaaaatacaaaaattagctgggcattgtggcacgtgcctgtagtcccagctacttgggaggctgaggcaagagaatcacttgaacccagaagacagaggttgcagtgagcagagatcgcgccactgcactccagcctggtgagagagcgagactcagtctcaaaaaaa

SEQ ID NO: 605208 - DNA, 316 bp, Homo sapiens
accatggggctgccagggtggggacagactgtgggggaggctgtggggtagaacctgctgccggggtggggacaggctgtggggccatggggctgctggggtggggacaggccatggtgggaggccgtggggccaggacttactgctggggtggggacaggagttcttgtccaaccgggggcacctccagggcaggctcatttctttccactggctaaattaattaaaaaaaaattcctctgaaacgaatactgagtcactttaaacatttctcagatgtaaatggaaatctaataaaatctgtgaaaggtatttt

SEQ ID NO: 605209 - DNA, 566 bp, Homo sapiens
attcctctttccccacgaatgtgtcttccccccttttggggggccccacaataaaaggggctcccctgcgccacatctcccactgtgacaaatgagccccctctcttaacactcccacgccctctccagcgcggggtactcacacccccttggcacgctcgtggggtcccacccattgtggagacaccccccaggacactgagccccctcccccctctgggggccctccccctctctctttccctcgggcgctctttatagagcacctctttttttttcccccgccgctgctccctccccctgtcggcccccccggcggcgcctgctcttcgtggcggcgcctactagaagagcggagagagctcctctccccccgccagcggctccccccacatcgtctgggtgctccccacacgcgatggcgacactttcgcctctatatccccctttccactctgatgtccgcaccctctaattctcttatatatatttacatagcccgcgccgctcctagagcgcctccgcctgttttctcctctctcccccacaaataatataacaaaaca

SEQ ID NO: 605210 - DNA, 661 bp, Homo sapiens
cctgaagttgccaaatacttccagtcaagctgatccttgacaaagcaaacaaaaacataaagtggggaaaggacacccttttcaaaaaatggtgctgggataattggctagccacatgtaggagaatgaaactggatccttatctctcatcttatacaaaaatcaactcaagatggattaagggcctaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatccagaatctacaacaaactcaaacaaatcagtaagaaaaaaacaaataatctaatcaaaaagtgagctaaggacatgaatagacaattctcaaaagaagatatacaaatagccaacaaacttatgaaaaaatgttcaacatcactaatgatcagggcaatgcaaattgaaaccataatgcgataccaccttactcctgtcagaatgggccttatccaagaatcc

SEQ ID NO: 605211 - DNA, 320 bp, Homo sapiens
  misc_feature (39)..(39): n is a, c, g, or t
  misc_feature (52)..(52): n is a, c, g, or t
  misc_feature (207)..(207): n is a, c, g, or t
  misc_feature (255)..(255): n is a, c, g, or t
ctcaggacatgagggcagtgggcctggaccccagcccgnatcaggcccttcncagatggagctgcaggcggtgaggctgggcaaccatcgcactgtgtggggccagaatccccgtcaggcccttctcctggcagtgcggggaggtccccacaggtaacacccatgtagctgccatgctcaggacacgtgtgcccgggcaggccagancccacacggtgggcagcggggactctgggtgatgggtagcccccattnaattcacggcagcttctcttacagttaaaagacacggaaaactggagcgccggcaccatcatttt

SEQ ID NO: 605212 - DNA, 195 bp, Homo sapiens
atctccccttcctccacagctccagttagatgaatctgatgtcagtctctcttggtagccaatacgtgtctgtctcccagccccgtaggatttcagcccatccttacctcataattgccttatgaagggtctgcagcgtggttggttcatgttcactcacagacctggttgccagttgcaagtcatagtgtaaaa

SEQ ID NO: 605213 - DNA, 207 bp, Homo sapiens
ttttttttttggtgactacaataatgtgtatttcaaaactgctataaagactattttgtaatgttttcaccacaaaaattatatgaggttataaacattacttgatttaacgattttagaagataaacatatatcaaatattacctgtagacagatatatacactatatttcataaatacattttaaaattttctttcatgacttga

SEQ ID NO: 605214 - DNA, 241 bp, Homo sapiens
atcgaatttaaacaaaagatacactctgcatgtctgcaggggcatacactacctgttagtggttagcataaaacctgtatacatttcatataagacataaactctagtgagcaactaacacatctgtccctattgtaatatcaacaggctctgcattgggagcagagcaggggcatatccacatccccagtgcctccagcggtcttcccaatttcacagcaatatcatttttactagttcc

SEQ ID NO: 605215 - DNA, 1044 bp, Homo sapiens
gaggtctagtgagggaaaaatgacattgattgctttgagagcatgtgatgaagggtcaggtccaggtttgggggagtcaaggaaaggctactctgtggagaagagaggatgtcagctgaagttaactagagtggaaattaaaggctgagcagaggagattctcaggtaatagcaatagcatgagcaatggcccaagtgggagaattgagtgcgtcaaggtgccagtagagaaagcccgtcagggcgcaagctagagcattgacttgactagtacacaaaaagagccttgtaggacatcagtcctaagagtatctcattggggagccaatgaagaaactggcagagcaaggggacgtaactgggattggacattttgatggcaagataaggatgcactactccgagagagtttgagactggtggtagaagtagggtgaggatcacatggtgtgaacacgctttggtaaaaaagaggagtagatggttggtaagctgggagctcggtaaagattgatatctttctattatcaagacttgtaaggatctgatcttccttaatataggaaggaagggagtcgtttccaggctctggtgagcatgccatgagaatcaacttggtgactctatgaaggataagccgtactaggaggtgtgaacagctggtcagaaggggcttttgaaatgtggtcattatcagggttatcagaaggagtgttattgtgagactactggcaaattttctagagcccacgtttagatgcttaagctacatttgatcattttctctggcgtgaatattgctggtcatgtgtgtcatgtgaggggtattggaggggcttgtggaatgattgctggagctatggatgaactttggggaactgggacagggcagtattaagatgaaagccaagggtatggtatggcagttggtcattctggaaataaagtggggatgtcatgtgaagttaattggcggcattgtgaaactgtatgaagagatgaaatggggatggaaaggtattgaacagaaggatctatataagt

SEQ ID NO: 605216 - DNA, 132 bp, Homo sapiens
accatttgcatcagcaattccacccaggtgcaaccccatggtgcagccccagatgcttttgcattcttgcacaggttcattcagttacttgcactccacatttcgggggcatccttctcagcagtacgcacc

SEQ ID NO: 605217 - DNA, 182 bp, Homo sapiens
ctcggccacgagtgcagtcagatcgtaactcctaaggcagcacgcatcggctgagtcagcattcattagatcgatagtggtggcgatacatctgacagatgtctattgatcgcgccgtcgcagtacagtccctggaggttgccctgccttagtcagcgatagcgctggtccggccccagcac

SEQ ID NO: 605218 - DNA, 789 bp, Homo sapiens
cctgtagtcccgagtgctgggattacaggcatgtgccaccatgcccagctaattttgtatttttagtgaaaccctgtctctactaaaaatacagaaattagctgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaattccaattttaatttctttaacttttttcacgtaaggtccacgtggtcatactaaacacgtgggtttcgggacaaaatactctctggagtccgggggtatttccagccaaaattttaacacctggtaagaatcaattcaccgtggtggggaacaaaactcttgggtctggaacccattttcataattgggttcccacgcatggaaggtactctagggttttagaccacgaggtctagattaatactcctattttacatttaaaacctttttattaataagtccttacattaaacgcgattttgggaactcttcttccacaattgtttcgtgggataaagtggtgaggggggcaaagaggggtttaaatccatggactcttgattgacccatcacggttataccggtctttacacttacaatgttgggaacgcagaattggatagttaatctatataaaaatactcacaggtgctcagaatataaaaccgtgggaaccaatacagttgtgtgggtggaagggcaaacgggtgc

SEQ ID NO: 605219 - DNA, 382 bp, Homo sapiens
ttgggtggcgttctagaggatcccgggttcctttgtcttagcaaagaacaattgaaattgaaattttaaaaaacataacatggccgggcacggtgctcatgcctgtaatcccagcaccttgggaggccaaggcgggcagatcatgaggttaggagattgagaccatcctggctaacacggtgaaaccccatctctactaaaaatgcaaaaattagctaggcgtggtggcgggcgcctgtagtcccagctattcgggaggctgaggctggagaatcgcttgaactcgggaggcggaggttacagtgagctgagattgcgccgttgcactccgttctgcgcaacaagcgtgaaactccatcgcaaaaaaaaacaaaaatcaaat

SEQ ID NO: 605220 - DNA, 122 bp, Homo sapiens
cttaccaggaactgttggccagttggttcaagccagagacattcagaaagtttttagctctatatttgcatggtgctgcgctgaggcggagaaccccttctgaatcctgaaaccccttcttg

SEQ ID NO: 605221 - DNA, 194 bp, Homo sapiens
gtccaatttctacagcaccatgcacacatgcacgtatgtgggtacacatacacactatacacacacatcccagaccatcccttcatttcacctagcaggatggtagctacagaaagcctctgtctttcgttatcctagcaaaagcaccactagctaccatcctagtgcattcgagaagagtgtctcccagaccc

SEQ ID NO: 605222 - DNA, 81 bp, Homo sapiens
gagagagatgaagggtcttactactgtgcctgtgacgaaccgcaaggggataccagctcctgggacacccgacagatgttt

SEQ ID NO: 605223 - DNA, 899 bp, Homo sapiens
gctgttagactctccagtggccaaagcccccagaggaacaaagacagaagtcttgttctttcagataggacattttaggggccagagatcactgtccagtagccaagggcaaagcctgacttctctttgggtaaagttaattttttaccacacaatagttaagtggtaatgaacaagagatatttaccaaaattttaatcttcttggaacaccttatatatgatgttatgtgagaagaatcaggattaaaaatatatatgtagtatgatcttaacatatacagtgtaatatgcaaacagcattatgtatctatgacattatttcatccatagaacacaagactgaaagaaaatacgccaaaatattaattcattatctccaggtaatggcaattatgtatacttcccaaattttcaacaagtcaacatacattatcatttaaaagcaacagttttaaaattctaactatgataattggtctactctttttggaaatgacgggccagagagtaacttaaaatatgtataaaagtgtatgggagatatgtagcaacacaccaactctcgcaacagcaaccacaacggcatcaccaccacgttgcgcgactcgactccgtagcattatccaggaactccacttacaggatatccacgcattccctgcacactgcgtacactgccatcataaataagagccagcaggggggcaaaaataaaacatcgcggcaggggacacaacgacagacagacaccccgggaaatgggacgggcagagcaaaaatggggactgaaagccattagataacacgacagggggggaaccatgttcagcgtataccagagtctaacaacaacaagccaagagagaccaaccgacagtcgcagaagagcaaccagga

SEQ ID NO: 605224 - DNA, 500 bp, Homo sapiens
ggaggacccacaataggcagactcagtttctccacaccccactccctgtggctctgagatccccaacggtgctacaagacacactcaggcattattcaagactcacagctattttatgaattttccaagaaagtgctttgcatttctgtaaatagcaagagatttccaagtgtgattgtgggttttatcattgtaagcaatttgtgatagaccaaagtcagctactgtaaatgacttgctagaaaaaaggaaggaggtagcctcaacagacttgttataaaacatttaaaacttggtctcaggtgcgtgctatggaaaatatactcgtatgttgctgtgaaatcataaagtagcacctagtacagtgcctcaaatgtttaatacacgtcccgtaaatatgtgttgaataaaaaatgaatcaatgtcattaaggggacttgctcaaacctcagatatcctctctgcctgcagtttctcaaattaaatgaacttttcacttt

SEQ ID NO: 605225 - DNA, 775 bp, Homo sapiens
  misc_feature (15)..(15): n is a, c, g, or t
  misc_feature (44)..(44): n is a, c, g, or t
  misc_feature (66)..(66): n is a, c, g, or t
  misc_feature (95)..(95): n is a, c, g, or t
tgtaacatccggganccaagttcctattgaggattaagcaaccnagagaaagaccccctaaacttngatcttttgccccatcaaagaagcacccnaagcaggatgcctccctgaatcctaaagccaattagcagtcagccaggacagctgctagagggggtctaagggggagtggagaggatgttccaggcagagggaacagcagacaggaaggctcagaggtgagtgtgagcaggcagtctcagggaccccagacagttggtgaggctgcagtgctcaggggaggtgtgccaacaggtaagctggcagggccgggtccctgggggctggcttgtcctttctgccattgtctgagagagtgggtggctggtatctggtggcccagatgaagataatggagatgcaattgtgttcttctttctgctcagtgcctctcagttaaggacatttgcaaaaattaataacagcatatgcttttatgtcctccacttaaatttcctttggattaaagaaagtaacggagggaaaggaagaaaagcaggaaggagcgagagagggaggggagaaagagacaaaagaaggaaaataatttggggaaaaaaaatttgtccttttctgggctaagatagccccagcctttgcattttctcacccattgagtcaccagcctcctgccctctttcaggactgtacatcttggcctcttacctactgtgtccgggtcagcctccctcacagcctgatggcccctgcgctcgtgccgaattcggcacga

SEQ ID NO: 605226 - DNA, 382 bp, Homo sapiens
  misc_feature (10)..(10): n is a, c, g, or t
  misc_feature (44)..(44): n is a, c, g, or t
  misc_feature (129)..(129): n is a, c, g, or t
  misc_feature (316)..(316): n is a, c, g, or t
  misc_feature (374)..(374): n is a, c, g, or t
taagcttcanaccccccggatatgttttattactgttagataancttcaaagagaaaccgtgaaaatccttatttccttcaagatcttttaagaacaaaaaaggccttatctcagcccgagtgcagtgntcacgcttgtaatcccagcactttggtaggccaaggcaggtggatcacgaggtcagggaattcaagcccagcctagccaagacggtgaaaccccgtctctactaaaaataccaaaattagccaggcatggtggcaggagcctgtgatcctagctactcgggaggctgaggcaggagaatcagttganccagggtggcagaggttgcagtgagctgagatggagccactgcactccagtctgggcnacagagtg

SEQ ID NO: 605227 - DNA, 198 bp, Homo sapiens
cctgaagccccaggtactcaaaaggctgaggcaggaggatcgcttaagcccgggagtttaaggatacagtgaggtatgattgcaccacttcgctccaggctgggtgattctctaaaaaaaagatgaaagaaaacgatggcaggatgtgaggcgctgctaggggactgtgaaggtccctcaaccctttctacatgcctt

SEQ ID NO: 605228 - DNA, 824 bp, Homo sapiens
ctttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccagcctgggcaacaagagttaaactccatttcaaaaaaacaaaaacaaaaacaaaaaaaaaaaacaacacgaagaactactctgtagtgagagctagaatcctcatgttgtctatttacaattttgggccaagtacagtggctcatgcctgtaatcccagcactttgggaggctgaggccagaggatcacttgaacgccaggagttcagttacagcttgggcagcaaacgtgagaccttgtctctacaacaaaaatttctctttacacttagccacggtgtggtggtatgcccctgtagtcccagttactcaggaacgcgaagcaggagacatcggcttgaaccacaggcagtagagggtgctatgacctaatgattgtgccactgcactccagacttgggcaccagggcaaggcccttgtcttcaatacacataaccgttacacatgccttcagtatgcttgatactatttggaaagaagatacttcggtgttaaagaccacatggtctgtcagctcccccttgagtatatttaccatttaagccttcacttgacgcccttcgtcttcaagggtctaaatatggccggcgacgacctaccgcctg

SEQ ID NO: 605229 - DNA, 414 bp, Homo sapiens
gtcaaacggtatagaacgtgaaggagatagagacacaaaaaacccttcaaaaaattaatgaatccaggaacgggttttttgaaaagatcaacaaaatcgagagagggctagcaagactaatgaagaaaagagagaagtatctaataggcgcaataaaaaatgataaaggggatatcaccaccgatcccacagaaatacaaactaccatcagagaatactacaaacacctctacgcaaataaactagaaaatctagaagaaaaggataaattcttcgacacatacaccctcccaagactaaaccaggaagaagttgaatctctgaatagatcaataatgtgttctgaaatggaggcagtaagaactagcctaccaagcaagctggaatttgacttgaggtaaagaggagatagta

SEQ ID NO: 605230 - DNA, 149 bp, Homo sapiens
atatgtcgtctgcgattgagttgtatgagctcttcctaaatccgtgaatattagaaccttgcctaatatatggttggcacatatttactccttatctgtacattgccttatcattttgttgattgtattcgttctgtgtagaaatagaa

SEQ ID NO: 605231 - DNA, 896 bp, Homo sapiens
taatgtggcgaataccagggtgaacgccccgtggtgcgccagcctcagacccccggggattaaaagaggaaggtgttgtgcacacagggcctaaggataaccgcccgccgtggcaaaaccgctctgcccgtgtagcgaagggcagcgactggtgcggagtaggacggccgggacgaaggggttgccgaatccccctggcccacaccaagaaatcagaacagggggttggtgccacaattaatttcccaaccgcccccggaaaaaggcgtggggtagtcacaccccaggcgtccacgaagactggacgacgtggtagcaccaaggtgtgcgacgaggaccgccctccatccgcggttgtaggaacccccgcggccagccacctcccccgggccccgcaacagaagatccccgcgggaaaacattcaaaagggacaattgaccccccccggcccaaacaagccgcccccggttcgagggaggaacaaataaacagagcacccgcagcgataatcttgtggcccccagccggcacgcaacaatgtggcgtctcccccctgcaaagggcgggcccccacaaaatccttattcctcgattacttggcacccctttcccatcagcacctctggttctcgaaaccctttgagtatcttggacaaccttccgcgatagaataataacattattcataaaaacaggatgtcttgctccttaaaacgtctacacccctgtaggacgacttccccatccccccccgtatcagttagtcaacagcatcgaatatgaattgcaaaattgttcacgcttgctccacgaaaccaccctgattctctaggagaatcccattcaccaaaaaaggggacccaccagaaaaaaaaattggaggacaaacaaaaca

SEQ ID NO: 605232 - DNA, 706 bp, Homo sapiens
  misc_feature (68)..(68): n is a, c, g, or t
acagatcgcaggctgattgagcaagcaacaagcatgcagtgagggcaagcaaggaggagctccagaanagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggttgtttttgggggggtgctatcccacgattctgagccctgagtatgcctggccattgatgctatcatgaccctgcttgggatgtctctacctggtctggggatagctggagcacttactcaggtggctggtgctttgacacctcagagggactgtgtgctatagagtggagagaggcgtgttctgtccaggtctttgacaggtgtaattctcattcaattaaagtttcaccgttttcgctacgtggcgcccgccttccccttggttccacgtttgggccccccccctcttgcttaaataagttgcgtttcctcataaactttttcttccgccttgtcttgtttattttttcatttcggctggtttttcttccgccccccttttggggtccttttcgcctttctcccccctgggccctccccttcccctcgccgtggctcgtggttcgtccacccggtcgggtggttcattcccttgggtaaacaaaatat

SEQ ID NO: 605233 - DNA, 460 bp, Homo sapiens
ccatagtgagaatgtgaaagtttggaaggaaagaaacgggtgatagaaagagagacagtgttgggcgggaagggtttacttgaaaatttaaacactaaggcgggttgcgcttgtacaagcccagtatgtgacatgggcgagaataaggagcctaatgggcaacccacagagagggacacgtgcggtacggccccaagtaaaggcgcgccagaaggggtagtaacgggaaggaatgggcccgataaaaagaaatacagaaagggggaagcgacgcgctggcgaagttgtaatggggggggaggtcaggtatatgcataaggaaaacacgggggtaagtaaactagataacgacgcagcggcgaccgaggcaaaaatacggtaaagatggaaagtgggtaagtgaaaagccgagaatacggcgggaaggtaaagaagttaggaaaatggcatagggcaaaga

SEQ ID NO: 605234 - DNA, 387 bp, Homo sapiens
ctaaaaattgcaggggattgctatgataaggagaatgtctccccaaaaatgtccatgccctaatccctagaacctgtgaatacattatattacatggcaaaaggggcttttcagatgtgtttgaggctgtgagccttaaaatagagagattagcctagattatctggggtcgggatggggtggcaatctaatcacatgagcccttaaaaccagagaaacttctctggctgggggcagaagagatgtgatgtgacaaaaacggaagtcagagacttgaagcatgaaaacggctctatgcaccatcaccagaacgaagatgaaggaggcaacatgatgaggaacagcctcaaggagatgagaaaggttagattgcagcccggggggaag

SEQ ID NO: 605235 - DNA, 122 bp, Homo sapiens
aagcaggtagatcgcttgacgccatgtctggcaacatggcaaaaccccatttctacccaaaatacaaaaaatttagccgtgcatggtggtgagtgtctgtgatcccagcgacagggaggctg

SEQ ID NO: 605236 - DNA, 218 bp, Homo sapiens
ggtaactgcactgactgcagatattacaaaaggtgatctaaaagcagcaatctgagcttccatcttaggaaactagaaaaagaagagcaaattaaatccaaagtaagcagaaaataaaaaatcgtaaagattatagagcagaaatcaatgaaatcaaaaacaggaaatcaatagaggaaacaggccaggcgtggtggctcacgcctgtaatcccagca

SEQ ID NO: 605237 - DNA, 224 bp, Homo sapiens
agagaggattaaaatattccaggagggggtccgtaggtaacgtgcaaccgtttggccatggccaataaggaactggggcatcttaaaaggtcggggtttgagggttgaggttgaagccctggaaccaatccccaatggttcctgaggcatagttgacctgggggttttaacttggttttaaaacttacaactggaaggggaccgattccattaaaggttttttt

SEQ ID NO: 605238 - DNA, 416 bp, Homo sapiens
agagagggaaatgctttcctggtcttagtgtgaattgaatgtttccattctgcccctgcctccctaatacagcacctagcccactaagcagagtggatacctactcctggcttgtctggcctggaaactccttgaggacaggagcctgtctttgccctttattctcagttcctcccacaatgcctcctacacaatggatgcccagaagctgtttgtgactaagccaatgagaacatgcaaaaagagctttacacgttgtaaaatgctacacaggaaaaaaataccactttttataaaggagttgcatttgcacttccctgacttctggatcccctcaagttaactttaagagaatgacattctatttcataggtggggaaaccgaggcacagagatgtcaaactggaagtctggcc

SEQ ID NO: 605239 - DNA, 1548 bp, Homo sapiens
  misc_feature (680)..(680): n is a, c, g, or t
tagaaaaaaacacagagctttattattctcaacaccaagggcaggggtcttcataggacagaggagtgagttctgtcaacagaacagggcggcccctaattgtggcgcggcgaatgaagcgggttccgccaggaaccacgaatgactgagttccccggcgcaggaaactatctgtggagaatgtaggcggtcttgggtggactgggtctgtggacttcttccttgggcccttgggccactctcgtgggggttcccctcagtctccaaattcttccttctcagcgtgttcctccagacaccagtgtgtgtgcaggtgccatattcgaaaggcctttcagcgcggccccagggaggttccctataatgggtgtggcggcacagttgtggagtggacgcccacttggcggctattgtggtctcttggagactgtgcacgtggtgtgtggagcccacgaggagacagtgtggccacccggggtgtcttaaacactctcctctcccttcctctctctcgagctatcgggggcgagctctcccctctggggagaggctccacctctttacaaccctctgtgggggggcctggtagagaaagagagagcgcctccacgtgaatggggtccacccaataaccgcccggggaaagggagaagacaaaagaatgggggggggggaaaacncttataaacataaaggcgtggccatcggggggagaagcccgggggggcccaagaaacccggggctcttgtgaggggggggccccgggaaaagggcaaattaacaacttccacaggaacggggggtggcaaaagggccccggagaaaaagtttctccccacgggggggggaccccaacttaaatccatgtgggggcgcgtaggcaatgtttagaacgggaggggcagccggtggcgaccgggggggggggcgggaaactcccaaagaaaaaaaaaccccaccggggtgtgtcccataacaattcgggaccaaaatatcgagagtgttgacccgtggtacacaacgtcttgagaaccccgataattttcaggagaacggggaaatattaacgggagagtagaccagccaacaaagcggcaccaacgcgtggacgttagattaacccccagggggcgacagaacaaaaccgggaaatggcctgtgggtcgccccattacacagaggctccggggtgtccccccacagaggcattaggtcatagctgtgagaaagatgatagccctccccggtgttgggtccacacaacagatgcaaggccacagccgcccttttataaagtgggagaaagtgtggtttacaccgcacacccgcgaggaaaaaaccgtatgaagggcgggggacagaccaaaccagcgcgggcgggtgggacgcccaccaacaaggggaaggggagaggggatcgaccagcggccacatgaggagggctaacaaaggaggagacaccctatgggcacggagaagcacacgagagagaccctacacgatgatcggaatgtaggcatcagcaacgcaggagggatcgagcaagg

SEQ ID NO: 605240 - DNA, 287 bp, Homo sapiens
  misc_feature (45)..(45): n is a, c, g, or t
ctaaagataggggtctaaaagctacttccacacaagtaagaatanctgcaagatagtcagcttatcctattacgtcttcatatatcatgaaggctccctgtatctataacaaagcctgccctggtctcttcaaaaccattagtagaacttctggtttacaaaaactagactccacatttcactgacatctccgacctatttaccaatcacatatgcgattttcattatcgaaatacactgcaccaaacacatcacaccggaagtatctcaaaagcaacatgcacaaa

SEQ ID NO: 605241 - DNA, 170 bp, Homo sapiens
gggtcgttagccatcacaggtaaatgggtccttgtccccgtcctttctataatttctaggaatgtactttaatagaaagctgtatagtgtatgtctccaaatctcaagcagaagaataagagaagaaaagaaatgaacaaaacttaataaaggaagctccccagaagctt

SEQ ID NO: 605242 - DNA, 204 bp, Homo sapiens
aaaagcgagagtgctctccctccagtaccgcctgaactaagagtagtgaggacttcagcgccattgattacctcctcttctcttctttccaggagttcctgcaagcccaaacatggttagtgcttcatcgctggccctgtgagagtgcctatccagctggaggtcctctgggggcttccgcacctggtcaagatgtcacgtggt

SEQ ID NO: 605243 - DNA, 489 bp, Homo sapiens
  misc_feature (24)..(24): n is a, c, g, or t
  misc_feature (63)..(63): n is a, c, g, or t
  misc_feature (109)..(110): n is a, c, g, or t
  misc_feature (115)..(115): n is a, c, g, or t
  misc_feature (121)..(121): n is a, c, g, or t
  misc_feature (160)..(160): n is a, c, g, or t
  misc_feature (205)..(205): n is a, c, g, or t
  misc_feature (300)..(300): n is a, c, g, or t
  misc_feature (389)..(389): n is a, c, g, or t
  misc_feature (487)..(487): n is a, c, g, or t
caaattatgtttaacttataacanattttgtaaaggccccttaggttaaccattttgggagtntacattgttctgaggaaaaagatatgctttcaaaacactatctagnnattcntaatcntttttctattatgggggttggggttcgggggttattgcnacagtgcttgtggcagtgaacaggatgtgaaatgtatcagaagantaaattagtgtcatgggacataaacgtactaggtggtcgggtgggtgctgggcccttagcacagagaattattaaggggttgatttgagtgttanggtttgtgacattaaattaccttcgtatttcaaacattactttttctaaaccaaaccagaagttaatcaacttttcctctcctttaggnacaaaaaggatatttaagatattttccaaaacagtaaaaacaacttagtgtttcaatctagttacaacaaaccctgttgatcctgtgcatttcactgngg

SEQ ID NO: 605244 - DNA, 440 bp, Homo sapiens
ggtcgacaattttggcatctttggatctagggattccaaccatgtcatcaggaattttttttccccccccggcctttaattaacaattcccagccttcccccccaggtggaatccttttcctggaagcacctcccaatgcggtgccaaaaaccaatgctggtggcttaacacttacatcctactcctagagaccccggaatccggactgattggatagctctggaaaaaatcctggggatgagtttgaattgactggatttgggttcaaagataatccatgaacaatccactgttaccagggtgattgtgtcctctgagcaacacatcctgtaatagatgtcacccttggtgctggaagttggggtcagactcctgagccacttggactgtgactggggatgggacattttccaaaatattctgggaagaaagatgtcta

SEQ ID NO: 605245 - DNA, 213 bp, Homo sapiens
gagtcagggatccctgagatagcgtgagagatggaacagagaggactatgggagagatcctccaaccctgagcagtggccaggcactcgatatgacaagctggaagagcctgaagaacgagctctcagaggagaacgaagggaaagagcctccacgaatcctccagacgctcagtccagggccgccagtgtcagccaccctgacctggggatc

SEQ ID NO: 605246 - DNA, 81 bp, Homo sapiens
gcctcggacaccgctatgtattactgtgcgaggcaggaaggagctaggcggatcagcgctatggacgtctggggccaaggg

SEQ ID NO: 605247 - DNA, 266 bp, Homo sapiens
agatcacagtgcccggccaccacgttatctcttatacctgcctgtcacataggatggttgtgaggtttacttaactgtcctgtgctgtgatcactcgcaggccgggtccctcacttggtgctctgctgctgctttcactgtaatcgtcttcatcatcatcatcacccccgaaattggagttgtgtcttccaggccatagaactgtcctgtaccatggggctgatatccagtctcgaggagttagccaagccccgagtactgtgtgt

SEQ ID NO: 605248 - DNA, 123 bp, Homo sapiens
gaatatacagaatataatgaagaaaagaagtacggaggcagaggatattggcccggaacaaagccaaacgaccaagagcctggaaaagggaaaaaacaaaggggtggcacaacagaaggccgg

SEQ ID NO: 605249 - DNA, 365 bp, Homo sapiens
tccatgctaagtacagtctgctgtgttttgcttatgtactgcgttgttgttgggtatttttgtactagtaatgtcttggttttggtcttcttgccgtgttgcaaaactgtagaaagttgcttattcaccggccttggttccattgaagtctgcgtctcgagtgtccgtttcctcctcagaaccatctgcattttcaataactctacgtcctccagaccttccagaaggaacgaaagaggtctcgtttcctcgcctggtgcatcactgcgaagtttcctgtggggggggccctctgagcttgctcttgagtgcgttcacctcgcggcccatggcctcgttgctctccgtggcctcatcctaccaaa

SEQ ID NO: 605250 - DNA, 133 bp, Homo sapiens
ttatcccctctgcttcgcaagtgccaagggcaccactcctaggtgcttgttctatttcgtacgtggttcatcttcctaaattcctgcactaatccgctgccttacaccactccttggcctcgtccatatgcaa

SEQ ID NO: 605251 - DNA, 1197 bp, Homo sapiens
gggggcggcgtggtgtggatgcgatggaacaagatagcagcaaaaagacaagatatggcttactgttgctctgcttcgctgccatcttgttgtggggcgatcgtctttttttaagatctctcggtgagccgatttgtgtgtccccactcgctgtgttcttttttcgcctgtagtcccctcttttgtgtgtgttgccggtcgtagatcgatgctcgtgtcgcgatattgttgtattgaattttttccccgttgggctccccgatatgcgcggcttgtctgctgggtccaccgttttggaaccacgagccagagtgtggcccctgggcgatgcgttggccgctttccgcggtgctcggtgtggcggctcttcggacgccaggtgtgtcgcgcagcttgccgggcggagcagaagttttcagaaagcccttggaggttcacacgccgcgccggattttttggccgtgactgacccttggacatcgtcaagaccagacaccgtgtgtttcagaattgtaaggttttggatcccagctcgagtcgacgtgcgcggtcattggtgcccatactgggaagaccatcagtccgccctgatctttcagaggcgacccccccaggtggacatttcccccaggacccagctgacaagcactcactgggcggatcccggaggcccggcacggaggtggtcaaggcttaaaccggagccaggctttgccaccctttccactggcgtattccggcgcccgcctttgtcttctcccttgtggaatcccatgaatggaaaggaaggttttttggaaatgttccttcgttatagtcacccggaaaccggaatgtacctacttttccaacacccctgctgcttgggaaaaagggcattcgagaagaacctgggcactcggccaagtttcctcttttgaggagaagatgattctcggatgccactccccgagctgaaggcctccactcagaagggggaagagtttcgtgagagagccctgaagtgagcccctgtgacgggtggccacgtttccttataatttattgaaggcactcactgtcacctgccaagccgcttgcagataaactttgtaattttaatttgctttggtgatgattactgtattgaccatcctcatgccttcccaattgtgggtggctctgtgggcgccatccaattaaagccgtccttgattt

SEQ ID NO: 605252 - DNA, 489 bp, Homo sapiens
gcagtcgtatcaacgcagagtgggccaggacaggccgggcgcggtggctcacgcctgtaatcccagcaagttgggaggtcgagggtaggtggatcacctggaggtcgggagttcgagaccaacctgaccaacatggagaaaccctgtctctattacaaaaacgaataaaaaaaaaaaaaaaaaaatttttgggcggacttttggacccttaaagaaagtttttaaaaaaacttttgtttgggcgagcgaagacatagtaaggaattaagtgtgacaatgcggctaatgcgatgttccttaaggaaaattgggctatggaataaatgggaggggatttttcgacaaattaaaaaaccgcgggggaaccaggaccggttgtggacgaaatctcaaaaatgtgagattcgaaggcgaaataaggggcctttataaaagaggagcttcgagcgaccgattacgaattacgaaattaagccaaggcgatgtggg

SEQ ID NO: 605253 - DNA, 438 bp, Homo sapiens
  misc_feature (345)..(345): n is a, c, g, or t
  misc_feature (353)..(353): n is a, c, g, or t
  misc_feature (412)..(412): n is a, c, g, or t
gcatactatttactttacatgattccacaccttggcttttttctctaaatagcatatcttaaaagggagtgcatgtctgtgtagagagagtaccccgtttgcacacctgaatggtaattccattgtgtataagcactttggtttattgaaggacagttgtgttgtgtttgcccgttacagtgttgtagtgaaaaacccttggtaaagatgacatttcacacaagtgcaaggaggattgttttcctggggttacaggggtaaatgcaagtggggttttactatttttaatgcctcttacccagcaaagcccatgaagagtgtgcccgcttccctccacaagttttngcccaacnaaagtatggttttccagcctttttgggtaatccatccagtttgaagaagaaatgggtcnccaagtggaaggtttaaatttccatt

SEQ ID NO: 605254 - DNA, 251 bp, Homo sapiens
gagtaggacaaagctggtaggtttcaatctggatacaaatctaaatctcccattatccccaagtgcattatagatgaacgctgattttgtctggacccaaatagctatactaatagtttttgttgccaaccgacttacgcgaatacgattgtttaaattattattaccacactggaatgttgaccagacaagcttaacctgcaacttcagatctaaagaagcgttaatgcctgtttaagcttaagcgggat

SEQ ID NO: 605255 - DNA, 1104 bp, Homo sapiens
gatacgtgctgagctgtattgagctgacaccgttgtagtggatatgggataacccccggtggaagaggctgagcagtctggggccctggtccgagagttccttgctgccatggtagcccgagtgcggtctcatgcctccggactccgcacgaatgatgtggccttcgtcacagttcctcgtgggaatggagactgcttgagcgaacgagaggaatctgaggtcaccagggcacgacaggtatcgagaccgtgcggtccatggccaggtgttgtcactcgatatgattcggtgctatgatcgctcgtgtgcgagacgtggcgactacggtgcgttgtcgaggagtacgtgcaagaccagtaagcatcgcgattgctatacactacttgggagattaacctcgttggagctggttgtgccaaagagggtcaccctgtggattccctcaaggattggtcgcacgcctaccattgaggaacggttgggggtggacgtacggtggtcactggcgtccatctgggctcgaactacgccaaagtaactcgcttattgagtccgctccatacctgtcatgggcattggagaaccacatgtactggtttcacacgcgcctactgcggccaggcctgcttgctaaaccctgtgaaggggtgtaaacaccatgacaaggaccaggcacttgtgtggcaccacgcgggacgcgttgcataactctgtggaaagaacatgggcgttaggaagcgtgggtcatttcgtacgcacggacgtgtggattccccctgtgctggcatgaccctgtgctgaagaccggggccaaagtgcacattggccccaggagcgccaaagttatctcataggggaattcctgcgaacatttgcaggcgccataggggccaaggcgtatataatacccattcactaaacactttgcgtggcgggttgacccaagtggcattctacacgccctcccctatggtggcctctacaagaggttgcgtaccacttcggcgtattttcgggattggatggtagggtgaccaagcatccgtttgccaaggttagtccaagggtagtccttggtggtacacttgaaacaaagggcatag

SEQ ID NO: 605256 - DNA, 357 bp, Homo sapiens
cgagcgtagcgggtcgatctaagatctcacataggtctgccagcctcacctgaaatggagcgtcttccagccaacatcccatcgtggcatattgttggctggttctcttggagctggtaatcgttgaagttgtggccggtgtgtgatgtggaggaagaaagagctcagatagaaaaggagggaagtactttcaaggtggaaacaaggaaaggggccagggctcttatattgttttcaaaagttggaaaggggtgagaaagctgccttgtggtgggactgagaaggcaagatttgttccttgcctttccctttgtgacttgaagaaacctgactttgtttccacaatggcacgtggat

SEQ ID NO: 605257 - DNA, 154 bp, Homo sapiens
tagtgttggggcactcttgcggggggattcttctcttaatctttcagatactttgtctgcgaacactctttaatgtaccacgatcaggcatttgagcggaagaacgaatgtcactttaaggctggaaagacaaattttattcttcataaagttg

SEQ ID NO: 605258 - DNA, 85 bp, Homo sapiens
tccattgtgcaatttggaacacaagaaaaagcatggattttgaagtcagacaaatcatttacttcggttgcattggtgtgtggtt

SEQ ID NO: 605259 - DNA, 260 bp, Homo sapiens
tccctgttttgtgtgtgtgctgtgtgctagtgtgtgtgctgtgtgtgcatgtgtgtgcgtgtgctgtgcgtttgtgtgctgcgcgctcgtgtgtgtgctgtgtgtgcgtgtgtgctgtgcgtttgtgtgtgttgtgcgtttgtgtgtgtccatgtgtatacgtgtccggccacgtggccggacacgtaataggagtacctgagatgtagcagaaactcaggcttcactgtttacgtgtccggccactacgtgtccggcca

SEQ ID NO: 605260 - DNA, 111 bp, Homo sapiens
gagtatcgggggtgctatacggtaaatacgggccctatttcagacgatttttaggggaattaattctaggacgatgggcatgaaaccgtggttcggggtaccgagctctaa

SEQ ID NO: 605261 - DNA, 130 bp, Homo sapiens
accccgttttaatttttccagtctggtatgaaggatccctggggttgcaagtattccagttcacttctgcctttctggacaatctacagaagcaagtgagacaaattaaatattgtataattttaagcta

SEQ ID NO: 605262 - DNA, 100 bp, Homo sapiens
cgcacccctccctagctttgttcgtagtgatgctttctaaggcccacttgacttcacattccaggatttctggctctaggtcagtgatcacaccatcgtg

SEQ ID NO: 605263 - DNA, 395 bp, Homo sapiens
atcgggcgatctgttcactcatccatccatctcatccatgcatccgtctatccatccattcatctatctacgtacccatcatctgccatctattcatccattcatccatctatccatccactcatctacctacccatcatctaccatctattcacccatccatccctctcatccatgcatccatctatccatccatacatctacctacgtaaccaacagctaacatctattcacccaaccatccaactcatccatgcatccaactattcatcttcctacctatccatcagctaccatctattcacccatccatccatctcatccatgcatccatatatccatccattcatctatctacctgtccatcatgtaccatctattcacccaaccatcca

SEQ ID NO: 605264 - DNA, 801 bp, Homo sapiens
  misc_feature (226)..(227): n is a, c, g, or t
  misc_feature (234)..(234): n is a, c, g, or t
  misc_feature (253)..(253): n is a, c, g, or t
  misc_feature (257)..(257): n is a, c, g, or t
  misc_feature (265)..(265): n is a, c, g, or t
  misc_feature (286)..(286): n is a, c, g, or t
  misc_feature (395)..(395): n is a, c, g, or t
  misc_feature (449)..(449): n is a, c, g, or t
  misc_feature (745)..(745): n is a, c, g, or t
tcccccctctactcaggggcagggcacagtcacagcgatcccgacatcgaatgtttcccactgcaccccctccgtgactacagacctgggcatggacccttgcacatgtccctgcctcgcactagtgtttgagcgagaggaaggggccccgttgtctacctggccctgcaacggcctcccacagtcgattcgggttccctgtgcccattattcagcaaaagcctcnngtgtcanctggctgcctccactcccncttncctgaccntgcggggcttggctgagagantggcattggcagcaggtgctgctaccctccctgctgtcccctcttgccccaacccccacgcacccgggctcagggaccacagcaaggcacctgccaggttgggccatanctggcctcgcctggcctgaggtctcgctgatgctgggctgggtgcgaccccatnctgccccaggaacggggccggcccaggtgggcgggcagcacacgacaaggaggctggctggggccctatacagatgtgcccccccatcctggccccatccagtgtacccccgcccacggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaangtgattttaaagagtgaaaaatgagactatgcgtttttataaaaaatggtgcccga

SEQ ID NO: 605265 - DNA, 671 bp, Homo sapiens
  misc_feature (49)..(49): n is a, c, g, or t
  misc_feature (71)..(71): n is a, c, g, or t
  misc_feature (120)..(120): n is a, c, g, or t
  misc_feature (265)..(265): n is a, c, g, or t
  misc_feature (319)..(319): n is a, c, g, or t
  misc_feature (615)..(615): n is a, c, g, or t
ctgacgatggccgtggagttgcccgactccttttccccatgaaataacnctccctgctggaggggttcctncagagggatgtcaaccggagattgggctgcctgggccgagggggctcangaggcgaaagagagcccctttttccgctccctggactggcattggcagcaggtgctgctaccctccctgctgtcccctcttgccccaacccccacgcacccgggctcagggaccacagcaaggcacctgccaggttgggccatanctggcctcgcctggcctgaggtctcgctgatgctgggctgggtgcgaccccatnctgccccaggaacggggccggcccaggtgggcgggcagcacacgacaaggaggctggctggggccctatacagatgtgcccccccatcctggccccatccagtgtacccccgcccacggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaangtgattttaaagagtgaaaaatgagactatgcgtttttataaaaaatggtgcccga

SEQ ID NO: 605266 - DNA, 1354 bp, Homo sapiens
ttctccactcttctatctccgatataaacgcgttgccaaacatctcgtgagtgtgttgttatattcccatgtctctgtattgtctgtggggaaatgtatttttgagcctttcttttaaatactgtcccaaaagtaagtataagtcccctggttacctccgctcggggaattatttgtgtcgttgggccaaactggtgtatcttgatggtgtcgataagcttaatttgctggtgccagaattgaaaggggggcaacatacatatatgtgtttgtggcccttggagtaattcaagcaccacatgtcacatcgctctggtattgaccgcccgtccttgggatcctggaggaagaatacgcacgggggagaaacgctcggctgtcttgtggggaataatagggccacatgggcaattcacgcactttcataggcccatggcacaatattgaattaggtgttgcattcacgcagctattcctgcatgctggcaagttggactcctcgtaaatgccttgacatacgaacgttcttgtgataacacatggctcaagcggctctcgtactggccgttgtttggctttctctgtcttgttaattgtttcttcgttccacgggggatactccgacgctgttcctcgcagactggtatccctgatgaacctcatgatgacagcttggaagactgagtcatcaacctccacggctcaccaacatgtgcagagctttctctcggttggcatcggtgtgtagacatatccctaaccacgtgcccaacagtcaacacgaaatttctacactctgtcttcgttcttactgggcctctcgaccctttataccaagaggggctgtagtgtaaaatctaggatgcatagttgcaaccaccaggatagtctgctgttctccgaatgaagaggattccccatttaaggtatgtcgacgacggcggaaatggtgaggaagagtcgcggcactatggtgtctggagaagaaaggagcggcagcagggcgcccacgagcgagggatagtccagacccgacacaccagtacaccgaccccagacgcgcaacgccccgcgtgtaagtcaccacagcggtttctggaaaaggcagcatggcctctgccagctctttctactaattgttcagactgagcaaaagatagtagtatttagaagaagtttctaaaagattagtacaaaatgttttctgctagtgaaaaaaaaagttctttgggaccgggcgtaggtggctcacaccctgtaatcccagcaccttgggagactgaggtgggaggatcactttgagaccaggagtgtgagacatacccggcaacataagacatcctaccaccctcct

SEQ ID NO: 605267 - DNA, 235 bp, Homo sapiens
cgggcaatcggtgtactcggcgcgcgaactgagccgccagccgctctaccgcgagccgaaccaacgctcctacagctacgtcaccgatccggacggcaccaagatcgtcgacgacatcacgctgccggccgccgggctgaacacctatctgttcgaggtggtcaacgacaagaaccagatcatctccaccgaagtcgtggaaacggtcaggcgcctgtacatccaggagatcatg

SEQ ID NO: 605268 - DNA, 901 bp, Homo sapiens
  misc_feature (1)..(1): n is a, c, g, or t
nccctggggccacaggggcttctctccggcgcggtgtacccgttcgctcgtccgccggccacaggttttttctcccgccctgtgtcgggcctccgcctcctcctgtggcgcccgccgtaatccctgcctgcctcccagttttcgtcgcgcccagaatccgccatgcagtgtcccctttgggccgccgtcctcccctcggggcgcttcctccctctgcgaaacaccccccttcctgcggggtggcgtggcccccccatgctccctccggttcagggcgcacataggtaaccccctgtggtcgtctcccttggggtcgcccctcgcttgaacccccgggcgggtcgccccgccccccgttcttggccccccggtgggcccccccctgcaggggcctgtggcacccgggggcggtgttttccccccctcgagtgattcccccgtagcaccgcgtgggtgcctgtcccccgcttggtttttcttcttctgtctcaagacattatagccccctcgtggccgagcgcctcccgctgtcttcaccgcctgttgatatgtccctccccacccctatgtgccgggcgcccagtgcggccgcgccagcctcgcggcgtcccacgacggtgctgtaggcatcccctgtccttgtaaacccccgcgcaccccctgtttttcctttacaaaataccccgcacaattatgtcttggggcccagacatgcgcccgcgcgccccggtatctcccaccacctgtcccctgatggccggttgccacccagaaggatgtgggactcaccccccgggtccggggtagttgcgcccgtggccccgcgaatgatggacgataaaatttatgggttccatcttggaaatgaaaacaaaatcttgtttttcccccccacataaca

SEQ ID NO: 605269 - DNA, 382 bp, Homo sapiens
tcttgatgcgcggggtcattgggcgtcgatcttgcagcgggatgctatgggcggctgctgacacgctgctggtctcgtccgttacgcctgtcaccaaggatgcccgggcggccggctccggtcgtgaagtcgaggtcgtggtccgacagctcgtcccgttgcatcaacatgagtgagcgctcctggtccggagtcagctgatcagtggggaagcgcacgatctcgttggagaccgcgcgagccagagccacccgggaagccgttgcgcttggccccgggcgtccagccgtagggaagagagaagccgtcctcatactccgccggctgccagcgcacaaaggcccggctggaggcccccagcgtgcggctgcgcctgttgttg

SEQ ID NO: 605270 - DNA, 275 bp, Homo sapiens
tcgccatagctattacagtggtcattagaatgatcagcactgcggccggattgttagttttagctctctgccttgaggcactcatcagggtctcccaggctagagcattcattaccactgaatggcagattacacacactctagcttcctttctgcacatggataacagtgtacattgcaggctacggcagagagcacagaaaaccttcccacatgctctgcagggaggccttgtttcggtgacatgaaacctgctttgacatttcatgcaagac

SEQ ID NO: 605271 - DNA, 119 bp, Homo sapiens
  misc_feature (35)..(35): n is a, c, g, or t
  misc_feature (64)..(64): n is a, c, g, or t
cttttgaaagaaatggatcactgctgcaggctccncatacactgaataaccgttagtccgcctntctcttcccgggagttttgtggtctgggtcattgtcactcctgctcactggtggt

SEQ ID NO: 605272 - DNA, 658 bp, Homo sapiens
  misc_feature (238)..(238): n is a, c, g, or t
  misc_feature (273)..(273): n is a, c, g, or t
  misc_feature (357)..(357): n is a, c, g, or t
  misc_feature (413)..(413): n is a, c, g, or t
  misc_feature (415)..(415): n is a, c, g, or t
  misc_feature (423)..(423): n is a, c, g, or t
  misc_feature (429)..(429): n is a, c, g, or t
  misc_feature (431)..(431): n is a, c, g, or t
  misc_feature (446)..(446): n is a, c, g, or t
  misc_feature (463)..(464): n is a, c, g, or t
  misc_feature (472)..(472): n is a, c, g, or t
  misc_feature (477)..(477): n is a, c, g, or t
  misc_feature (485)..(485): n is a, c, g, or t
  misc_feature (495)..(495): n is a, c, g, or t
  misc_feature (498)..(498): n is a, c, g, or t
  misc_feature (505)..(505): n is a, c, g, or t
  misc_feature (507)..(507): n is a, c, g, or t
  misc_feature (509)..(510): n is a, c, g, or t
ccagtttacgcgccaggggcatacctcgcattgcgcctatgcgtgtcttatccacctctatctgtatctcgtgatcgacctactgtcttggtccatctcaattagataaaaatgaaccccgttacagagtcaccatcatgtctcttctcaccaccctctgaatctgcattagccagtcaactagccctttcagcgtcatgtgaccagcgcgccccattcagcttggctggtgtcgttncacatgacccaggctggccagtcgtcaggttgcancgccctttggttcccgagcatgctgtatactctcagccttctctccaagacttaacctaaagtcggtcagtgagccacctcgancgcccacacattcctggccaatcagctcagctgtttatttaccaaatgtcttcacnanaactacancagcancnttcggctaacaaaanaagcaggaaaaatccannacaccccnttcgncaaccaantaaatccaangcnacttgtngnannaccttttcagcaaattcttcctggcgtcagtccggcagcctcactcaccatttctagcttgttgaaaacccaaagtattcttcggcaccattcactgggcccaacagtgagattgaaagttggggacatgctcacgccataatactat

SEQ ID NO: 605273 - DNA, 105 bp, Homo sapiens
agaagactaaactcaacagtaaatcaaaaaactgctcgccagaacactacgagccacagacttaaaactcaaagagacctggcggtgcttcatctccctctagag

SEQ ID NO: 605274 - DNA, 377 bp, Homo sapiens
  misc_feature (76)..(76): n is a, c, g, or t
  misc_feature (132)..(132): n is a, c, g, or t
  misc_feature (134)..(134): n is a, c, g, or t
  misc_feature (142)..(142): n is a, c, g, or t
  misc_feature (148)..(148): n is a, c, g, or t
  misc_feature (150)..(150): n is a, c, g, or t
  misc_feature (165)..(165): n is a, c, g, or t
  misc_feature (182)..(183): n is a, c, g, or t
  misc_feature (191)..(191): n is a, c, g, or t
  misc_feature (196)..(196): n is a, c, g, or t
  misc_feature (204)..(204): n is a, c, g, or t
  misc_feature (214)..(214): n is a, c, g, or t
  misc_feature (217)..(217): n is a, c, g, or t
  misc_feature (224)..(224): n is a, c, g, or t
  misc_feature (226)..(226): n is a, c, g, or t
  misc_feature (228)..(229): n is a, c, g, or t
tactttggttaggttggagacgaaggctgtagaaaacagcatgctcgggaaccaaagggcggtgcaacctgacgancgcccacacattcctggccaatcagctcagctgtttatttaccaaatgtcttcacnanaactacancagcancnttcggctaacaaaanaagcaggaaaaatccannacaccccnttcgncaaccaantaaatccaangcnacttgtngnannaccttttcagcaaattcttcctggcgtcagtccggcagcctcactcaccatttctagcttgttgaaaacccaaagtattcttcggcaccattcactgggcccaacagtgagattgaaagttggggacatgctcacgccataatactat

SEQ ID NO: 605275 - DNA, 449 bp, Homo sapiens
cctggtatcccaccacttatagataggcagcaagctcagaaaattgtggggctctcaagataaaagacgaatgttaaactaggagttgactcagatattcctaataaagctttcaaaggttgccttcagccagggcagtggtcatgctgtaatcccagcactttgggaagctgtggcagggggatcgcttgaggtgaggagttagagacccagcctgggcaacattgtgaaagcccatctctacttaaaaatacaaaaattagctgggcatggtggcacgtgcctgtagtcccagctacttgagaggctgaggcacgagaattccttgaacctgggaagcagaggctgcaatgaacttgagattgcgccactgcactccagcctgggtaacagagagcaaggttcatctcaaaggaaaaaaaaggagccaaagggtggggataccaggg

SEQ ID NO: 605276 - DNA, 131 bp, Homo sapiens
agctgacccgagtttggggatactgaggtcgggaattcgagacagactgtacgacaggcagaagccctgtctctacttaaaaaaaaaaatacaaaaattagcctgggcatggtggcatttgcctgtaatcc

SEQ ID NO: 605277 - DNA, 468 bp, Homo sapiens
  misc_feature (196)..(196): n is a, c, g, or t
tggagtgtaccgagtccaaactgtgccctctgcccggcgtcctgtggtcaagttctgtcatcggccttcaggtcttcatggagatgtatccctcagtaaccggttggccttatataattcacgtttcctgaatctctgctctgagatggatggtcgagtccggccccttgtgtataccttacgctgctgggctcancataatgggctgtcaggaggtggcccccttctcaataactacgccttgacgttgttagtgatctacttccttcagaccagagaccctccagtacttcctactgtggcccagcttacccagagagcaggtgaaggggaacaggtagaagttgatggctgggactgtagcttccctaaggatgcctcaagattggagcccagcaccaacgtggagcctctcagttcccctgctggcccagttcttctcctgcgtatcttgcttggatctttctg

SEQ ID NO: 605278 - DNA, 303 bp, Homo sapiens
aaaacttttgaattttttatagtgatggggtctagctatattgcccaggctagtctcgatctcctgtgcctcaagaaatcttcctgcctggacctgccaaggtgatgggattaacaggcgtgagctaccatgccagcctcctgcttgtgtttagtttattggtttttgttgttccaggatactattcaacataccacattgtatttgattgtcatttctccctggttctctgacagtctccaattgttcctgggtctttctttgtcttttgtatgatcttgacacctccagagatcagttatt

SEQ ID NO: 605279 - DNA, 191 bp, Homo sapiens
ctcggaccgggtcggcaaggacacaaaaaatagtctggcattttaaagtgtacaattctgtgacattttgtacattcacaatgttgtgcaaataccacttctatctagttccaagacagtttcatcacctcagaaggaaacctcgtgtgcaataagcagtcaacacctcatttctcccttcccttgccgaa

SEQ ID NO: 605280 - DNA, 467 bp, Homo sapiens
  misc_feature (374)..(374): n is a, c, g, or t
  misc_feature (451)..(451): n is a, c, g, or t
cacgaggcggcttctacgcgaagcgcggctggacggagcgccccgagatggccaatttcgtcctccggctggggtgaaaaggggccccgaggcgcggccggccgggtgcaggaggaaggtgtaacatatccgaacggccgcgaccgctgcggcctggattgacccatggacgtgctcctcagacccgcggcgcccaaggatagcgcggagattgccgctatgtcccgcgacttgatcgaaacggggctcacctggtcctggacgccggcccgggtcgccgccagcatccgtcaccgggagaccatggccctggtggcggaggcccagggccgggtggcggggttcgccatcatggagttcggcgacgaaacggnccacttgaacctgctggccgtgcggcccaggttccagcgccaaggcgtcgcgcgccgcctggtggagtggctggaancctcctgccgcaccgc

SEQ ID NO: 605281 - DNA, 194 bp, Homo sapiens
aggggtacggatgctactcgggcacctagaagccacagcggccctccagcagagcggcacggcaccatgcgcaggaatgtctcgaccttgtccatgtccttcctaagagcagtagagcagcccggtagttctggaagcagtgcgtcatggtttgtgcgacgtttgcgtcaaactgtgctgtaggttctgcttga

SEQ ID NO: 605282 - DNA, 303 bp, Homo sapiens
caggtagtcgtatttctctaccctgagttgatgatctcgaggtatttatcccagacaatgatgccacttcacctgggagtgctgaggcgggtggatcacctgaggtcgggagttcgagaccagcctgtccaacatggtgaaaccccatttctactaaaaatataaaaaattggccgggcatggtggggggtgcctgtaatgccagctattcaggaggctgaggcaggcgaatcgcttgaacctgggatgcaggtgttgcagggagccaagatcgtgccactgcactccagcctgggcaatcaa

SEQ ID NO: 605283 - DNA, 474 bp, Homo sapiens
  misc_feature (284)..(284): n is a, c, g, or t
  misc_feature (349)..(350): n is a, c, g, or t
gacgagcttcacgatgccccacctcaccccataaccaggccgtgtctcctacccaccagccaggaaaaggacctgatgagaagggggaagaggagggagagtagggaggaaggaggggggagaggtgataagtgcatggtactgacttctcctgtttaggttttagctgcagacttgggtcctgcaggtggtgggaagccgtgcatacacggctggtgtcacagccaagcaggcttctctcacaacaagcctcgggccctggggccggggctaggcagcctccnaagagatgatccgtgtccccaggctggatgctgtgtaggtccagggaagccccaagactccccgnngcccgaggccctgaagatgggtgtggggagagaagacactggcccattgaagggggcccatggatctatagtgttttattttaagcaacacacaaaaatacaaaaagcaattgtccaaataaaa

SEQ ID NO: 605284 - DNA, 367 bp, Homo sapiens
gaggatccccgacggtctagtactatatcaggagtcagcaactagatgccataggccagatccaacctgcagcttgcatatgtagacagttttatatggaacacatgcacacccatttggtttttgtataatcaatggctgctcttgtgctacaatggcataactgagtatgtagttgcagcagagaccatttttcctgcaaactctaaaatcttgactatttgtccctttacagaaaaagtttgccatccccctgatctacattgatacttattgagaaaaattggagggctcaaggaccgttcaattggtaacagacccgtcgggggaacccgggcctcgaaatccggaaatccatggtcatagc

SEQ ID NO: 605285 - DNA, 604 bp, Homo sapiens
cggggatcaaaatgatttctcaccttgcgcgttaactcggctaatcaatcctccaggggccatcattcaacgacagagaagacttgtgttcaaaataagaactgtcccccttcagcgaggttgatacgccaagcaccaccaaaaattgtgggggagacgttcttcttgaggagtcgcaccccaggcgccccccctgtgcgccttaattgtagtggtgaacaaggcacctctttttcgatgtatcccccgcttgtcaccagtggggaatttccccaaatcaatatgaaaagataacaatatgctgccccacaaagaaattcagtgtgtcctgggaagctcttaacgacccgcagtgggggagtggtttgcattgagaggtgcgcccccacccatggtcggccgtatgagatgaacaagatttgctggggtttcgccgtcttcatagacatctccgccgggtgtcaatgtagagcggcctacattgcgaggtattgcacgagtcttcttgcccccccacaggcccaggcgcgtggcatgtgtgcattagagcggcgcaagttatccccccgaccaacaaaatgacaccccccaacccaacaaaaca

SEQ ID NO: 605286 - DNA, 219 bp, Homo sapiens
tacgatcgagctggtaccgttgctaggtggagtaagtgtcataatctcagtcttgccactctgcctcctgggctcaagctgggtcaagctatcttcccacctcggcccccgccccgagtagctgggactacaggtgcacgatgccatgctcagccaatttttaattttttttttttttttttttttttttttttttttttgggtttttttttttctctg

SEQ ID NO: 605287 - DNA, 207 bp, Homo sapiens
ttagtagtcattcccacttcctgctttgttcttcccggtatcacaggtgctggcatctgggagatgacagtttctgtattctgctcttcattgtctctagtgcttgttctgccaatatatattgtatctgctagattaagagtgtgagattatgagttgattttggtttctggctgtggaaggcaggtgagcagacttcagcaggct

SEQ ID NO: 605288 - DNA, 157 bp, Homo sapiens
gactctacaggatcccgcttgggcacgcaccgtcctctggtgaacctggcaattatatccctagccaaccccttaaacaccccttccccacatctaagcccgaagtgatatttcctattcgcctattttacaccaaccccacggtgcgttggcccaa

SEQ ID NO: 605289 - DNA, 1241 bp, Homo sapiens
gggtcccagtggcagcagtttagtcctgtcggccggcttgtgtgtcaacagaagaccattggagagagccatctcttgatccatgaagtgccaagctgtgcagagcatggctcgaagcgtcgtagtgaggacgactggccacgcacttcagtgaaacggtctgccagtggacgaaggggcgagagaagcatctaccgtgcgatacgaggcgaaagcctggctctcagctaggacctactatagaatcgtggatggaagcggccaagagggcctgcgcttggagtggtgactgctctcaagtatttgaccgcagtacagaacgccggacgatgcgatggggcctcgcgtagggagcacagcggttagcccgaaagggatgccgggtgcaagctaaacagcgcgtatgcatagcgtatgggagaccttgcagcgttgcagagcggccggagggtacgcaaacacccaggttggcttggcgttggcatccgtagtgtacccgcccatttgaatccacgctccaaaggggggatcgagcacccagagaatgaccgagcacgaaattgacgctcaaggagttctatttcgtactccgatgaacgcgatattcgaaaccgaggcgcttcgaagagaaacaatatcgctagccgtgtatgcgcacgaggtccccgaacgggctcgtggagtgcctccgtgcctccgtcattacagcaccgaacagtgctggaccttcaacttcaggcctgttcgacattcccgttcgactttgggaaccttccatgaagaagaaaaagggcgaagatcgtaaacccatacaaacgtgaatgacacacagactagataagcgcaagtgcgcaataacaacccccatacagccaaccgacgatccaagtcccttggacggattcattggagacccattggtccctagtattcgccaaacccattagaagcagaccgttacaccttcaagtggaccggaattccatcggcttgtagtcgaacgtgggtaacaaggattcaggtcaacgaaagggagggaaatgggcgataaactcgtttgcagctgaccaattccaacgcaaggaaactcctgttgcgattacacaatcgaccccatgggacattttacgtgcacaggtacgaattggaccaaccgaccgtgacttactttgctcaacgtactggataaaacccgcgaacaaagattgcctcgtcactgaggcctgggcccatgagccact

SEQ ID NO: 605290 - DNA, 950 bp, Homo sapiens
  misc_feature (928)..(928): n is a, c, g, or t
gccattctgtttttataacgtggctacacttgccttctgaatgattgaaagaaacttttacatcttttcttccaaaataaaagtaacaagctgactgtgattcttaaattgagaccagagcagcaaacgtctcactttaaattttgttttcttttcctttttttttcttttttctttttttttttttttggccagggcatggttgaatagttattccttaactttaaatatttttttgaaacatattttttaaaatgttctctaaatatttcggctatctggcaaggtctcttttaactagatcagggctgttcttcccacctcatccctctgaaaataaaaatgtttggccctccccaccatccatcatagccaggccactaacttgactgggtgcaagagatctggcggcaggaactttgtaaagccagtgtgcagataagaattgggctctggagggtcctgagggcttcaagtcttaccgtgtgtgtgtcccagtcctcaaatttgtggcccaaactctcaggattctccctctgcccttgtctaactccatggtactagaagaccttcctcgccactctctccaaattaaaaaattcagctgccctttcctcgtgtgcctctgacagaaagaatccttgaatggcacatctcagccccccatagagggaagtacttggaaaaaactgactcattaccctgcctcctttagattaattcgaaccataggccggaagatgtagaccgaattactaccagaggcttggttaaccacaaccctaattaagggttagagttgttctccctcgcaaactgatattgcgtccccatggtcaacctaataaggcagcaccgtcaatcgagataccatacaagagtgaacacacaggggggacagcctctagatcgatttacatatcatctngcaacagacacacgcatagacc

SEQ ID NO: 605291 - DNA, 111 bp, Homo sapiens
ccgcgtgatagaggatcccccagccaccccggcgtatttattagcatatccctctactattttttaaccaaatcaacaacaacctacttagctgttcccagcttgtccaga

SEQ ID NO: 605292 - DNA, 183 bp, Homo sapiens
tgtttaaaccacaactgaaacacctaatagtatatattttaacaagtaaaatgcacctagaccaccttcattactgaaacacttagtaattattatttactgacttacacaccttattaacatgagagaaagttaacaatatcaaagcagaccatcttgtcttgtcttaatttatatatttat

SEQ ID NO: 605293 - DNA, 132 bp, Homo sapiens
ggggggggggccggggttttttttttgggcccccccccaggggggaaaatgggaaaatttttttttttgggggaaaggttgggggggggtttttaaaacttttttaaaaaattttttttcccggggggggga

SEQ ID NO: 605294 - DNA, 261 bp, Homo sapiens
catcactcatagatcagttctatttttctcaacctttgtctctttgcatttccatgtaagggcctatgctatacatctgcgtaagcgtcagagattctttccttagccatgacccgtctactaatgatcccatcaatggcattcttcatttctgtccgtgttttgtactctggcgtttcttttaggttactactcttaaggtgtccgtctctccacttacgttgcccatctcttcttgcgtgccatctgctttattcggga

SEQ ID NO: 605295 - DNA, 166 bp, Homo sapiens
tcaacagagctacagatttgaagaatcttttcagcaatatgggaaggtggtgggcgccaaggttgtgaccaatgcccggagtcctggagctcgctgttacggtttgtcacgatgtccacagcagaagaggccacaaaatgcattaaccaccagcacaagaaccaca

SEQ ID NO: 605296 - DNA, 207 bp, Homo sapiens
gccggtcccaggtcagctgcatttcgtcagacagatccggacaggcctcaatcttggtccattgcaggatgtcatgcgcccgccagcggcgctcaccaccaacaagctcgaagcgaccattggctttggggcggacgacgataggattgttgagaccgccgttggcctggatcgcgtcagccagaaggagtctgaaggcagtctgga

SEQ ID NO: 605297 - DNA, 271 bp, Homo sapiens
gtcgactctagagcgataccccgtacgtctgtaaacatatgatgtccatattaacaagagagaccagttaaaagatagtttcatacttttagaaagcctaatttctatactgtaatatcctcccatccctactatttaaaaaggctgatagttcacaaaagctatttatgttctttccctagaaacacacagagaactttggtcaaagccacatttttaaaaagtcatacacttactgctgcagtaagcacaaacaaatagacactcatca

SEQ ID NO: 605298 - DNA, 245 bp, Homo sapiens
  misc_feature (154)..(154): n is a, c, g, or t
  misc_feature (211)..(211): n is a, c, g, or t
ttgtacttcaagagctctggcatctctttctgcaaaggcaccctgaatggttgctgtcctgttaagcatatgtgaggaggtggagagacagcccaccgcttgtgtacacttgtgaccccgtgttcccattgctgacctgtagtttcctccccangtcatctttcttgttccagaagaggtggggctggactgtctccatctctagtctcanagtttagcgtgcactgagtctgcaagcttcttac

SEQ ID NO: 605299 - DNA, 1655 bp, Homo sapiens
  misc_feature (205)..(205): n is a, c, g, or t
  misc_feature (448)..(448): n is a, c, g, or t
gcgctggtagaacaggacccgtacgccatgtgccgtgttatcccgtgggatataggcacatggtgcgcctgggtctggtgtccggcgcgcaccgatgactcactcgtttcatggcgctgcggcgcctgcgcccccagctggattatccgttcgatactgtcacgggttatcctctccgtcgctctcgttctgagggagcattcanatccgactgatcccgtgggccgtgtcgctggggcctgcttgacccgagaggcctgagtctctgtgccagagtgccactccgtgtccttgggctgttgagagaagagtcgcgtacgagcatgcttgcttggcattctgtcccgtgctgtaggcgcctgatttcaacgactggggcgccacggttctgatggttgagttgccgggtgtgaatgaaaagaggccgcgcaagccattcagatcattncagaggcgaactagtggacatcccactgtgtttggttagttgaacccacatgggccttgcataggaggtacccaagtctcggtgattgtgcttgctcatgtgaacgggacgcaaggacacttgggcacaggaacccgctgtaggtgcgagataggccattagggagacccccctttggcggcggacctatgcagaagacggggcataatcttgaaattttgcgcctaacgcaggttggtttattccttaacgccacaagagacaatacgccacctttggccattgtatccccgaaagcggaaaaccgttaccccacagtgttgacgtacgaaaaaaggccattgaggccacaccttttcttcggtggtagtcttccccctatcgcggacacaggcgcggatgtcaatttccttacctccttacttataggcgccaaaaacccacgggtacccgtctctcggatagcggattctggggaggcctagttggggcgatttcggcgcctgtggggcaggggctgtctggaggcctccgagggccccctttctgtgtgttccattacacagagcgcgaaatatcggttgttggaataaagacgccgcttctaggtgccccagggcgagcgttgttggacctccggaccaaaagtaccttatgtagatgcgggccatcagagattggaacgtcgcaattcggtagttctttgtgcagccaggcagttaggatttacccgttgggaggtgcagttttgggggcccggctgtgggatggtcccccggttgtgtcggggcgttgcccgtttcccatttctacgggccgctgcccgggttggtgacccttgggcagagccacaccgcggacaagtttcgtgctaggagggccacattcgcggggaccacgtttcctctggcacagggaggatattcgccccctctataggtttaggaccgccggagaagaagggttggccgttcattccaagttggccaggtcaccacgacagcgtatggtttggtgaactagttactccccgtgtggaccaagagccaattgaaactctggttctaaagaacagaagaaaagacgcataatataagtctgctagcagagagcggccctcaaagctaaacagggttcgcgtgagacatatctgcccccagtataaccacatttataagagcgcgttgcacagtccacttctcaatta

SEQ ID NO: 605300 - DNA, 329 bp, Homo sapiens
tttttaggcccccttttttttttttcctgttccccaaaaaaaagggggaaattccggggaaggggtttcttatcccggtccgggagggatttcctttcccccaaatttaattttgtttttcccgcaaaaaggtggaaccagttggggacccctccctttgtaattggggacccccccccctttaggggtcccccgggggtttttcaggggaaatttaggggaaaacttttttcttttttccccccttggggggggcggttttttttaaaagttgggggggggccctttttacccctttttaatgttttttttttggggggggataccca

SEQ ID NO: 605301 - DNA, 301 bp, Homo sapiens
  misc_feature (21)..(21): n is a, c, g, or t
  misc_feature (130)..(130): n is a, c, g, or t
  misc_feature (180)..(180): n is a, c, g, or t
  misc_feature (182)..(182): n is a, c, g, or t
gcacgaggacagagtcagcgnagttgtgggggccggggcgccatgggagccactggcacagccgagcagccgcgaggacccagcgggcgaagaggggcggcttggagctgggggatgcgggcgcacgggngcagctggttcttacgaacccttggaacataatgataaagcaccggcagngncgagaggggccgccgctcacagatgacaacaagtttcacagatcctgccatctccatggatctcctccgagctgtcctgcagcccagcatcaacgaggagatccagactgtcttcaaca

SEQ ID NO: 605302 - DNA, 145 bp, Homo sapiens
gcagtacggagtgtgagagtcccttttgtgtggacgtctgggataccagagtcacgtcgtcacgtggttctatgttctgtaaccgggtcttgggttcacggggtgggccgcccacgtgggtaccccagtgatttttgggcactgc

SEQ ID NO: 605303 - DNA, 419 bp, Homo sapiens
  misc_feature (19)..(19): n is a, c, g, or t
  misc_feature (87)..(87): n is a, c, g, or t
  misc_feature (91)..(91): n is a, c, g, or t
  misc_feature (115)..(115): n is a, c, g, or t
tcccccgggggggggcccnttttttcccccgggaggtgtgtcccttttttccccgaaatgtttttgccgtggctgggggagggaaanaatnctaacatcgttgggtgggaagggntggtctgtttccttggggcaccgggggaagtttggtgttttgggtttggggttttgttgggtttaagggatggaaggtttttcccgtccaagggttccctgttaattcccgggggcgggttggctttattgttttgtggttggattgggtcccttggcgtgggtaaaatttgtgcccctgggggggggtttggcgtggaccttttttagagggggtggccccagggttttaggatttccccccgtgttgtgttggggatttccccccccgtttttttggtagtgcaagccccaaaagttttgta

SEQ ID NO: 605304 - DNA, 304 bp, Homo sapiens
  misc_feature (5)..(5): n is a, c, g, or t
  misc_feature (13)..(13): n is a, c, g, or t
  misc_feature (30)..(30): n is a, c, g, or t
  misc_feature (299)..(299): n is a, c, g, or t
agagnaaagtaancccatgacctgaagttncctagttgtgggagaacatcgatgccctctgactgaggacatgagctggtttgtggggaagggtaaggaattcagttttagttatgttgaatggacccatttgccctaaataaatgtgtggaaatgtccactaggctattgagaatttagatctggaactccagaaggattgattatgaagatgtaggtttaggacattagctgcataatgatagtagttaaatccttattcgtatcatctaaaaaacccagagagagagataaaaatnatgag

SEQ ID NO: 605305 - DNA, 309 bp, Homo sapiens
acagaggtgcccggaggatacgtgagggaagggatagcctcattgataaatggtgctggggaaatgggacacccatatgcagaaaaatgaaactgggccgctatctctcaccatatacgaaaatcacatcaaaatggagtaaagacttaaacctaagacttcagactatgaaagtgctagaagaaaacattggggagactctccaggacattgcactgggtaatgatttcttgagtaatacttcgtaaacacaggcaaccaaagctaaaatggacaagtgggatcacattgagttaaaaagctgcacag

SEQ ID NO: 605306 - DNA, 708 bp, Homo sapiens
caacgcagtgaagcccaggagacatcattgtcaggctgctgggttcctaagtgtgcaaggatgcggaacagatctggcctcattctctgtgatcttgccctcctgatgggtttcctgatggtctgcctgggggccttctatcattatcctgggtgctccatattcgactgtcaggggagcctgattgtggcctattagtttctgcctctggggttattgatccttcgtgagtggaattttcatggaacaactatcggcaagtgactgaaagcaaaggagatgttgaggcacatgctccgataacgaccttgctcatggggcccatggccgtggtcacgagtagacatggccatgacttttaccctccagcttatgaagagagccttgagtgtggaaaatgcagtagctgttcttgagagagagaggcctctgggcattcctccagctctatatacatagacgggcctggaagtccaggatggaaagtgactcccagccagaggccctaccatcttatagagagtacatagccggcctggatggtgacatgcaatctcagaggacgcccatagtgcgaggccaaggagtgctgaggcatagaaagctctcacagcactcatgatgccaccaactgatggggagcagctagtgataataaaggcacacgagggacctgtgggatggaaaatgccagaccaggtgacccga

SEQ ID NO: 605307 - DNA, 764 bp, Homo sapiens
ggtgtgactctgggttgtcctctgtgagatgcccaaccaggtctttgtatggggccccccccgcatgggccctgtcttttgttgtggcattccccccgggggcgaccccaatgactttgtctgggtcattgttcttgtggtgttgtctttgtcattgccttcggttcctctttgtggggtgaacctgccagggtggctgccccccttctggttttcgcacccacccgcgctgcgcggagggtcgatgagacgggtgcccgcgatgtctattgcgagtttgtctttgcgccgcacccgtttcgtattgtctccccccaccggcgtttccctaccgaccatctttcctcgcgtcgacgctcaccctcccccgagtagagttcgtggggcccacaccactgcgtttggttcctctcaccacgcggggcgcctccgcccacctttgtgtctcactcttttgtcttagagagagagagagcgggtgtgtctcccgcacggtctgtctcccccgggtggtgtttctctccacaccatcccggggccagcgtgtccaccctctgtgtcaccagcacgcctggagctagtcgggggctaccacatatgtgcgcccccaccgccccccgccctgacggaggggcccacctactgttgcctctctgccgcctccgcacttgctcttttcgtccccccctctccgcccctttccgccccttttaaacacccccttttttttcttttttttttttcccctcaactttttcccccca

SEQ ID NO: 605308 - DNA, 153 bp, Homo sapiens
ggtgtgaaacaccccgccggcttgcttgtgggattttcatcgcatcaggtacaagaaggtacaaccagacccagagtggctcccagaggcagaagggtgatgtacgatcggtgctggccagcactgggtcagcactggggagggcaggacacc

SEQ ID NO: 605309 - DNA, 269 bp, Homo sapiens
atcgccggtgccaccgcagtccctctcgtccagcttatccctgcttcttgagagcacatggggggcacgtgtccacaccgtcctgaattctccagcatgcccagctcattctggacttttccaagagatcctgagaggtgcccagaaatgtacgcatgagcccctgaactcttggtcacactcaggaatatgacgacaagccgggtccgttcccaggtgtgtctatgtggccgtgaaccggtacgacagcaacgaggtgcagataccca

SEQ ID NO: 605310 - DNA, 568 bp, Homo sapiens
cccgataagcacttatgtggggtgtaggggacaagactgagaccaagacgtcgactcagataaatcagagcagtactcgacaggtgcactggagagaagcaagggcaccgcagttgtggtaggagtaggagaagagctgacttgcaatgaagcaacaggggaccagcaaacgaaataaacgtggtcagccatgagcgggccacgagggaatcacatggcttccaaagccagaaaggaggctctagaaagccacacactggtgatctccagtggtgatacccaatacacaatcagcatgactctctcagacacatagtgtgtgaggcctgtaggcggattcaaatacagaggttgatggccactgcagcttggtgaggtccagctcaatttcaaactgctaggttcaccagcatgctagcaggcttaggactatgctgccatgtgcctcagatactctctggaggctgcagtacgtgtaagcctatggctgctcttccaggctgctgttgtaagtgggatgtgatcgggtgaccatctgtgtagacctgggtatagctcaaatcatggg

SEQ ID NO: 605311 - DNA, 1638 bp, Homo sapiens
gagaggccgcgtcctcagctggtcctagacatgcgtggcgtcggggctgtggcacggtcgggtccgggcttgaatgcaccaaggaaaggccatttgtggggacatagcaagaaggcagctgtctgcaagccaggaggagaaccctcaccagaaacctcacagaaatcggccaacaccctcatctcgggcttccagcttcagagcaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacatctgcttaggaatcaggcactggatcacagccataccctactcattaacacctgggggacctcaggcatgtcactcgaccttctgtgagcctcatctataatatgggaatgatatctcctacttcactgaggtttgtgaggactggagatcgaacatgtacctactgggccctctagaaatggtagacatcatcactgctctttcagacatgcagcaggagggggaaggtgccatttaaagcaataattgactgcagggttgttttttttcttgagacggagtctcgctctgtaactcaggctggagtgcagtggcgcgatctgggctctctgcaaactctgcttcctgggttcacatcattctcctgcctcagcctcccgagtagctgggactacaggcgcccacgaccacgcccggctgatttttttgtatttttttagtagagacggggtttcgccgtgttggccaggatagtctcgatctcctgacctcgtgatctgcctgcctcggcctcccaaagtactgggattgcagacatgagccaccgtgcccagctaatctactgtgttgtgtagagatgcagacatctgcttaggaatcaggcaggcggatcacatgaggtcaggagttcgaaagcagcttggccatcatggtgaaaccccttctctactaaaaatacaaaaaattagctgggcatggtggtgcacgcctgtaatcccggctacttgagagactgaggcaggagaattgcttgaacctgggagtcagaggttgcggtgagccgaggttgtgccattgcactccagcctgggcaacaagagcgagattccatctgaaaaaaaaaaaaaaaaacaccgatctcaaagagggagttgtgagaaccccaacttgaagctggttgctctcaagttccagaggcccggacttgcgactgacgtctggggagttgggggcagcagtcttgggaactgagctgtgagatctgatactatctctgggtctatagtgctggcattgaattggagaacacccagctggtgttcactgcttggtgtgtggcggaaaaaccctcacacatttggtcacagaagcccttttctgtgttggtgattgttgtgctggtgtgagaacagaggaaaaacaccgcttgcagagtttttcctgaaacaatactctttagagcgatagaaataaataccacgacctgcgcattcaaaaaa

SEQ ID NO: 605312 - DNA, 378 bp, Homo sapiens
ctgtgcttgggtgctcatgtggtgcgctgtgccccgattggcgctgctggcaatagtgtgtgatcgtggtgagagtggtcctgctggtcccggcggatcctgtcggccctgttggcgcccgtgtgccccgcgtggaccccaaatgccccctgtggtgacaaggtgtgagaccaggcgacacaggtgcgacagacggcataaatgggtcaccgatggcttctctaggcctccagggtcccccgtggccctccatggctctcctgtgtgaacaaggtccctctaggagcctctggtcctgcatggtccccagaggtccccactggctctgcttggtgctccgtggcaaagatggactcaacgtgtctccactggccccat

SEQ ID NO: 605313 - DNA, 295 bp, Homo sapiens
ggcacgaggttgctgcttctcccaggcaaggctgtggaccatggagtggcagcccagccagcgtcggtctgtgccccttccgccactggggctcaaagccggggtggggtggctgtcagctctggactgggagcccccaacctgctacatccaggagcttcagtgatctgagctcagcgggtagaggtacgggctaggttcaactcaacttgcctgtcctcgtcccatgaccccttttcattgcgcatttagttaagctctcaagactgctgaagcttttcctcgaccctgcacc

SEQ ID NO: 605314 - DNA, 184 bp, Homo sapiens
tgaggaggtggtccgaagtgcggtagcgttgggcagagtggagggggctgcacaggttgtcgtagactgctcccacggtagcagaagctaacacccttcccacactggatacacaattccaaactaaaaaaacctccagattcacatccagaaaatttctccccccaacggtgaccggcgactt

SEQ ID NO: 605315 - DNA, 924 bp, Homo sapiens
  misc_feature (629)..(629): n is a, c, g, or t
tagagccttcgtttgccaagtcgcctccagaccgagacatgaaactcgtcttcctcgtcctgctgttcctcggggccctcggacgtgtgtctggtgcccgtaggagacggcgtgtggcagtgggtgcgcctgtatcccaaaccgaggtcacaaaatgcttccattggcgaagcaatatgagaaaggtgtgtggccctcctgtcagctgcataacgagagatgcccccatccagtgtatccaggccattgcggaaaacagggccgatgctgtgacccttgatggtggtttcatatacgaggcaggcctggccccctacaaatgcgactgtagcggggaagtctacgggaccgaaagacagccacgaactcactattatgccgtgggtgttggtgaagaagggcggcagttttcagctgaacgaacgtgcaaggtcttgaagtcctgcccaaacaggccgtcgcaggacccgctggatggaaatgtccctatagggacacttcgtccattcttgaatggggcgggtccaccgtgagcccatttgaggcagctgtggcccaggttcttctcagcagctgtgttcccggggcaggataaaggacagttcccaaccttgtgttgcctgtgttgngggaaacgcgcaaacaagtgttgctttttcctcccaggaacggacttcagctcatccttggcctcaagtggtttgcaaacgcggtgaacacgcggttaatagacaagccacggttgggaccgtcacaggtgtaaagagatatagtatttcgcgagaacttgagcagtggattaaggcatcgcggggcacacaccgtggggagtagtgaagggacatattccgccgaaggtgacaacaatgtcgggaagagcgagtaggcaaggagcccaaagagaggggtcggagggcacgagcg

SEQ ID NO: 605316 - DNA, 602 bp, Homo sapiens
tgatgatcttagtatctctaaaattgttcagaatttatgttatttaaaatagtcaatcctttaaaaggacacatatgttaacacatatagtgggtgtagtcaaatccatatgagtataaactctttgtaccaatatccacgtgaagctatctgacagttagagggacctaagtttaacataaaaaaaaaaaaaaaataaacttcccaactaacagtgtttctttaaaacatacatgatattatgaaataataccttaagtaaagatatcttaaatgattttatccattcagttagctcagttttgtccaaaggaaaatgcatgtttatgttttgaattctaacaataaattatttttctacatcatttcttgatattattcccaatacaaattaatcaaagcacttcattctgtatatcagatttctggctcatccagatgtaaataaacctcagttctaaatcatgccaatctagtcctcattatttaggaaagccagacaataatctcaccattgtctttagtagtgccacatgctaaaggagaagacacctttataggtccaactcttagaaatctcccaacaatagtacattgttaaa

SEQ ID NO: 605317 - DNA, 3616 bp, Homo sapiens
agcgtgggacaaaagtctatagccagtgcatttgaaaactcccccttgcaccagggctgactgtagctgggggaagacattttactcatttgctctttcctttcatacagtcagctggtccctcttctcaggtgtagatcacctattataattttacctaattttgatactctgataaggaaagtcccaggacttatcagctgggataggcctcacttacaagacagctctgttcagtatttggaagaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605318 - DNA, 3383 bp, Homo sapiens
  misc_feature (9)..(10): n is a, c, g, or t
  misc_feature (12)..(12): n is a, c, g, or t
ccctctccnncnctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605319 - DNA, 441 bp, Homo sapiens
tctgactgctcctggatgcaaagttgatgtgaaaacctgacaggagagatgtaatggagataatgttctgagtttatgctggtgaggtgctggcaaggctggggcttagaaaacagaagtctccagctctctagttccttatctgtggaatgggtatggggatacttgatgggttggtatgagaatactctgattgaattatgaatatacaagtaaattgatttgatgactccttattcagcatcttttagtattgaggctgtggatggcattagatatacagtggtgaataataatagtgctcattttacaaagggcttattatgtaccagagagcgtattaagtgctttccctggcattcatcacttttggattcaagcacagaaaaaacatggaggtaggtaattttaaccctacatctacttaaggtgaggaaacta

SEQ ID NO: 605320 - DNA, 3275 bp, Homo sapiens
  misc_feature (9)..(10): n is a, c, g, or t
  misc_feature (12)..(12): n is a, c, g, or t
ccctctccnncnctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605321 - DNA, 180 bp, Homo sapiens
gagcgtctcaggacgtcagagagctcggtggctgttccagcagatgtctcagatgagctgctgtcgtctcacatagtgctgtgagcacatgacaggtagctcaggtgaggtcgggatcccggtgtggcaagctcttggcaacgtgcgcttaggagcagtcctttctgtacatctccaaga

SEQ ID NO: 605322 - DNA, 3221 bp, Homo sapiens
  misc_feature (9)..(10): n is a, c, g, or t
  misc_feature (12)..(12): n is a, c, g, or t
ccctctccnncnctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605323 - DNA, 271 bp, Homo sapiens
ttagactgtaaaattcttggagacagggagtatatctgtcctgtttaccattgtatcttccatgtttaacaaatgcccagcacatagtgctttccacacatctttgttgagtggaaaagctaccttagcctagtttaggactccctcttagataagcagctctttccattttcaattttttatttaccatgttcctactctaccccatccaaacatgacctcaaagagaatctgggctaggaaagtaatctgaatgacaatataaccctgg

SEQ ID NO: 605324 - DNA, 3150 bp, Homo sapiens
gaccctggcttggggcagccggataatctgttacctagtcagggacttttctactttatttactacttgattcgctcgtcttcccccacccacgggaccaggaaccaacaatcgggcacttttaagagcacgggttgcttcccacaatttcaagagcttgtgtcaacttgctacaaacttgtggagaagttggaatccggcagcgtcttccacccttgagtaaagtacccgctgcagccactaaatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605325 - DNA, 117 bp, Homo sapiens
aggttctaacaaagcaagggaaaacagtaataatcggaaaaagaatgctagtaaacaagcacgactgaaacatggataagcccctggttttagtaacaggaaactgacaggacaaaa

SEQ ID NO: 605326 - DNA, 3329 bp, Homo sapiens
  misc_feature (9)..(10): n is a, c, g, or t
  misc_feature (12)..(12): n is a, c, g, or t
ccctctccnncnctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataatgtttcattcaagataaggctcgtggcttaggagattgtgacctggcttgcatcattctaagacttctatcgtctgttttccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttctttttttggaaagcagtagtaattaataccaaaggcatagacaatttagggccataacctcccttcccccctctccacctttttttttttttttttttttttttaactttaaccatgataggcatctctgcaaggtagcttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatca

SEQ ID NO: 605327 - DNA, 1288 bp, Homo sapiens
  misc_feature (9)..(10): n is a, c, g, or t
  misc_feature (12)..(12): n is a, c, g, or t
ccctctccnncnctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgtgtgttttctcctagacccgtgacctgagatgtgtgatttttagtcattaaatggaagtgtctgcc

SEQ ID NO: 605328 - DNA, 457 bp, Homo sapiens
  misc_feature (16)..(16): n is a, c, g, or t
  misc_feature (149)..(149): n is a, c, g, or t
  misc_feature (159)..(161): n is a, c, g, or t
  misc_feature (209)..(209): n is a, c, g, or t
  misc_feature (226)..(226): n is a, c, g, or t
  misc_feature (228)..(228): n is a, c, g, or t
  misc_feature (263)..(263): n is a, c, g, or t
  misc_feature (276)..(276): n is a, c, g, or t
  misc_feature (286)..(286): n is a, c, g, or t
  misc_feature (362)..(364): n is a, c, g, or t
  misc_feature (367)..(368): n is a, c, g, or t
  misc_feature (377)..(377): n is a, c, g, or t
  misc_feature (451)..(451): n is a, c, g, or t
ttttcttctatttttntttaatgtatattaatacatattgcatttatttattttaatgacatttatttaagttcaattgtacaaaacctaatttgttgtcaaaagtatcaagcaataaattttaatatattgtacagggtataatcgancatgcaaaannnaaaaccccatgtaaagacagcatgataagctcactggaaattttttanttaaataagcttaaaangncattggactaaatgctattatatggaatataaganttccctaatgttnatttagttancaacttttttgtagtagcatacacacacataccacctttatgtactatctctagatgtaaaatagtaaactatatnnnatnnttatatatntgtagaacaaggtggtcatcttgtggtcatttcagatatgttcatgattttattgagtctgcacacagtttttnttttta

SEQ ID NO: 605329 - DNA, 221 bp, Homo sapiens
tgagccggcacctaatggacttcttcgtctaatgctgtaagacctctaatttctagatggtctatacagatacgtgaaatatatatagttagaataccaaacactttatcagtgtgcgaaatactggaagcctgtttgtagaagatacatgtttggattctatatgcatatcaagggttctacaacttgaatgaagggatttcaaagaacagtacgaaaag

SEQ ID NO: 605330 - DNA, 698 bp, Homo sapiens
agcgtgggacaaaagtctatagccagtgcatttgaaaactcccccttgcaccagggctgactgtagctgggggaagacattttactcatttgctctttcctttcatacagtcagctggtccctcttctcaggtgtagatcacctattataattttacctaattttgatactctgataaggaaagtcccaggacttatcagctgggataggcctcacttacaagacagctctgttcagtatttggaagaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatagatctggaaatacaccctgtgtggcagtcatttaacactggtagatttaagtctgaaagcgttaacttttggaattaaattctaatttagattta

SEQ ID NO: 605331 - DNA, 422 bp, Homo sapiens
  misc_feature (113)..(113): n is a, c, g, or t
  misc_feature (120)..(120): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (151)..(151): n is a, c, g, or t
  misc_feature (155)..(155): n is a, c, g, or t
  misc_feature (164)..(164): n is a, c, g, or t
  misc_feature (174)..(174): n is a, c, g, or t
  misc_feature (177)..(177): n is a, c, g, or t
  misc_feature (194)..(194): n is a, c, g, or t
  misc_feature (292)..(292): n is a, c, g, or t
  misc_feature (303)..(303): n is a, c, g, or t
  misc_feature (321)..(321): n is a, c, g, or t
  misc_feature (328)..(328): n is a, c, g, or t
  misc_feature (341)..(341): n is a, c, g, or t
  misc_feature (347)..(347): n is a, c, g, or t
  misc_feature (373)..(373): n is a, c, g, or t
  misc_feature (396)..(396): n is a, c, g, or t
  misc_feature (411)..(411): n is a, c, g, or t
tgtgccagcagccttgtggtgactgcgacagtgaagtccatggttcgggagccaagggagggccctcccgtgactgtcagtcttattggtgcttataaaactggaggactggncctgccntctccncccacnggngctcctaagtttacgngccntcaaacagngcccccccanaanaaaggagtcagtttttnctttgggccaggtaaaaaaaaacaaaggcccgtccttcctccaaaaggtttgtggttttcccccggcccaaccagggccagatcctccccaacctaancaaaaggaagngcccctttcaacctgtgnggggtgntgggtcccagganttaaangcaggccagccccggcccctagcccncaggcctttttttttatccaaanaaatgttttttaatnagggatgggga

SEQ ID NO: 605332 - DNA, 187 bp, Homo sapiens
tatcctcgtcttaaccgcaggctcggtaggtttgtcgcctctacctataaatcttcccactaatcctctccttatgagcattcccctcttgggtgggcagttaggaaaataatgacttgctcgttgattgtagatattggtctgttaattgtcagttcagagttttaatctgacgcaggcttatgcg

SEQ ID NO: 605333 - DNA, 915 bp, Homo sapiens
  misc_feature (287)..(287): n is a, c, g, or t
gatataggggcggttggctttgttgggtgagctatgtttgtgtccctgtggagtggacgtggttggtgattggcaggatcctggtatccgtgttaactaggtcaaacaactgtccgaggaatctctcgctgtaaaaaacccattaccggacaacgtaccagtcatcgccttgcagtgtggcacggccccagtgacgaccagtcggaaaactgtgaggaggccagtgatccaggtataaaggaaggcgattcctcgccctgaccgagtgaggagagttcgtcattctngacggcaaaggctaggcgtggattagaattggctccgctacatcctcttcattgactacaaccattcgcatgcaagggcaggtggaactccgtgcacctggttccttgcgatctgcaggaggttgggtcctgtcagagtcttcggttgtactgtaactctctgacccggcgaagcaccctggtcaacctgtggagtgctgggatgcctcatgtgaactaggtgattgccgacaattatgttgaacggacccttgagtccaggttattcatgactgggagttccatcctgaagccaatataatagggtgtcaatctgttgcgcagtcaagcgggtgcattgttggccgtgcttctcgtactgtagtgaccaacaatcccagaacgggcgtcgatcccgtgtcagcttggttgcctggcgtctggagtgggtgggcatgcggcgggtactctgtgaatgccccttgaccggtggagagcatctggtcggggacgttggcacccaggtccccccgttgccgtgttgtagcctttctccctctttggcctggatttcccctcgggggtgtggctcaatttgccggtttcggccggagttgtcgggtttccgggtgtatggactggcctcgag

SEQ ID NO: 605334 - DNA, 130 bp, Homo sapiens
ccgcgtaccagttgcggatatgggtacggccgatgttgcctaccaggtgaacagcgcccgtcccaagctacaatggttctccaaacagctttggctcggtgaaggaactgccttcggacccacctggtga

SEQ ID NO: 605335 - DNA, 228 bp, Homo sapiens
  misc_feature (34)..(34): n is a, c, g, or t
ggttgtccctcgctcggccgtttgtcatttctcncttccgttgcttgtacctgttcgttgccggtcttttttgtcggcgctttgttcttattgtttcctcttcgtatcctggtccgtattcgttgtacggcttgtactcacgcgcatctcgtcgtactgatccgctattagtttgtttattataatacagcagtcagtcactgcttacaatgtccctcgaatctctct

SEQ ID NO: 605336 - DNA, 177 bp, Homo sapiens
atgtactctaaggatcccctgtctttgtggacggcggagccggttggagcaatgcttcttgtcacaggctgtactctagatttgggttctcattggcaagcatctgcattcaaaaggcttccttgtgtatgctggctgcttgatgaaggaccaaggccatgatggggtcacggagct

SEQ ID NO: 605337 - DNA, 1342 bp, Homo sapiens
gcactcagcccgagtccccggtcaccgggcggtctgtggccgctctcgggtactccccagtgcttatagtactatcagcgtgcctgaagtgcaacgagtgtaccaggaggaggggctggcggccgtctgacacaccatgccctgtcgcccaaccctcgcctgggccggtgctgtcccatgccgcctgagtgacgacgggtggactcccccgagaagacggtctccccttcctctcgcctgttgcctcccagtgccgagggttccatgctgggggcttgtgcaggctgcaggggcaaaccttcattcgatggttggcggcgagagcatgcctggcctggtctggtagtgtgctggcgaccgcccagttgtaagtgggtgtctgtgtctgtgagccagctgagtgagggtctccctcatgtgcacttaccgcgtctatgtgttgttacatttaggaagcaagataggggagtctggtaggcatagctaaccgggccttcaaagcggagtttcgcccgtttggatttattctttactcgcttttgcgaaggagcccccgagtatcttttgcgacccttcgatggcaacgccccttgaccaagagtcttacggatgcgcgacccctcgatgtggccgcgggtgccaagttatacccgcacttggccatttctttcgcgagatgattaccaagttcaagggcaagggcgtgatcagaactatggtttgaggcgcttgttcaaccccttgaaggccccaacaagcgaggatgccccccttggttgtcagcaacccatagagaaaccccccaatttccaactaggtccccgttgaaaaaaatgcccggccattcgcctttgggagccgcgccttttggagtacgaaccttcagagagaagaatcccaaaggagactcaaagcatataagttgagacggcacggttgggtgttcccccggttctctcgagcaaacggagaaacctaccgcttaggcctttgggcccgttcctttttacaaacccccctgtctcacagtgggggcccacatcttacaatgtggcgaccccatttcgaacagaacccccggttgggttaacgcattttttggtaaccccaagtgtacgcccacattgggtgatgcccttggcgccccatcgttctggccacgcggaaccgacgaggaatttggggggggggcccatttctttgcgcctttgtttggggaatttgttacctttggccctttggcgcaatgcccgggggtttccagcggcccaatggtggtttaaggcgtacacaaccgggttggggggaaatgctcggcctttccgctctgagcctgagtacc

SEQ ID NO: 605338 - DNA, 543 bp, Homo sapiens
actgactggttaccttctgtctttgtcccaaagatttaaactgtgtaccttgtatagctcttctgccccatttgacttctgagatgaaagtatttactaaaattaaaaaaaaaaaaacaaaaaacaaacctttagctcactaacttatgggttctgaagtgatggaaacttcttctaagggatatatttattaagcataaacttactaataattacttccaacaaataaaaacaggaatatcacttgtcacccaggggggtttaatagcatacattggtcactgaagcatatagggatgtactgtgatctttcctgaccgattatgaaagcattatgactggtcacacggtttacctcggctatatcactaacacggtttagaacgacataaactatcacgtggtggttctggcctacaatggtgtattaacaatctatataactaatctgctccatgtcgctttattaaaaaacataacttaccccataacggtcatatacaaaacgagggtgggatgacaatagttagagtgacaactgtg

SEQ ID NO: 605339 - DNA, 928 bp, Homo sapiens
gggacgagaaatggcggggtctccgtgagtaggtggtccttgagctcgcagtgggacaaggagctcgcggtggaagagagagccagggccttggttcttccgccaaggtccctcgagtaaagacttctccgggatgcagcatagagagctctggatagcgggggcgtgtgtgacccggaatatgctaccaacttgttgacaggcgggcgtcgctgcaacaagcatcggggggaccgcttgcgtgcctggagggagaatccgaggagccacgctgtctggcggaagaagtgctgccaaggtggagactttttggaatcaggcgtgttcgcaaatagaagaaggtatctcaagagggatttagatgagggagcgaaatcgcaatggggctagagagatgggttgtgcaaagaattacatgggggctcctgagtggggaattatacttgaggagtctagaaaagttagcttttggaaacggagtcacggtttttggaactggataagatttctcattaggtgagagactacttaggctcggagcaattaaaatttgttaagggcaaaagtaatcgcctaacggaaagaggggaattctcggtggggaaggtgggtggttcgcttcggaatgacattcaaggtatataaagctagagacatcataggaataggttttctggcccctccgttacaagtaaggtgcgtgagcagagtctggagtagattggcccacgaggggcggtgaacacaccaaggtatgtaagaagggaagaaattcagggtggaatggcctagtggaaaggtcccttgtgggcctcgctgttaaactgtgacccaagggcacgcacgggcactattccccccacggttctctcaggggagtggcaagccctggttaataccacccttccagacgggatttcgcgcaaga

SEQ ID NO: 605340 - DNA, 111 bp, Homo sapiens
acaagacagcacgttgcccagacctgaagttctcaggatcacgtgcagcttgtacagtgcagctcactcatgtggcaaaggtgcccttgaggttgtccaggtgagccaggc

SEQ ID NO: 605341 - DNA, 172 bp, Homo sapiens
tgtgcttcagataggctaggtcagtggatcctcatttgtgtcttgtcactgagttatataacagtctggttgaatgtctgtataccagagtatctcatttttatccgtggtgtgtttgactctaaggatctgcccctgaacatctcccgagaaatgctccagcagagcaaaa

SEQ ID NO: 605342 - DNA, 349 bp, Homo sapiens
tccggagtagttctgatgagatccgatggtttagacaggtgtggctcccagcactttgaggaggccaaggtgggcggatcacgaggtcaggagattgagaccatcgtggccaacataggtgcaaagcccgtttatacttaaaaaaaaaaaaaaaaaaagaacttagctgggtatggttatgtgcacctataatcccaggtactcgggaggctgaggcaggagaatcacttgaacccaggaagtgcgaggttgcggtgagctgagattgcaccagtgtactatcaccctggagacagagtgagacaccttctaaaaaaaacacaacgtgttgggcatttccccaccccca

SEQ ID NO: 605343 - DNA, 772 bp, Homo sapiens
  misc_feature (2)..(2): n is a, c, g, or t
  misc_feature (151)..(151): n is a, c, g, or t
  misc_feature (187)..(187): n is a, c, g, or t
  misc_feature (213)..(213): n is a, c, g, or t
  misc_feature (254)..(254): n is a, c, g, or t
  misc_feature (328)..(328): n is a, c, g, or t
  misc_feature (352)..(352): n is a, c, g, or t
  misc_feature (387)..(387): n is a, c, g, or t
  misc_feature (472)..(472): n is a, c, g, or t
  misc_feature (484)..(484): n is a, c, g, or t
  misc_feature (550)..(550): n is a, c, g, or t
  misc_feature (561)..(561): n is a, c, g, or t
  misc_feature (570)..(570): n is a, c, g, or t
  misc_feature (635)..(635): n is a, c, g, or t
  misc_feature (651)..(651): n is a, c, g, or t
  misc_feature (684)..(684): n is a, c, g, or t
  misc_feature (691)..(691): n is a, c, g, or t
  misc_feature (706)..(706): n is a, c, g, or t
  misc_feature (739)..(739): n is a, c, g, or t
tnggaaaagaactgaaggcataattctctacaggacatttacagttgttttctatatatattattaggtagcaggaaagttttttagaatgtcatttgcggtggacaatggaaggcccggcttcatcgtattcctgtttgctgaaccacanctgccggaaggtggacagagaggccaggatggagcnaccgatccagaaagagtatttgcgcnccggaggggcaatgatcttgaacttcatggtgctgggtgcnagggccgtgatccccttctgcattcggtcggcaatgccagggtacatagtggtgccccctgaaaggacattgtnagcatagaggtccttcctgaagtnaatatcacacttcatgatgctgttgtaggtggttncatggatgccagcagactccatcccgatgaaggatggctggaacagggtctctgggcagcggaaacgttcatttccgatggtgancacttgcccatnaggcaacttgtaacttttctcaagggaggatgaggatgcggcagttgccatctcattttcaaagtncagagccacanaacacagtntctccttgatgttccggacaatctcacgctcagcagttgttacgaaggaatagccacgctcagtnaggatcttcatgaggnagttagttagaactcggccagctagaaccagangcatganggcatggggcaaggnatagccctcatagatggggacattgtgggtganaacatctccagagttcagcacgatgccagttgt

SEQ ID NO: 605344 - DNA, 116 bp, Homo sapiens
ctagaggatccctgtggaatcctcctgctgctggagcctttttactcgcggtggtgatctttttttgcttggaactttagcagcagcaggagagcagcatggatggaattcctgtg

SEQ ID NO: 605345 - DNA, 241 bp, Homo sapiens
attcttcctaggtgtgtgaccttgggtaagtagcccccccaaattatctcatccttaaagcgagatggatattatatatctcagcatcatcatgaggattaaatgagctaacacacatgcacagccaagcatttcatcagtggtaactacaaccgtcattattagcacatgttcatcttgttggaacttcactttaagacacgggatccatgaatgcagtcaatgggcacacattatggag

SEQ ID NO: 605346 - DNA, 163 bp, Homo sapiens
  misc_feature (84)..(84): n is a, c, g, or t
  misc_feature (118)..(118): n is a, c, g, or t
  misc_feature (133)..(133): n is a, c, g, or t
  misc_feature (160)..(160): n is a, c, g, or t
aatggggaagaaggacttgggccccagcaggcctttttgtggcatccagtcagaagttaggaaacaccctctagggcagtgctncctgcaagctctcacacatgacttgagagaagtnagaagactcccagantctgcctttttaagttttccatcagtngtc

SEQ ID NO: 605347 - DNA, 347 bp, Homo sapiens
gggatcctaaggaaatagttataaaagacacacaatgatttatgggcatggctttgcatttcagtgacatttgtaataataaaaagttagaaacaaacgaaataggttaaaaaattatggtatgcccaaatgaagacatattctctatcagtggtaattaatactttttaaaaattgtccaaactttttgcaatgaaaattcctgcttttatacccaagaagtatgtatttttttttactcgggaggctgaggcaggagaatggcgtgaacctgggaggtggagcttgcagtgagccgagatcgtgccactgcacttcagcctgggcgaaagagcaagactccatct

SEQ ID NO: 605348 - DNA, 507 bp, Homo sapiens
ggatcggttcatcccgtggcaccaccaagtggatgcactgaagaagatgtgctggatcaggggggcttcgcccggtgtgtctaggctgctttctcccactgtaggggcacttacatggactgtcagcccaggacaagtgggccaaactacagcgggattatcctgatgcccttatcaccaactactatctatggccggctgtcgcgttaagccaagttctacctggtcccccttcattacaggtgggccggttgtccaatgtgtcgctgtaatctgggaactcataacctgtcctggaaggcacatcggggtctaagcgtggcttcagtccatcgtttccacctttgcagtggatgcggtttgaccctggacaggtcaggacagcttccttaccaaagggcccaaaaaagccacagccaaggggacaccatggtcagagtcgggcctctctggtgctccctgcagaacccggcctctcaaccaggtgctgtgagatactggtcacca

SEQ ID NO: 605349 - DNA, 297 bp, Homo sapiens
cacaaaataatttgtagatacgtttgtgcctgggttagctagcatcttgcacgtgtgacattccagtatcatgacataagcagtgtgtatccaagcacaaatgttaaaagcagagtaacttaagcaatgtcgtatacaaaggtatacagacactgtaggttattcttcttcttgaatcatttatgctgcatagcaaatcgcaatttacatgtcagtataatgttactgatctatagaatacactttgaaactgtgaggtatggcagctccctattacgagcgaggtgacatgtaacc

SEQ ID NO: 605350 - DNA, 155 bp, Homo sapiens
gaaaggggggggtttttccccggttccccctccgggggtttcttgcccccccctccaaaaccccccccaaggtttccgggcagggggcccggggccccccttggggtccccccaagggtttttttcccaaaaaaaaaaagtgattttggggggga

SEQ ID NO: 605351 - DNA, 225 bp, Homo sapiens
tagaggatcctgtgcagatacacagtcgcagagatagtcttttaaagaaataaataagaagcggaaggtgagcactttaaaaaagaaaaaatagggcaggtgcggtggtcacacctgttattccaggactttgggaggcttaagtgggccgatcacgaggtcaggagatcgagaccattcttgcttacacggtggaaacccatttttaattgaaattaaaaaaat

SEQ ID NO: 605352 - DNA, 744 bp, Homo sapiens
agaaaacctctgcgaggacagggagggagcaatgccgtgaatttaatgggacgctgtgaagcagactcatggatgcgaagtgaagagagggctctgctgtgtgctgctgctgtgtggagcagtcttcgtttgcggcccagccaggaatatccatgcccgatgcatgaagaggagccagatcttagccatagtgatctgcgagagtatgagaacacatagcgcagatgatatagccagcaacatcagtcatggtctgcgccctgtgctcagaagcaaccgggtggagtattgctggtggaagcagtggcggggcacagtgccagctcagttgcctgtcaaaagctgcgatgcgagccaaggtgtttcagcggggtgcaccatggcagcaggccgctgtatctatctcgagagtttcagtgtgccagatgccccgcaaggattggctggtgaagtgctgtgagaatagataccagggccacgtgctacgaggaccagggtcatcacgtctacaggggcacgtggatgcacagcggagagtggcgccgagtgcagcaactgtaacaagtagcgcgtggtccagaagccctacagcgggcgcgaggccagacgccatcgaggctgggcctggggaagcgacatctactgcttgaagccagatcgagactcaaagccctggtgcaagtcttaaagcggggaagtcagtcaaagtctgagaacctgcctggctgaggaaaggggtgcatg

SEQ ID NO: 605353 - DNA, 861 bp, Homo sapiens
gcgctgtgtgcggtcgagatttcatgagcgctcgtgactaaagcgtgtttgcagtactctgtggggggtgccacttttcgggggccacttcttccgggcggtatttcctcccctcctttggcgggtaaatatttctccggggtctagggggccagatttccgtgggtccccgctggacctcccgcggcgggccgtctcaaaaggatgggcgcccccacgggggcgaaacccacgtctctctggtgttgcacggtgcgatggcctttctgcgggctgtatttatggggggcaaatcacgcgggaagagggccccaaccacacactgtgggcgttttctgcaaagaatatctttggtgtcgtcccctctcccttgtgcaccatcctagcattaacctctcccgttcgcccccgtggacaaacggtctttgtccagcgcccaaacaactggctggtttattccccgcgagggtaacgtttacgcccccttcttaatgtgccaaatcgagatagcacatgctcgcttcacatgacaggggtccaacacgtctggaaggcgttcctactttgcccgccctagtatgcgcactgtgggcctccctcgttcttttgcaaaccgtgagtcctacgtgccgatacacagggtgtacacatcctctcaagggggtggacccccgtgacgaacttttgatgagtcagcaatagtagttgcattcctaccttttatcgccttccgccaccaaaaatgttccctcaatcttcttcgccatttattcaccatcccaaaggcatgtccccgatcaatgtaatacgacgtcgggtgcaacccaaccccctctctccaaacccaacaaaaaacaataa

SEQ ID NO: 605354 - DNA, 241 bp, Homo sapiens
cccccgatgcagagctgccccagtttacaaaactccctccgagtcccacatttaaattagaagtcctcacatcttccattcctggggcagtggatgagatgacatcctggaatggcatcagaactgtctagaagtctcactactaccatgaggccagtgatgctggccatgatggcaatgccatggaacatgacttgccccatgccccaagacatatgcacccattggttggcgtgcctgc

SEQ ID NO: 605355 - DNA, 1302 bp, Homo sapiens
tttctctgttgtgtttttttggtgcttggtttcgtcgtctctgtctcctcgtcctttttcgctggctgtgtggtctttttctgcttttgttttcttttggttggctgcacgttgcgtgtgctaggtgttcctgcttgtttgttctttgttgtgttgatcttctccttggtttgttgtcgtgtttgtttttcttcttcttggtcgttccttgcttgttttgtcgtccttttgttgttgtgtgtggtgtattattgttgcttgtgcttctttttttgttttttcttctgtttttcgccgtctcccctctcctggttgtcgtccaatgtttttggtcgcttgcccttggtgttctttgtttctctgcggttatgttgtgcgcgtggttgtatttttgcttgtctctttttttttttcgtgttcttgtctcctctcttctctctgttgtgtggttgtacccttgtctcgtcacttctctcttctttgcgtattttttgtgcgcgtttcgttctcctgtctctgttgttcgcgtgtgtctcccttgctttttctcctgcgggtatttgatgtgtttctccttgtttttggttgttcctccacttgtttttttcctgtgttttgttgcgtccttctgtgtgtttttcgtttctcttctgttggttctcggcttgtggtgttttgcttgtgtgtccccgttccccttcgggtgtgtgtgtcctctctgtgggcgctcgctcctgttttgcgcttttttgcgctctcctcgtctctggtggggtcgtctggcactctcttgttctcctctggtctcgttcttactctctcttggtggggcgcgcgctcgcgcccctgtgtatgcttctcttgccccccgctgtggcgctctgtgtattttggcgtgggtgggctgttttgtcgtcgtgggtttgtccgctgagttatgtggtgtttgttctttttttctctgtgtgctttgtccactttttgtgtttttgagggaggtcgctcttgttgtcccctcggtctctgtttattccctcgtttcctggttggttgcatgtttgctcgcctgtgcgctcttgcttgtgtgtggttaccgtgttgttctcgccacaatttcgtccgtgtggtgcccctctctctccgtggtgtgttattgtttttgttttcccctctccctcgctcagttcgtcctctgtttcttgtctttttcccttctcccctcgctctgcttgttgccctctcgctgctctggtgtgttctcttgtaaaatggtggtggtttggtgtcttttctttgtcatta

SEQ ID NO: 605356 - DNA, 1033 bp, Homo sapiens
  misc_feature (49)..(49): n is a, c, g, or t
  misc_feature (80)..(80): n is a, c, g, or t
  misc_feature (91)..(91): n is a, c, g, or t
  misc_feature (99)..(99): n is a, c, g, or t
  misc_feature (124)..(124): n is a, c, g, or t
  misc_feature (141)..(141): n is a, c, g, or t
  misc_feature (162)..(162): n is a, c, g, or t
  misc_feature (165)..(166): n is a, c, g, or t
  misc_feature (170)..(171): n is a, c, g, or t
  misc_feature (174)..(174): n is a, c, g, or t
  misc_feature (179)..(179): n is a, c, g, or t
  misc_feature (196)..(196): n is a, c, g, or t
  misc_feature (265)..(265): n is a, c, g, or t
  misc_feature (269)..(269): n is a, c, g, or t
  misc_feature (344)..(344): n is a, c, g, or t
  misc_feature (347)..(347): n is a, c, g, or t
  misc_feature (353)..(353): n is a, c, g, or t
  misc_feature (373)..(373): n is a, c, g, or t
  misc_feature (376)..(376): n is a, c, g, or t
  misc_feature (385)..(385): n is a, c, g, or t
  misc_feature (636)..(636): n is a, c, g, or t
  misc_feature (640)..(640): n is a, c, g, or t
  misc_feature (651)..(651): n is a, c, g, or t
  misc_feature (672)..(672): n is a, c, g, or t
  misc_feature (684)..(684): n is a, c, g, or t
  misc_feature (698)..(698): n is a, c, g, or t
  misc_feature (713)..(713): n is a, c, g, or t
  misc_feature (721)..(721): n is a, c, g, or t
  misc_feature (725)..(725): n is a, c, g, or t
  misc_feature (731)..(731): n is a, c, g, or t
  misc_feature (761)..(761): n is a, c, g, or t
  misc_feature (766)..(767): n is a, c, g, or t
  misc_feature (778)..(778): n is a, c, g, or t
  misc_feature (781)..(781): n is a, c, g, or t
  misc_feature (783)..(783): n is a, c, g, or t
  misc_feature (788)..(788): n is a, c, g, or t
  misc_feature (790)..(790): n is a, c, g, or t
  misc_feature (796)..(796): n is a, c, g, or t
  misc_feature (804)..(804): n is a, c, g, or t
  misc_feature (813)..(814): n is a, c, g, or t
  misc_feature (820)..(820): n is a, c, g, or t
  misc_feature (825)..(826): n is a, c, g, or t
  misc_feature (829)..(830): n is a, c, g, or t
  misc_feature (859)..(859): n is a, c, g, or t
  misc_feature (865)..(865): n is a, c, g, or t
  misc_feature (871)..(871): n is a, c, g, or t
  misc_feature (880)..(880): n is a, c, g, or t
  misc_feature (884)..(884): n is a, c, g, or t
  misc_feature (893)..(893): n is a, c, g, or t
  misc_feature (899)..(899): n is a, c, g, or t
  misc_feature (911)..(911): n is a, c, g, or t
  misc_feature (926)..(926): n is a, c, g, or t
  misc_feature (1004)..(1004): n is a, c, g, or t
gcatttattgcatgttttaaaattcgtgctatatatctgtagccctggnctgagaatacaaagtgatattttcccaaganacataaaactngggaaagnggtgggggggattttcccaccagtnctccccccacgccaggncccaagcagggtgaggcctcnaanncggnnagntgagnaggcgaggactaagagntacaatctggaccagggaaggaggggtggaatttgcaacagcgtctcaactaccaacgagaggtaagcnagtnaactgtacaagtctcctatcaactttttaaaaaaagagaaaagctgtaaaagtcaggccctgtgggtagggaagnggncaggtncccagccagggccgggatcnggngtgggtgcnaggcggagctgctgcgaatgcggcacggcgggccgtctggccagaggctgatgcaggtgggcggccttggcaagggtagcctagggctggcgccaccgctaatcaccaccctcgaagccctcctcctcttctggaactgggtctgcatcccagcatgtgatgtcgatctctggaggcttgttgtagaacacaggaggcggagcttggcacagagctcttccgattgggcaaactcctcctcctgtgattgnttgnagttcccctcnctggcctgggtcccctccttntggcgtggtctngccattggttaggnggtgcgggctcaggntcatgctnttgntcaagntcatcaagggctgagggcagagttggggtntgggnngcagcaagggnctnanattcnanttcatntgggtcanagaaggtgnntggcgnatcanncanntcatcaaagttgagaagggtggcacagcnttcgcntgctgncagcagtgnctcnggagccacntcatcnagcaggggcacntctgccagggtgacntcagtacccgagggtggcgtgggggccctgggctcaccctggagtgtggaggcccttccccgttgccaggcataggtnatgaggctggtggcggcgggggtagttgt

SEQ ID NO: 605357 - DNA, 312 bp, Homo sapiens
tcaaatactttaaaaaatccttgtatcatgtgtcctccattttatcattttcataaactcaacattactattgatcaaagaaacaaagggaatctatatttacacgacaaaacagcaccaacatataaaataattttcttggtgctttactttatgaaatttaagacagaggacaactctgcttaaaaagtgtaattcctttcttccagttggaaaaaaaaaaatcactagcacctttaaaagcatatcaggacctggttagctgcaccggtatgaccatagttgctcatctgatatcaacagctctatctc

SEQ ID NO: 605358 - DNA, 150 bp, Homo sapiens
aatccccgagctagccccaatgctgtagcttactgcgcagctccctaagcggttgtcaccagctggagacggtatgggagaaccgttgtggcgagcgctacacgaggcaaactgacttctccctctctttgacactggacccctgcgagc

SEQ ID NO: 605359 - DNA, 605 bp, Homo sapiens
ttttgtttaaggccaactttttggctgagacaaaggtgggcctttaatataataaagtaagcccctcccactcacgcaaaagaaaagctgcgtttaaggatttaaactggcattttagagctcggagttcacatgggccacataagcgaattcccttccggagcgcacagaggtgacgtgtatgaattacgcttatggacgtattagtttctaatgaaagatatgcaggtaccactcaagggccttctaatattaaccttccctgcccggcagaaagcccagtacaaggtgaggaaatccgaaggggctcactgccctctcaaaccaagagggcttggtttccgaagcagagaaacaccctacccaagcacccgcaccgtacttgggcctcaagtaacggcattcttcgaggagaacgggcaatctcgccccccttacagaggagcggaaccgcaagccagacagcaaagctggttggtttctctccatgccgaggccacggatgcccgggaacgtcaccagaccagaaaggacccaatcctcaaccttcccagcgcaacgacgcgcggccggccctctgctcagcagaagcctcctgcgcgctc

SEQ ID NO: 605360 - DNA, 320 bp, Homo sapiens
aataaaccatttcttctccaacaaaccattttgaatgtgctcttggtccttgcgattggcgcttcggtggtgttaagtgcctttactttcaagtcttttggcgccaacggaaacagctagccaatcggcaagacagcaatctaaccagcagctcattcaggtttttcggcccacgcagtatattgttacccaagcggatggccagcaacatgttgtcctgagaatctgactcaaaacaagtgatatcgattcggaacgcactgatgtcagcgcgtttttgcgatgcgcaaacaacacggtcagtacgcagcggatagaaa

SEQ ID NO: 605361 - DNA, 107 bp, Homo sapiens
gactctcactaaaatgcacatctgatcatgtgactcacctgctcaaaatcttcaataccttccctgcaaatgctaacagaatgcaagtctgatcatcctcagggatg

SEQ ID NO: 605362 - DNA, 224 bp, Homo sapiens
cgccggtccatgactgctcatcgctcacctcccaaagtgctgggattgcaggcgtattccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatatggggatcctcta

SEQ ID NO: 605363 - DNA, 383 bp, Homo sapiens
cttgtgattaagaccgtacacgacaatatagcagtctactagtaagcgtagaggggcgagtgctggattgaggatgttagcggatacggatatctacgggggagatgataggggtcttcgtcgtgtaggggaatatgaagtgtatagtaaggtgcgaggggatctgtgaacaggactgatagcgtcggggtcggtggagtagtagtctaaatggaagtatattggtgaggtggaatcgttcccggtggccgccctgtgtgggccgtgggttactgggattaggtgcgctatcggggtagaggaggtagccggtcgcgcgtaatcctgttggggagacgctggtgttgaggctggcgaggtttgatgtggtgcctgtacgggtc

SEQ ID NO: 605364 - DNA, 551 bp, Homo sapiens
ggcagcgtacggccggaattaagggatgctcgagttctgcgcgggacttgacaaggcacgacacgggccggaaggctgccaggcccgagttgggcaagtcgaagaaatgaaccatcgacaatgcgggtcgcattcggggcggggccgagtgcgaaccgtgagtccccaagatcccgacccacggcaggggcggggcccgggagctggggccgttggcaggccagcccgcgcggcgacgtctccgctgtgcggtcacggcaccgaagtgacggcctaccacaccagtggccgcagaccagcgcccgaaggccgacaccgctggccctgaggcaacggctcatcaggtacccgggcggggggcgggcgtgaggggggcgcgggggctgcgcggagaggcacgcgcacgcacgacgcacgcaacgcacgcactacgccacgcgcctcggctaggaagccgctgtacccatcccgtccggccgttgccctggcccgttggagcttctagggcccgaggcgggcggcgccgttgggcagtccggcgcgtggtctcc

SEQ ID NO: 605365 - DNA, 531 bp, Homo sapiens
  misc_feature (90)..(90): n is a, c, g, or t
  misc_feature (259)..(259): n is a, c, g, or t
ctctgtgttaggcagtttaccatctggctgatgtggggaaagtgcaaacttcctgtagaatcccggtcttttcatccaagtgctgcagcngcagccttgtagtctgcaaagaaccatgcagaaaccaaagagcttgcttttttgtctttgtaatttcttagggtctgtgatatatgccaggaaatctgattgaaactaatatgctttttattctcccattattccctaaatggttatatcacaggcacttgcctacatngggaaagtaaggacaaataatacccatttaaagtaacttgcctatattttgactgtctttcgtaagcacttgctgaactgctgacttaactcagttttaggatttcctctttccccccaacttttccacatttcttaaatgagggtgtaatttactggaaacatgtacatttaatataatattgctgttagattcatggtacactttatgaagcaaaaacatgaaaaggaaaccacaactctaataaactttaaattaaagattaagatgac

SEQ ID NO: 605366 - DNA, 159 bp, Homo sapiens
cctagaggatccacgacgcataggagagagacttataatgtacgaatgcttaaaaggcttccggaacagctcggacttaccaaacaccagagaatcatactggggagaaaccctataaatgcactccagtgtgggaggaacttcaaacaaattggccca

SEQ ID NO: 605367 - DNA, 155 bp, Homo sapiens
tgcttccaattaggtgcatgagtaggtggcctgcagtaatgttagcggttaggcgtacggccagtgactattggttagtgtctacctgggttagtgtctacctggtggtctacctgtggttagtgtctaccttggggtgtacctgagctctgaat

SEQ ID NO: 605368 - DNA, 883 bp, Homo sapiens
ggattgatcgaggagcgcggttaccggacgggctgggtctatggtcgctccggggccgctccgccggtgtgctttttaatcagggcaagctgtgtccatggcaggaacttgggcagagctcccacatattgcaagtgattttgataaacaagatctgtggaaggagcgcaaaaaggattaaaaggttctctcagaggaagaatatgggaggtcaccaaatattttttacaagtgttatccaagcataaggtgaacatcttaattcaggacaacaatgttatgtgccagtgctagggtatattcagggagattctatgcaaggtattctctgaaagagtatgagatcgtgtaataagtgggctcctacatgtgtgtttggggccatccaaggtagaggatttggcgtagtttcaaatacaagatgtgattgtggtgtactttctgttatgtaggtgcaaaagtgtatatctggtttaaagggatgtattctaaaggaaaggttccagagtaaatagatttttctaaggtgaatggagacttttgggagtatggtgggttaataaaatttcctgggggacacttatttttcgcgtgttcgtggcaaaaaattcaggcaaaaggttttttaaaaagcaattacggattttactttaatgccaatgggtgggattttgcatccaaaaatttacaattgaggggtgatcttggcggggtagaaacactctgtgccgagttatagtgaaatgggcaaggagaatggtctcaggggaatattattattggggaccggtcgttgtttggtctgttttgcacagtgtactacattcgaaaagcgtctttgtgatggggggcgaaaatgactaggggtgacagagctcttttg

SEQ ID NO: 605369 - DNA, 140 bp, Homo sapiens
cccgcggtttgtcgtcgttgagcagcccccacgggtgtcggtcagactcttgggtgtgtgtggtctgtgtggtccttgagtgggtttctcggattcgtgccctggaatacctgggtcaggaatgctgtcagacaaggtag

SEQ ID NO: 605370 - DNA, 153 bp, Homo sapiens
acacgcactttgcacacgcacttggtcatgtatatcgggacttcttacgtctgcacgatgctgatgtcacgactaaggagtcttgtctctaacgtgaagaagtcattaagagctgcttatgtaaagccctgtgtcttgcgagacagtggcgtt

SEQ ID NO: 605371 - DNA, 321 bp, Homo sapiens
  misc_feature (159)..(159): n is a, c, g, or t
  misc_feature (172)..(172): n is a, c, g, or t
  misc_feature (304)..(304): n is a, c, g, or t
gggagatgtcatctgggagtcagggactggagtcaaaaactttagaagtctactcggtgttctagtttgctgtggctgggctggcaataaagccatatgacatagtgcttctcactcttcggtcccctttccacagatagaggaacatcacaccatggncaccaccacgggnccatagggagtactgccaagttcctgccagtgttcacttaaggcctaaaagctcttcagtcagtttgtggctgtcaggactgggactcacccttcaaggcgatcagttctctggaccagggtaggttttgcnatcccacccaggatttt

SEQ ID NO: 605372 - DNA, 510 bp, Homo sapiens
tccccgcgcggagtcgggcagtgtgcagcgggagaagcggcagccagtggcgcggcgtgggccggagagaggcggtcccctgggaggacggggtctcccctcgttgcctttgtacgtggacgaacgtgtgtgacaatgttggcacgtctggctgtgatcgcagggaagcggggccggcgcgggcggccgagggtccaggcgagcccgctgggctgcgacgggacgattgcctgcatgctacacctgaaatgccagttatgtgagacaagaatgcctgccacgctgtgaccattgctgtgcccccggaccgcacggacacgatattatcatacttgataaaggtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccac

SEQ ID NO: 605373 - DNA, 1167 bp, Homo sapiens
ccgatccagtgctgcacaaggctgggagagctgccccggggcccctgctatcctgcgcctggagtgttgtgaagagggtgggtttgcctgccgccctgagggctgagagctgccatgatggatgctgggaatgaatggatgctgctctgccctgccctggcctggcctcctcgctgtcctcccctgtgctgtttgtgctctctgtgactcactagtgacttgctgggctgctcctcccaccctgctgccctgcctcctcactctgcctatttctgttctgcctgtgtgtgcttgcttttcccaatgcctcgtgctgtgttgctgccctgtgtgctgatgttgctgtggtgctgatgtgtgtgcccctgtggtgccatgtcgacctgatgccatgtggtgtgctgttgtgtgtccctggtgctagagatgcttgctggaccttgtgcctgtgcgagatgtgtgtggcccattgtgtacgttgtggcttgcttggcgtgcatgccaatgcttgtgtgggcgccctggtccgttgcatgctaaagtgttgagccgagatggctgagtcttgcttgggacctgtggtctctgcccgttgccccccccttcttggccaacgcttgtgtggtgctatgtgtgcgtgtgtgccactggtgaatggccctcctgtggagtggctccctggggtgtagtgcctggcggcttacgatggccttgtggcgtggctagagtttgcaacatggtttgcgggcctccaagcggtggctggatggctttggctgtgtgtgcctctggctacgcaggcatatcctggttgtggcgtggcgttccgttggtgtggccatcgcacccacattgggatattaccctctttgggccgtgggggcatgggcgttaccacttggagcacccctttggtgggtctcctggaacccattgtatccgatggaacacccttcgcgggagacgaaaacactaggagagtgggtttgggcaatcagtacctgaaaagtgatcttataaccaattccccacaccacctgtgatttaggctcacttacccttgcgcaaagagcccccaatgtgagaaggtctgggagctggggggaagagaatatgcagaggctcagccgggcaagggaagtcccgcttcacttccccaaatttatt

SEQ ID NO: 605374 - DNA, 1642 bp, Homo sapiens
  misc_feature (1642)..(1642): n is a, c, g, or t
ctgctaataccttgctcctccaaagtccagagtcccaagcctaataataggcccctggcaacagaatcggagatgaaggtacccatatgggaaaaatgggacaaagctgatgctggcaaggtaggggaataaccctgcagaaaatggtgagatgccaagaacgagaccaggcagcaggaaagctgacaggtgctggaggatgccaagtggaatgtgtgtgcattttttgataactgtgtacttctggtgactgtacaggtttggagaatatcgtattttctatatcacatgtttatataataaattgcaggaagtttctgttgttagctttgttctttggtgtgttcaagaacgctatgttggttgacgcacacagaacactctcatgtgtggtggatgattagggagggaagggggcattagtgttcgacgtaattacaaatgtgatctctccgaataggtgctggattgtgagtggtgcgatggaaaaacccctttgtcccttgtcatatgctttgtgagacaaagacgttacctcatagggttctcccgcgaggtaagagaggggagtttcccccgtggacttttttgcatcgaccacgagtgtgaccaaccacttgtgggtctacatagaaaacgcctttagcggaggctagttacataaatagacagacatcgtggctctttgtacactggatccgtcgttgtcctctcccttatatcccaatccgtgtctcagcgctatgtaaggagattgatactctcgcctgttttataaggtccccgagaggagcaggttctgtgttccgagagaactctttggaggcccctcatttaggctccatttgtgggtgctcacccaggcgtgtgttgtccaacgggcggaggaccctctgggggagggtttttccccagtgtgcgcaagtgtgtccccactcttgtaagaaagttgggccacccctagtgttctaaaaccaggagagccaagggtggcgttcccccccatttcctctcaatagaaggcggggcgcgagggaaagtcctcttccgagggcaattacagacttttcttgggccgacctttttccgatctcctgccaatttttcgccttagaaaagaagcttcgacgggagctccacgtgctcttgtgcggacaaacaccgtctctggtctgagcaccaaccattcttctcttcaacctgttttaacatgtgggtcaaagccccgttcactgtcttataagacgttatcccccggttctacagagagactaccacagtgtacgaacaccccacatgggggcgctaataaacaggaggagcaaacaagaacattggggggggcccccatttaagaaaacagcgggctttctcaccgcaggctggggataccatgcgtaacgaacagcttcttgcgccgtatactgcgcggcaaaaacacacatattctgtattagtagacaagcaacttcatacacaacgcggactcaacagcgggcgggctcgtacacaacaaacaacatgacactgacggtctctttcgttgtgccgacacaacatatcgcgtcatacgtcgtacgcacaccttgagagatataggcgtgcgctagcataatagtacacgagctaatagcatacgccn

SEQ ID NO: 605375 - DNA, 1103 bp, Homo sapiens
gaaaaaaactctacctcatctatactaatctccctacaaagtctccttaagttataagcattcacagcgcacagaactaagtcatattgttatagtcttcttcgaagagcacactatatccccaccattggccagtcatcacccgatgaggcaagcagccatgaacgcctgaacgcaggcacatacttcctattcatacaccctagtaggctcccattccccgtactcatcgcactaacttgtacagtcacaacaccctaggctcacctaaacagttcgtactactcagctctcactggccaagaactatcaaactcctgagccaagcaagcttacatctgactagccatacagcaatagctctctgactagtcaaacgataactctattacggcactccaactgtcatgactcccataaagacccattgtcgcaaagccccccagtcgccatggcgtacacatagataagcttgaccgacagacaactcgtgtaacaaacttagcgacgcgacatactcggtacttcacacacacaggacattcaacaaaattaaagtatacatgccgacaggcccccaccgatggcaaggaaagagcacagcacattaagggcactacgctcacacattgccccttagggtacagcataagtacgcccataagatgaaagagcacacataagatacaagctaagcacaaggggactgccgccaatccgtggaacctgactgatacaaacagagagggaacgccttcagcagctacggcacccagtgggccatacacatccgagagaaaacgacacaacgagccaaccaataggacaccgcatccggacacgagccacaccaacaggggcacacaacaccgtacaaagagaccacaaagagcccacccaccgggaacagacagtatagcgctccagggcaggcaaagccacacatgcctcacagagcacgttgcgcagcccacccgggggcatataacacaagcccgatgcgatataacagtaaagatcctgagccaaaacgacaaccacgaccacaaaaaccgacagagcgaacaagcgcagaagcagacacagaggtaccgaccagttca

SEQ ID NO: 605376 - DNA, 373 bp, Homo sapiens
  misc_feature (16)..(16): n is a, c, g, or t
  misc_feature (128)..(128): n is a, c, g, or t
gagaaagaggaatggncctggcctgtgggcaggatccagagctggtgcggaacatctgccgctgggttaggcaagctgttcagattcctttttttgccaagctgaccccaaatgtcactgatattgtnagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctggggacagcaatcagacctattgcttttgagagctgtgacctccatttgcttcgtgctcttgcctggatttcccatttttgggttacttggtgggattgaa

SEQ ID NO: 605377 - DNA, 855 bp, Homo sapiens
cgtcgtggcgggcgtctgtagtcctagccactcgggaggctgaggcagcagaatggcgtgaacccgggaggcggaggctgcagtgagccgagaccgtgccactgcactccagcctgggcgactgagcaagactccgtctcaaaaaaaaaaaaaaaatcttatctatttgtccgggtgaattcagagaccatggagattctatttatcagaaccagggaagataaattccttcagagctattcaacggagtacttcttttccctcaaaactggggggactggtcggggaaagggggcccacaatttttggtcttggatatagctccaattctcataagtatatacgggccctataatggggcagaaaaagatgcttggagggaaaatctccataacccatgagggagacctgaaaaatcatccttaggggtataattaataatggggcaattaagtgccaatgatatttctcaccatggatgctcgggaatgtgaaagaacattaaacagatcctgcggaattatgtatattctacatgtgcgaggggacatcggggaaattgcttgtgaaatgatttgtggcttctgtacaacgattttcaactaagttttttaagtaaattcagtttccctccatatttaaaatgctgtgctaggtctcaattcggattggtatgcgaactgcctactaatactacggggagtggcggatactggtatccaaaaagagattggggaaaaaagggggctggaggaggagattggactaggataggaaaggttgtttggggcagggatcacagggcgtgttcatgggaagggggggaaatcaaaggtagggccgagagaattagtg

SEQ ID NO: 605378 - DNA, 248 bp, Homo sapiens
  misc_feature (97)..(97): n is a, c, g, or t
  misc_feature (107)..(107): n is a, c, g, or t
  misc_feature (227)..(227): n is a, c, g, or t
ggctgaggaattcggacgaggaccatttggaccagctgggcagcagctccaacgggcctgtgggaccaacaacaccgtttcacccttaggccttcgntcctcttttnctttagcaccaggttgaccagcagcaccagcaggaccagcagaatccattggggcagcaggaccgacctaccacgttcaccagggcttcccgaggaccaagcaggaccagcaggaccagnagccccagcttcgcccggtca

SEQ ID NO: 605379 - DNA, 109 bp, Homo sapiens
acagtggtggcctggtctcaggttcccgggccaccacctggggtctgagtgtaccctcatggagccacctatcctccagaccctggagctgtgtgcacggtgcgttgtg

SEQ ID NO: 605380 - DNA, 438 bp, Homo sapiens
  misc_feature (3)..(3): n is a, c, g, or t
  misc_feature (61)..(61): n is a, c, g, or t
  misc_feature (92)..(92): n is a, c, g, or t
  misc_feature (263)..(263): n is a, c, g, or t
ccnggctggtttccccgtaggttgtcaaacctaaaacgtccctgccccttccattggcccncttttccgtgaaagctccctgccctccccanaaacgatgtctcccctttccttccttgaacccacatctctgttattgaaactcctagaagtcggctgggtgtggtggatcatgtctgtaatccccagcactttgggaggccgaggcggggggatcacctgaggtcgggagttcaagaccagcctggccaacatggcgaaancccgtctctactaagaatacaaaaattagccgggtatggtggtggacacctgtgatcccagcttctagggaagctgaggcagaagaattgcttgaatctggaaggcggtggttgcggtgagctgagattgagccactgcactccagcctgggtgacagcaaactctataattagt

SEQ ID NO: 605381 - DNA, 998 bp, Homo sapiens
gaaaggcttaacatgtaaagataagatctttactatctctaaccctgtcctttgtttcactgcattcttgtctagttttgcttcattgcttatcattaggatagggtaagtgaagtttgctatgctgctaggcatcctaatgcaatgtatacctgttgttgtgaagacgaattgtgaatagtcatgattcatttctagcagcaggctgagttcagtgacagtagcttccattgagaagtcttcctgtgtcgtgaatagccactttgtaaatgacctcgttggtcgtcacataagccaaacaaacgatagggaacgtatctgcgtatgaaagatccacaaattgtgttcagatcagtgccctagaagaacaattttatatgcctcactggttgttattcttagggttcattcccacacttgacttctatcgattgtgtactactagtaaaaagcagcattgccaaataatccctaattttaccactcaagaaatatcatgaaatgatgttaagcttttatgaaaagtttaggttagacctactgttgttagattaatgtatgcgttgcttccctttatctggaattgtggcatgtagcttttttattttaaccctctttaattcttattcaattccatgacttaaggttggagagctaaacactgggatttttggataacagactgacagttttgcatacttataatcgggattgtacctagcaaggatatggctacctttgttaactctgccttctaggtatcaaaaggcagtgagtataagccactttgtctatctgtttgacctgagtttattggtgtaaatatgggttgcaccttccgaagctctggacctcgttaacgtttcttttagcaaagttgcctccgggcaagacaccgtttttcttcacaaagcgactttaaaaaaaaggggggggacccagagaaaacccttaggggaataaagcacaggaatatattttaccaacaattgttacgt

SEQ ID NO: 605382 - DNA, 265 bp, Homo sapiens
tgccaggggacagacgcagtccagtgtgaagtgggctccactgtcatacaggaccctaatggagggacagataaaaataaaaaacaaaaactttggagacatacagggaacaagagaaacaaaatagaaaagagctctgtaggtgctaatgtacagtaatgatccacagttctcttcatccaaatcagcaaaaacaaaatggcagggtttaacagtgcaagttcaaacacatcaaggtcattcagcatgttaacacattccatta

SEQ ID NO: 605383 - DNA, 595 bp, Homo sapiens
  misc_feature (520)..(520): n is a, c, g, or t
  misc_feature (523)..(524): n is a, c, g, or t
  misc_feature (532)..(532): n is a, c, g, or t
  misc_feature (534)..(534): n is a, c, g, or t
  misc_feature (536)..(536): n is a, c, g, or t
  misc_feature (543)..(544): n is a, c, g, or t
  misc_feature (548)..(548): n is a, c, g, or t
  misc_feature (554)..(555): n is a, c, g, or t
  misc_feature (558)..(558): n is a, c, g, or t
  misc_feature (567)..(568): n is a, c, g, or t
  misc_feature (577)..(577): n is a, c, g, or t
  misc_feature (585)..(589): n is a, c, g, or t
cgaaagaagtgaagggaccatagacagaggagagaagaggcgcagaagatgagacagagatggagggaacgagcggaagtaagcgagagagtgaaggaaaggggagagagtgaatagatcggagaagcagaagcagatgagagaaagacggatggacagatgggccaaaaaagagagttggattgagcgcacgagtgacacacatggtgaagtcgactgacgagggaggagacatagagacagagggaagggcggatggtgaagacgggcgttaaacagggcaagggaaagcgaagaagcagcgtgatctttagagggaagatacttcaggaggaagagaagtagcagaaaggggtgggtcagacgaaacccgagtctaaaagggtaggaacagccggttctaaagcacgaccaagagcgtggacccctctctagcctggattccactaaaatatgtgaatgtggtgtgtgacaacacgtcggcgagtgaggaagaaaagtcgggcacgctaaaaagtgnaanncccaactncngnaattganntacngtaaanncanaagcaactnntttggatgnttggtgtnnnnnccacca

SEQ ID NO: 605384 - DNA, 346 bp, Homo sapiens
cccccgggagtgatgtccaaagacgtctagtaggttcaaagtatggtctatcaaagaatagaagctattcctatcgtggcagggaaaactcgtggatcgtggttcaaataccatttttcaccagctcatgaactccattctcatcgatgattagaggtgcatggaattctttatctgccacataactttctaatccttctccagcataggagataagaggagagattacacattggattggtacatcattggcatccttcaagctaagaaaaaaaacaagtgtgtgttaaagactttgcttcccatgttacttgccagagcaaaagtacaaaccataacttacctc

SEQ ID NO: 605385 - DNA, 551 bp, Homo sapiens
  misc_feature (476)..(476): n is a, c, g, or t
  misc_feature (479)..(480): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (499)..(500): n is a, c, g, or t
  misc_feature (504)..(504): n is a, c, g, or t
  misc_feature (510)..(511): n is a, c, g, or t
  misc_feature (514)..(514): n is a, c, g, or t
  misc_feature (523)..(524): n is a, c, g, or t
  misc_feature (533)..(533): n is a, c, g, or t
  misc_feature (541)..(545): n is a, c, g, or t
tgtttaacaatattgtagaaggaagccaaatcgaaccttccctaacaaaaaattcctttgggagcccctgtcaaaaagaaaaccaaagagggttaaacggtcattatagaattcctaaaaccagagcaagtatttgccattaattgttctagctctaaaaaagcataaaaaaagacggtggtgtgtaagcgatagtttaccaggacacccccaaatactttcagtagtaatttaataaaagtttgggtccatttaatgaacacaaactgcgagccagttttctttcttttttaaaaaattaactttctgaagctcttcttaagattttcttctaatgaaccaaaagaacatctgcagcgtgacacactggctgataacgcatgacacttttaacattatttaagtaaaataaagatttaggtaaattacaaaataatcagaagttagaaataaaagccatgccctttaaaaagtgnaanncccaactncngnaattganntacngtaaanncanaagcaactnntttggatgnttggtgtnnnnnccacca

SEQ ID NO: 605386 - DNA, 133 bp, Homo sapiens
cgggatttcagagacagccatgatctgtcgctggtgtggacagtcacgaaggagctgatctcctgtgtctccccaccgtgcattataacatggagcggcattcccaccagacaacgagagggcagtgtcctgc

SEQ ID NO: 605387 - DNA, 615 bp, Homo sapiens
gccacaagtcagccaccttcatcaacagctgggcaacatcctttagcaacagctttgagcttttgagcatagaagtgaggttctggggcatcaatgtcagaatgtcatctggcaatttcagatagtcaattgtcctaaaagcattgccattgtcatcaacatcagtgctcatcacatcagccacgggtctcaccaatcgtgtgaggttcgagagctcatcattgtgttccagttagcgttcatttctgcaaggttccagttctgcacagcagtcagccatttcaccataggtgtatcgtatgtttgcaactgtgcgtatttagtcaccagtcacggtatgcagtgatctgtcccgcttctcatgtgactcatcagcaagacatgtcattgccaattcagacacgtcattcacatgttctacatgatctacacatggccactgctgtcgacactgagcctaggcaatcttcatctaggctatcaaattttcgtctagcaactcttttaacgagtgagtatcctcactcctgtgtgcatctataagccgcgctccactggaataagccgagcttaagagttacacaatgcaaagtgaggtaagccacttcagtgtgc

SEQ ID NO: 605388 - DNA, 1047 bp, Homo sapiens
tcgactggtttgtagttggtggcatgtgatggtgtgcttcggttgtgtgtcgcccgtctcttgtgtggtgttttctctgtgtgtagtgtcggtttttgcgtggtggtttgttacatcagtgcccgctttgatgtggtgcgcgttgtcttcgtggtggtccgcgttcctcgcggttcctagtggtcccgaggggggctccgtgccacgaggggtctccgcttcgactctgaccgtttgcttctgtgtggcaacgtggccggcattatggcgcttttgtggcgttcactggttgtctcttcccattttccgtgttgtcactcacgcctacgcggtcccgtcagtgagcaagcctgtggcaccttggggcaaggcccaggattcaggaagtcaaggtgcatcggggtgatcgggtctgctggttgtccctgcttgtggcctctccatagttatcggggatctgctccggcagatccccctggccgtgctctttggaattttcctgtgacatgggagtcacctccctttacgggatcccgttctatgagcggctgcatctgctgctcatgccgccccaacccccccccgatgtcacttacgtcacagaaggtccggaccctccgtatgcaccctgttcaccggccctgcaagctgctctgcctggccctgctttgggccgtcaatgtccaccacgctgcctccctggccttccccttcatcctcatcctcacccgtgccgctccgcactggtggtgctcaccccgtatcttcacccgacccgagagatgaaaatgtctggagtgctaacgagggcacgaagccggtgtttgaagaggcgggaggggtgttggaccgagtacacatgagaatgcccactgcctgtgtaaccgccacccgagggacacgccgagggaccgatggacgaggggacacggctggtgggatcggggttccccctcccactgcccctccctcctttttatttaagtgaataaattttaagtattctcctccccccctgcccctgcagtaaagtgctttggcccccca

SEQ ID NO: 605389 - DNA, 155 bp, Homo sapiens
gcttcaagatctctgttacaacaccactttcctgtgtggataacataaaggtctttggaactcatctcatgcaagacatggtgaaagatgcacttcgcgtcttttgtcagatcctccgtttgactttccccctaagtgctacctcatataaataa

SEQ ID NO: 605390 - DNA, 268 bp, Homo sapiens
agctttatactaactgtctctagtatctttaatgtcttcacatcttcgaagacaatcctctagtatctgaacatcgctggcccatgtttaattccttatctcccaatactgaattcctggaggtatactgcttccacaatagaatccacgtaaaggctttattacgcaggagctttacggatctaggatcagaaacgtgccaatacaaaaataccaatatagcttttcctccggttggttatccacatcttctgaccattaataatat

SEQ ID NO: 605391 - DNA, 575 bp, Homo sapiens
ttttctacagtggttttatactgaaggaaaaacacaagcaagaaagaagaaaaagcatctatctcatctatctcaaagcagatttttacacacgaccatgtgccagggtacgggggaaaacggaagtggcttaagaacaaagagggctgcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgccccgtcccccccctgcccagccgggtgagtccattctcccaggtaccagctgcgcttgcttaactgtataatatatagacaagagatcggaatgaggtgagaggtggaagaagggagaagaaaggtggtttagctgccttactagctttaaaccc

SEQ ID NO: 605392 - DNA, 267 bp, Homo sapiens
aaaaaaaatggacagactgtgacagaccattcccatcggccaagatggtcgaacccgacatccaagaacccagcgagcagccaagctcagcgcaacctccgggcttctcagctctgactccaataagggtgagcacgtcgccctcgcgccacggggcctttttacatttgcggattgatggactcggctcgttgtcgtccattgaatttccgacgccgcaccttgcgttgtactggtcccttgagtaaccgagtcctgtgcccagga

SEQ ID NO: 605393 - DNA, 1055 bp, Homo sapiens
tcctcccaagtagctgggactacaggcacgtaccaccacacccgtctctactaaaaatacaaaaaaattagctgggcgtgatgatgtgcgcctgtcgtcctgtctactagggagactgaggcaggagaatcgtctctgcctcccaggttcaagcaattttcctgcctcggcagagacggggtttcaccatgctggccaggctggtctcgaacccctgacctcaagctgatcagcccacctcagcttcccaaagtgctgggattacaggtgtgatccactgcacccggccggcattatgatcttagtgtactcttgaaatggttatctacgatggatgataagacaccattaacgctcgaacccgcacctcatgaataactggcactctcacacacgtagtaggtgacttaaaatttcaatagaactcacacctgcagcacaccacagtccaacactcgaacctcatacgagtaccaacttaacagcaatggaccaataaagacactacaaaatgtacagtatgcaacctacatctgcacctcacaactactacacctaaacgcgaaacagccagaacatctatatccccaccccacccaccaatactcgactcacatctagcctaataccacatactacacctcaccacatcttgcctaccacgtctacactcacttcgccaatcgaagaccccagaacgcaccgtcgcgaacacacacgcacaacagaacaggggcccaggacacactgacggggcacccacacgccccagcacgcgacggctcggcgtcccgcaggacagcgcgcaaccgacgtccgacgggcgggcgcccctctcgcccgccaagccatgctctgggagccttggatcacacaaggtgaacagcccttggccgctgcttcacacgggaaccatcgtccgacgcaaaacgcgccatatcgcccgcctgataggcgacccgacccggcacctgcaaaccggcgagtcacaccatgcagataacgtacaaaggagaaatagccgaaagcacaccgagcaaacaccacgttcaaga

SEQ ID NO: 605394 - DNA, 146 bp, Homo sapiens
cgcaagtgtttagtcacaattcacgcatggcattagttggttttctttagaatctagaagagtctccatcctgcctccttttttttttggtttaaatgattttaatgacattaacactttcaggagttcaggacagttatggtatg

SEQ ID NO: 605395 - DNA, 244 bp, Homo sapiens
aggcagaggatccctcacgcttaacttccttcttctttcttcctcttcttcctcttttcttcttctttctttttcttcttcttcctgattcttcttcctctttctccatctttttctttcttgctttccttctacgtttgttcttcttcttctttcctctttcttcttcttccttctcctcctttcttcttcttattcttctccttctccttctttttcttcttcgacttacctacgtgttgag

SEQ ID NO: 605396 - DNA, 428 bp, Homo sapiens
tgctatgactaacgcctttaatcgcaggattgagacaggccgaggtatgcgaaccacaaggccaggagagcaagaccatcctcaccagcatggcgaaactctggctctactagaactacaggcgctggacgtactggagcatgcatgacagcccagatactcacaagactgtgctggacacagcatttgaacccaagagcagtgggatggacggagctgagatcgagccattgcacataagcctggacgaaagagcatagactctgcctacgataggaccaagtcttggcttgaatagttctgccaagcatgtttcctgcagagtaacacctgcaatgccagctctatgaaaggccgaggcagacatgctacttgcgttcacaggctcaggaccaggccgactaccatggagactgcatgtctcttct

SEQ ID NO: 605397 - DNA, 870 bp, Homo sapiens
  misc_feature (1)..(1): n is a, c, g, or t
  misc_feature (6)..(6): n is a, c, g, or t
nttganatcctagggttgatacactgtcgactgcgaggaatgtcctagttgcaatttcgaggatgcccctggactgtccccgagactgacggatgacccttctggaacctgcaaagccaagatacagccagcatagccttcactggatacctagccctgggagtccattgacactgcgactgcacacccgaactgcattagccaactctatatctacgaactactgcggtgattactgccaacaacacagtcttgtgagcaagcaacgaacggcttgctataacgcggcctcagcttaggagaccgcagattctttgaacgcgaccggtcttagtgctcctaccataaccaatggcactccgccagatgggagacacacgatgcagcccggacaggaacccttgtcagacaggctcacccactgtgcacagagatggctagttcaaaaacgacaccctctcgtttgttagcacttacaagttaccttttgatgtccagggtggacacggtttaaacattcctgatcccgggtttcttttccacgcggaaaatcttttactgcccccacagggaaggggcgtaattcctcccgaattgggaaccagccttcaataggactgcgtggcaacccgaaaccagcttttagacccgggccccgctttccgccggcttcgatccgggggaagacggatcccattttgttccttgtttaacaacccggctgaattcaatccgagggcgccggaattgcattactaaggcttggccccggaattttttcttgggggccgggcaacccgctgacctggccacgggtgtataattgccaatttccttccaaagtgtcattacgcccctttggcatttttg

SEQ ID NO: 605398 - DNA, 1349 bp, Homo sapiens
ggacgcgtgggtcgaccacgcgtcggctactggaattcgacaaggacatggatcaggtgcctccagctaaccaggaagcttgagagtagccagcccaggcacggcgcaggtgtaacgaggagcccgagaaagtcatgaagaggacagaacgcaagaaggccacccaagcgagagcctacaagatagcttcctcttggagctcgaaatcccgctccttctttccctgtcgagcatctctgacacaaggatatgcccagcatgcactccatgcggaggtgtgacagggacgatcctgcatggacacaaacgcaagacctatccaacgagcgacagaggactacagccctgacgggacaccatcatggagacgcaaacattgaaaccatgcagctggtgcgaaacaaatccagcagtcccagatggcagcaagcatcatcttaccaaggaagtccagagaatccaaaggcaacacagcatgtcttggcagacaagcatccaaatatcatttcttcatacaccaacaattggtgaaaaaaagacatgggagattaatcccatataatagtagatgactgatagggagtaacacaataactacaatagattgattatggtagaataccaaaatagagggatgattaataacaacaggagttaaaaaatggagatggaaagattggtcaccatcgaatgatacataaacgaacacagtagaaccagagagaacacacgaacgccaaagggacaattcacccgatagggcaagacacagacaaacccaaacatgtgcaggaaataaaaacacgggaatgacactgaaaggcacaacacacaagccacacacatacatgcatcggacacaatagacgcagaccaccaacaaggaatcaaacaacccaaaccacggaagaagataacaccagtggacaaagtgacgcaacaatgcacgaaggaaccaccaacggacgccagagcacaaaagcagcacaccagcacaaagggagaaagtgatgagcggacaaacccacacaacaaaagaaccaaaaaaagcggacagcaaaaaaaacaacaacaagaaacagaaagaccaaacaacaggagaagagaccgagagaaagatacaagaagagacagaacaaaggggaggaacgcaccgggaaggggggacgaacacgcacagcaagacacaagggacagacgaggcaagacgagcgggagaagagcggcgcgccacgacccgagaaacaagagccgaagagaagaacagaccacgggaaaggagctcacaggacaaaaaccagcacacggacaaaagagaccgagagagcaaagacgcaaacaaacggagg

SEQ ID NO: 605399 - DNA, 234 bp, Homo sapiens
gcttcggcattcatgtgtatcagctcttcggttcctggcatttcatgatattcactgtgctgggttggggtacgtgtacccgtgttctaccagcctgtgggaccaaagcagtatccttacaattatctgtacctggaacgaggtgttaatccctccaaagaaccagagcgggtggttcacttatcagatctgaggaggcttcgtgggctgttgtgtcctgtgttacgtctaggt

SEQ ID NO: 605400 - DNA, 700 bp, Homo sapiens
  misc_feature (244)..(244): n is a, c, g, or t
gggtggtagcgctgggggtgattttaggcagcaagaattggagaactcacgctgcgaaaagaaaacctcgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccanctcacttgccaaaactctggagtggctgctgactagaaattgatctgtataaatgaccttgaaaatggacttctgaccagttgcggtggctcacacctgtaatcccaacactttgtgaggcctacgcacgcacatcactacgtcatgagttctataccagccttgccaacatggcaagaccctgtctctactaaaaatacaaaaattagctagtcatggtggcacatgcctataatgccaactacttggcaggctgacgtatgaaaattgcttgaaccttggatgtggacgttgcaattaacctacatcactccactgcattccatccttgtcaacagatctagactgcttcttactataaatatataaaaactcaggtggtccccttaccaattctcgcttatattattctgatacaattcacttgccttccctttacaccttgttaattgccac

SEQ ID NO: 605401 - DNA, 638 bp, Homo sapiens
  misc_feature (52)..(52): n is a, c, g, or t
ccccttcgcccaatttgtaattgtagttttccggagacggagttttgcttcntttgcccaggctggagggcagactcccccttaaaaaaattaaataaaataaaattaacctccaaaagtgagttcaggatttgtttgcaattcttaatttttttcccacccaccccaagctaaggacatatagttgaatctggggttcataaatttggcctcccttctttcttaatttctttcttttttatcccctttcggtatggatataggattcattttactttaaaattaactttatcaatgagaacacatggacacacggaagggaacataacacacaggggcctgttgaggcttggggggttaggggcgggatagcattaggtgaaatacctaatgtaggtgatagttgatgggtgcagcaaaccaccatggtacatgttttcctatgtaacaaacccgtacattttgcacatgttttccagaacttaaagtgtttttattaaaaaatatggaaaaaaaaatgaattaggtcaattgtttgtttacaattttagggccctgtcccagagaattatttttattaaacggttgaaaatgttggaaataaaaaggtttcaaaagttgaaactattccaagaaag

SEQ ID NO: 605402 - DNA, 150 bp, Homo sapiens
acataccaaggccaccacacaccagccgtgatccaaaaatggcccttcgcatacgcagcataaatccctattcaattaaccctcagtaggatctgttttctgtcgccagagtgtatttaactgagcccttttgaacccacctccagccgt

SEQ ID NO: 605403 - DNA, 380 bp, Homo sapiens
  misc_feature (25)..(25): n is a, c, g, or t
  misc_feature (29)..(30): n is a, c, g, or t
gcacagagcgagctcttgcagcctncccnnccctcccgcaacgctcgaccccaggattcccccggctcgcctgcccgccatggccgacaaggaagcagccttcgacggccggagtcgaagaaccgagttatcaacgggggaatacaaaatattggaaaaggaccacccctttctttaatgatttgggtgatgcccatggctctggagtggcccacctaaacttcccatgggcttccgagtagtacccagcccagagggaagagattagagcatacagcgtctgctcgggggacacacatatcgtatgcacaccactatcgtcgttagagccagtgctgcagctccatgatgatgatgcatgcagtatgatgcgtcactac

SEQ ID NO: 605404 - DNA, 358 bp, Homo sapiens
cccccccggggggggggggaaaacccccccgggggggggcccccctaatcctggcctttttttccaggggcaatttttggggcccgggggtccccctggggggtttttttgagttgggggcccctcccccccccccggggttttttttgggccaggggggttttttttttttaaaggccgccttttttaaccccccccctttttgggccccgggggaattaaaaaagtttttcctccgggggggggggggggtttttttttcccccaggttttggtttcccctttcccccggggggggaaaaaaaagcaaagggccccccccttttgcccccttgttaaaaaatttccccccccccca

SEQ ID NO: 605405 - DNA, 174 bp, Homo sapiens
  misc_feature (94)..(94): n is a, c, g, or t
  misc_feature (98)..(98): n is a, c, g, or t
  misc_feature (133)..(133): n is a, c, g, or t
agaaaagcgaccgctggcttcctggtagagggcggcatgctcgaagggtctgctgggtgtggattggatgctgcggtgtggaggttggaagctntgtntggcccacttgggcacccacgcttctgtccacttntggttgccaggagacagcaagcaaagccagcggtcgcttta

SEQ ID NO: 605406 - DNA, 187 bp, Homo sapiens
ataagactcccttagatccccacttagatcaccaccctttttcagggggtaataaagtcatcttccttggaatgtagcaatctataaccaatcaaagccctgtaacatatgccctggtcttgtatggaaaatgttgtaatcctgctaaaattcctctctctttgcctgtggaagtgaaaccttaact

SEQ ID NO: 605407 - DNA, 297 bp, Homo sapiens
tatagaccatttcctgggtcctaaaacccctctccataaatgtaaaacaattaatgttatataaagtatgtgctctgaccacaaaggaattagtagatcaatataaagaatacatctttgacgagaatctcaccatattgaacaactaaataactcacttctaagtaactcctgtatcaaaggagacattacagaggtatttagaatgtactttgtatttaggtgtcaaaagatccagattcatgggataacactaacactaagcacatttataggcagcactcacatgtatctgga

SEQ ID NO: 605408 - DNA, 758 bp, Homo sapiens
gagagagagagtgagagagagagagagagagagagagagagagagagagagagagagagagagagagagagagagagagacagttagcgcctcctcctctctttctctctctttctctctttctctctttccgtctctccctctccctttctctctctctctcttcctctctccttctccctcctccccctccttccctctctctctcctccctctcctccttcttccctttctttctttctccctcttctctcttgttcctttcctctctctccccctcttcctttttcttccctcccttcctcttctcccctcctcccctctctctcctctctcccttctctctctctcctcctctcctctccttcctttcttttctctctctctctttcccctttctctccctcttttccttcccttctccctcttctctctcttcctctctctctctctctcttcctcccctccctccttcctctcctcccttactcctcccctcgttccctccctctctcttcttctctcctctccccctcctcttctctttccctcccttctctctcctcctctctctccccttctctctttctgcgtcctccctcccccctccttccctctcttttctctctctcccttcttcttctctctttctcctccccctcccttctctcctcccttcctccttcccttcctctcctcctcccttccctcctctctcccctctcactctccttctctctcttctcctctttccctcc

SEQ ID NO: 605409 - DNA, 194 bp, Homo sapiens
cagtctcgatgttgaggaacatctttttagagctgcaaaggaacgattatgattcagggtgacagaatgctaactgcagagtcaataggcaaattgaattcataagcagaatggagtatggtgttcagtatccagtggccagctcctcaagggcatgactgtggaccacattacttctgcttggtcttctgctg

SEQ ID NO: 605410 - DNA, 659 bp, Homo sapiens
gagaccttccctcgctgtgcatggaccagtggctgactctggagcacaggctgttgcttcccggtctggtgatgaatcctccatagtttggcatctcccgcacagaacagcatggtggcgggtgcctgtaatcccagctattcaggaggcttgaggcaggagaatcgcttgaacctgggaggcagaggttgcagtgagcagagactgcatcagagcagcctgggtgacagagtaagattctgtgaacagaaccagtgaagaaacacaagagaacagaagagaagaaccaaaaaattctaaaatttatgtggagtcacaaaacacccgaatagccaaagctatcttacgcaaaaagaacaaaactgggggaatcacattaccggatttccaattatactggagagctatagtaaccaaaacagcatggtattggcataaaaacacacatatagaccaatggaacagaatagagaacccagaaacaaaatccaacacctacagtgaagtcattttccacaaaggtgccaagaacgtacactgagcgacaagacagtctcttcaataaatggtgctgggaaaactgaatatccataatgcagacgaatgaaagtagacccctaacttctcaccagagaaccaccgcacttcttcaacaacat

SEQ ID NO: 605411 - DNA, 171 bp, Homo sapiens
gaaccagaagccatatcccaagttccatagacctcattatcttcagatcaatagaagcagaatcaaaatgcattctggagctttgaggtcaattgatttggaaaccactccggtgcaaagaatctctagattcatagattttggagtattgtttgaggggaaaagaccctg

SEQ ID NO: 605412 - DNA, 150 bp, Homo sapiens
gacatctatagactgggctccatttgtaaattctaatattaatttagttaattatatgccttgcaagtatcttttcccagccctagtttattttttgatttatattataggtgttttttgttggaccttaatttttaattttaaggtagt

SEQ ID NO: 605413 - DNA, 313 bp, Homo sapiens
atgcctctctgtatgggggcaggggtcttcctgcgagacacggagcggaggcgggtcttccaggctctagccaggatccacgagatctgctataacagcaccatcctctgggacgtgacggtgagggatctgctgccctcctctgctatgataaaagacttgagccaaggagcttgggatgcccctttcgcaagaagaactcacagatgagaaacggtttgccctatcacctcagcctgcccccaatcttgaggactaccagagtcggaactctaccctcagcttagagatccacgccccacagagagagcgt

SEQ ID NO: 605414 - DNA, 172 bp, Homo sapiens
agtgctgttatctgctgaatacttggagcttcccagatgaaaatgatacacgtgtacttctgcccagattgcaactttccatactaagcacttctgaaatgattcttggccctaaactatcacttacttcagactgaatgtcactgctgtatcacaaaacactgcagcaagt

SEQ ID NO: 605415 - DNA, 353 bp, Homo sapiens
tgagatggaatgtctacccagactggtaaccagtcactaccatccctgtgcagagcctgggcagccgtctttgttgcagtcctaacctcaggacatctttggagatggggtctgtctttaaggcagtaattaaattaagctggatcattagaatgggtccttactcaatatgactgatgtcctgctaagaagagactacgacacaggtgcatgcaaagggaacaccttgtgaagacacagcgagaaggtggtcacttacaagccgaagaggaaggtcttagaagaaaccaacccagcagacaccttgaccttagacctcttttttgtgagaaaataaatttctgttgcttaaa

SEQ ID NO: 605416 - DNA, 1267 bp, Homo sapiens
ggtggtggctggtgccgtggaaatggaagggctcaggagagagctgggacttcagtgcgagctgccgacggctagctaccgatgaagcatatatgaccttctacagatgaggtcgaagcatcattaggagcataagaacgagactcagggatatcatatagtatcgtacacaagagtccagattgcatatgattggactccgtgcactgattccgtgcttaactttcaatagtttgaactcctagtattgggaggattcttctatgatagaatccgtgatagttgagcagatgaaggaaatagacaaagagcaggctttcaggcaagttagtccactacttggctcgcatcctggacgacatacatcagacgatgagtgcctagacacgaggcatcgaagaagcgctttttgaacgcctgatggaccaaataggcttacgaagcttgcctacctcgggactcacgcgatgcacacaacgaacgacgcggccactgggattgctatagttgcatgcgccagagacaacacgcacactcacgctgggatagcagcagatgctcgcacaaagatgccgtaaaacatagacacacctctaaccgcaccacgggaaaacgcggaacacacagcgcacaagccacagctctggccacgcaggcggcaagcggacgtggacctccccttgaaaccaccgcgggccaccacaacacgctgcactcgcctcgccagcgtagcgtaccacgcatcgctgcgaccgcaggtcaaccaagctcgttactatccccgggccacggcacggcgcgcggagcaaccacacctccctaccacccacacctgacgggtcaccgccaggcgcaacagcacgcgtcacgtgcccacacggcgccaccatacagcggtcacccgcaccctagtccacaccctgctgcagcaacacaccgcggtcacccaaaacacccgtctcaggcccacccgagccaacccgaggggccaaccaatgaagcacagccagacacgctgcgatcccacggaccgcgcggtctggtcgccaaccggcccacaccgacgagcaccacggagcgcccgctatcagccacgccgaaggtcggtgaacacgcaacccccaccacgccaacggccaccggtgccccaccagggcaacacaccccgacaggccgcgcgcaaaccggacaacacgcggtgcgacaacacttgggcctgtctcgccaccagcgacggcacccggcccacctcgcgacggcaccttcg

SEQ ID NO: 605417 - DNA, 166 bp, Homo sapiens
acccctggttggcgcagcttgaggagttcctgaaccagagccgcccttctacttctggatgaatggtgaccgcatcgactccctcgctgagaacgaccgtgcagcagacgcgtgtgttgaacttcatgcaggtctgtttcaggcagggcttacactcttcccaggt

SEQ ID NO: 605418 - DNA, 153 bp, Homo sapiens
gtgtcagccgcgcagggggaggacgatgaagaagctgtaagggaaagaagctcacagaacctctacttctgccttgctttcaggatccaagcccagcacttgggtgtcttgcccaggtgaggaagagaatcaagccacgaagggggatggaca

SEQ ID NO: 605419 - DNA, 346 bp, Homo sapiens
gggcacggccggattagctgcggcggcggaattaacgtggacgtgaaccagcactcggaagggggtccaggaggcaaggctctaggctcggactgtggcggctcttccagctcaagctcgggttcgggccccagcgcgcccacctcgtcgtcggttttgggctccggtctggtggccccggtatctccctacaaaccgggccagacagtgttccctctaccccctgcgggcatgacctacccaggcagcctggctggggcctacgctggctacccgccccagttcttgccacacggtgtggcactcgaccccactaaacctggcagcctggtaggggctcagctgg

SEQ ID NO: 605420 - DNA, 81 bp, Homo sapiens
ctattatttaaagggtgacttacatttggaaacaacatattacgtataaattttgaaaattggaataaattgattcatttt

SEQ ID NO: 605421 - DNA, 470 bp, Homo sapiens
tgtgtgtgtacgaaagagagatcccgtcatgacacccaagattcaagtaggagcatattgcaaccgagaattgtacacagtgctcctggaagaagagtccatccgtgtttatccaagaaatcagaccacgtgctcaaacacgctcagaccaggtccaaccaggccccaaggagatgcgaggtaggatcagggccatcacctcaggaatactttgccccttccacctccacccagtgtgtgcaagtaacctaccagacctagattgtacagaagtgaaagatttgtaggatacttacccattcattagaatgagagatattttactgggagcagtgcttttctccatgagttctgaagggcacctccatccaattcctctatcctcagaggttctcacttctatttggccaaataaggaaaacatgtggatgtctcagtatatgcttctctttttcagaaattgcatttaa

SEQ ID NO: 605422 - DNA, 437 bp, Homo sapiens
ccgcctgcagagagcctatgaatggacatgcagtcagggaggtttcacataaccaagattcctatcccagaaaagcagatgtccatagctctgggaatggaatgcgacccttgtggacagcttacaaatgaccttaaatccctcactaacctaccaacactctcactaaacttaataataaatgctggtatatccagtgcattggtagcatcgcaggaccagaaggcagtgacccctctggacccagttttctctatcttgtgtgtgtcttttatttctcaacctgccgatctgcctgggaacaaagaaagagccctgttgcattgcaagctgctggccagatcccgcaatatagtcccagctacttgggatgctgaagcatctgtagagggagagctgcccctaatcataaatcaaaaataaaagccaattacatc

SEQ ID NO: 605423 - DNA, 563 bp, Homo sapiens
gcacgaggtttactcagaccataggcggcctacccaaattgatccggcgccacctgccaagctccctgggtctttagcccgactttctcattccaggtactggcacttgtcacagcatggaactacagccgcttgggatatagagggcatgttatggtggtcagcggcttttcaggctactggagctttcaacggtggttgaacgacctcccctgggaccaacatgaggcactagcacaacccaatctcccgcactctgggactaagtgtccgtgaccagggctgggtgtctagatctatgctagatttaagaccattagcctgagaatgcgtcttcaccgggtagcacccattgcttgatcagtcgcaataatcaccacattgcgaagtgtgagctccagtcaaagtgaccctggaacccttgggagacactgctgactcctcgatctctgggaatgggggacgtatcagggtccaagagcaccttcacttcatgagttctttggaccacctggaatgccatggtgaaatcccatggggtttcccaaagccgaacaataata

SEQ ID NO: 605424 - DNA, 479 bp, Homo sapiens
tgtaatccggctaaggtaggtaattccgggatcagctgggtcctctaagggctggttcaaggtccggctaacaagtctagagtagctataatcctagggctagtttagacatgagtaatggatccatattaagatattaacaagggcagcacctcacttccaggtggtaattacatggcagcataacaaatatatcccagaccatagaagcttaaaacaggcagagatataatataatctgacaaggtcgggggaaaaggaaccggggcacaaatttcccgggttctcggttcctcctaaaggcggtattccaagggtctatcaaagctctagccattccaaagatggcaaggtgagaggatcctctttccagaatgatccaggggtccataacaagattaagtggctaatgcagtggtggtgggcgggaatactccctcgagggtctggcaaaagggtcctctccatatggcagttca

SEQ ID NO: 605425 - DNA, 643 bp, Homo sapiens
  misc_feature (228)..(228): n is a, c, g, or t
gctggggatggatgagatgctcagaccggggtgctctcagggatgggagaacaccccagctcacagggtggcacccagcaaagctggctgggagatgggaggagctcagtgtcagcctgtggcagcgtggggagtgcggctgagtggggacgttgtccagaaggcatgtatgtgtgttgccctgtgtagaaaagccatgctgtgttgtgtgtcttgacctgtgtcccnctcctgtgcccccatgtgcagcccagtgcacagcctcctcccagtgctcatgtgccctgcctctggcccatgagtggtaactgtggtgcagtggcatgttgttgtgcatgtggccaatgtgggaatctctttgcactgtgtgtgtgagttgtgtgttgggaagccacagcctgggaatgtgatgcttgggaaagacctgagggcgtcatgcacgtcgcctctttgtggcgtgcgttgggaccgttgggatggtgtcgactccaccgtccaccccgagaccatcagtcagggttccatatttatgaaaagtacgggggtacaaggaggtcatcctccttgccacacggtcaatataacccaatgagtttgggaaacagcaacagataagggcttttgaaaagaccacgaggacccc

SEQ ID NO: 605426 - DNA, 138 bp, Homo sapiens
gtatcgtgtacatagatcgatttcaatagatatttcgtgtcacgagtggtggatatctttgtattgtccattgttcaaattctttagtcgtaggcttgttgcagggaattgcagtacccttgcttggatgtttttgtt

SEQ ID NO: 605427 - DNA, 287 bp, Homo sapiens
tgaagcatatcctccacaaagcctctatcagtaatcaaagtgatattttgggtttctgcttgtcttactccttgcttccttttaaacagttataacttatattggaaacagcagttattaagtcttgttaaggtatggtcatatgctggaataatagaaatctagttctgctcttttcaaacatttaggttgatagttattttacgttggtctaaagaagccagtaaatagtacccctctttcctacgtgagtgtgacaaactgagaagcaagcaaggagtaagaca

SEQ ID NO: 605428 - DNA, 184 bp, Homo sapiens
atattgcccagcaacaaagttggcaatcaccatcatgcaacatcagttggccgtgtcacattcaggcagcacattttcatcatgcacacaaatcaagtcattcctccaacaacagtcagcaatccatagtcccagcacattccagcacatgcgtccaccacagtgtggcaagcagcgccaccac

SEQ ID NO: 605429 - DNA, 183 bp, Homo sapiens
caaccgagctcgtacccctaattggttcttcgatgacgcagcctccagagtagctgggaccacaggcgcatgccaccacacccactaatttttgcctttttatttttatttttttggtagagacagggtttcgtcatgtttgccaggctggtcttgaactcctgagctcaagcagtcctcacg

SEQ ID NO: 605430 - DNA, 482 bp, Homo sapiens
aagcgtttagtatacgaggagctattttagttattctgtaaacgctccaccttacatgccacgtctgtgtgagatcaacagggatcaggttaggtcaccacacatgtactgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatactaaaactttttgggcatctattttgaaaactataggagcctttggaaggccttctatgtttggaggggaagggtgttgagattgtcaccatccttcaagctgagactcctggtgagcctttgccaccatgaaaaccacatagctgaccagggctgtgcttgaggtacagaggacacacatcgtaaacaggcctgtgtcatgtttccttacagtcgttg

SEQ ID NO: 605431 - DNA, 930 bp, Homo sapiens
  misc_feature (22)..(22): n is a, c, g, or t
  misc_feature (62)..(62): n is a, c, g, or t
  misc_feature (275)..(276): n is a, c, g, or t
  misc_feature (278)..(278): n is a, c, g, or t
  misc_feature (286)..(286): n is a, c, g, or t
  misc_feature (289)..(289): n is a, c, g, or t
  misc_feature (291)..(293): n is a, c, g, or t
  misc_feature (297)..(297): n is a, c, g, or t
  misc_feature (304)..(305): n is a, c, g, or t
  misc_feature (307)..(308): n is a, c, g, or t
  misc_feature (313)..(313): n is a, c, g, or t
  misc_feature (327)..(328): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (346)..(346): n is a, c, g, or t
  misc_feature (349)..(349): n is a, c, g, or t
  misc_feature (368)..(368): n is a, c, g, or t
  misc_feature (377)..(377): n is a, c, g, or t
  misc_feature (516)..(516): n is a, c, g, or t
  misc_feature (622)..(623): n is a, c, g, or t
  misc_feature (703)..(703): n is a, c, g, or t
  misc_feature (808)..(808): n is a, c, g, or t
  misc_feature (862)..(863): n is a, c, g, or t
  misc_feature (890)..(890): n is a, c, g, or t
ttgataagaaagcaattatttnaaaaagtttaatacaaatacatgttaagtgtacaaatcangattcttttgggcaaacaagttgttatctaaagaagaagcaaaacctccttaacagttgtaataaaacctatgcctgaaaagttggtggctattacacggaaatatttatattgtgttcttctactcccaataactacttttaaagaatcaggataacttaaatagaatatcaaaatataaattataaataattataaaaatatatctgtccnncncccctatnggngnnncgtnggtgcannanngcctnaatatggggctatnnatncngcnaaatattcanganctatgttatctcaattttngaaaagggnacttttctgaagagaaatgtttgaagttaaggtactaagatttcactaatttcacacattggtattaccaacaaattgcgattaaacagaaatcactcttttagacaaaaatatttcccgataatatgaaaaaactggngtttccaaattacaaaaatgttgaaacagaaaggtcagaaaaaacaatgtgaaattaagaaagtatttttgagggtttctttttcacatagctccgcccccccccnncgcgcaatcctgcacaggcatgtttttttgtgtgcgtccagtgtggtcataattcctgtatgaagtgctgaataaagatngacacagctttctgttgaaacagcatttcttccactccctctcaactttgtagatagttgatgaaggtgagcctttgttcttgtagagcctcatgaatctctctntcagttccatgaaggtgggcttcacacatgagttatttgctaaagctaatcacnnatgagaatggcccacaggaggtacggnacacaggctggtcttccagccttcttgattccaggagaca

SEQ ID NO: 605432 - DNA, 80 bp, Homo sapiens
ttctggtcccccactgtgcccagctctgactgggaccccaatggtggctgctatgtaaattaaatctctccccgctgtac

SEQ ID NO: 605433 - DNA, 422 bp, Homo sapiens
  misc_feature (400)..(400): n is a, c, g, or t
  misc_feature (406)..(406): n is a, c, g, or t
ggaaacttgacccttaaaagctcccatccctgggacttttatataaagttttcttctcctttctgccaagctcgcttgggtggcggtcaccctgccattatctccctgaagcagaaggggttgaggaggagccacagggctgtccctggcagtctcaccaaagccctgagctgtgcagataaaccagtgtctgcaggtagagggatggagagaaagcttccctgctgtctactctgaaggttctctgcaaagaactaagggtagacagttcaaaaagaggcaagcaataacaaacttattaacgtgtacagggcaaaggaattccacaaatatggagactcaaagaaggtcttcgaaatgtagctttcgatgtggccacatgttggggaaaactttgganggcttnttgctgccggacttgg

SEQ ID NO: 605434 - DNA, 970 bp, Homo sapiens
ctgggtaactttgtttccaaggccgggccccttcagcgtagtttctcttcggcggttatctatgggtgtccggcgcgaatatgtgttggctgatacttcttcatcccccgttctattatgcccctgacgcttatacacatcttgcctgccttagccgtagctggttaccgctggggcagtgcatcgcgcgttggggttttctttgtcgatcattcttcacttggtactttcttttggcgttccacaggatgacttcctgcttgtatctgggtgccctctacttagctgtccagcccactgtgtgatgtcagctaggtccgacgttccccggtgggagtccttccgctgcttgcacctcgcctccagcatagagtcggcctgttgcctgagatggagcccaagctgtactgtgggcttactatgactggagacaggaaggagtttgagacactctgttcagagctgtgaccagggtcactcatgctcctcctctgccacagaagcggtaccccaatgttacaccctggccagagggcccatgctaatggaccacagcctggacgacctctgctcccagcgtcagcccagcccatcatctccggctccctcgcacagggcggctcctcagggccaaacgccccagctgctgaggactttgtgtttttataaagggaggggatgaggggtaaagatacaacactatttattttttatgatttactgtcatgtcgcggtgtgggatcttgagctctggcaatgctgagtgatggtacgttcctgttgtcagccccgtcaagcccagcgcgaaccagtccggcggccattcagccagggacagagcccacagagcccatacacctgtctcccaccagccggggccctcctggcagggtagggaaggaggaccccgggcacccccctcagggcctgacatcacgtactgctagtcttgcactgacgccataccccc

SEQ ID NO: 605435 - DNA, 289 bp, Homo sapiens
gataacttggcctccaggagtcacggagggcgtcacagaggaggtggcatctgagggcattttggggaacttgttcagcaggtggaaaagaatgggagggctcagcttcagctctaccactccatgggtttgttctaattttcttctttgccttcattcttctctgcctcccatttgctcctctggctgctcagttgttctccctgaagccctacagagaaaaggcatttggaaaaaacaccctaaagctgttatatgctccgcatcccattgcctccctgcaccccgt

SEQ ID NO: 605436 - DNA, 84 bp, Homo sapiens
aaagcagttccaaaagttttgaggttggacatgggcccgctccccccaatgaaataaagtttttttttccttcccaaaaaaaaa

SEQ ID NO: 605437 - DNA, 345 bp, Homo sapiens
gtaaaccccgcgggctgattccagagcctcacgctctgattttgtgcccaggtacctcttctgtcggccctgctcgggccaccctgaccgctcactctcaggtgtgctgggagctgcgctgcgtgctcctgccaggagtagcgggcatctcagcctcgacagtcgccaagtggaccatcgatgaggcggacattgtgaagatcatgagcgtcaagctgggcccagccttgaagatctataacgccattctcatgttcaaaaacgctgatgacaccttaaagtgactggcccagggctgtgccctcctgcagcccctgcttggcctccatctccagctgatgcttt

SEQ ID NO: 605438 - DNA, 174 bp, Homo sapiens
gctctctgaggctcatttgcagttgttgaattgtcccgcagttttcaatcatgctgaccatcagagtccttgtgactgagcagctgtcaaattgcatatcactgctgtacagattggaatggatctgtcttggtaaagtcagcctatattctcgtctgtggatatcaccccata

SEQ ID NO: 605439 - DNA, 270 bp, Homo sapiens
ggtacttttcacccttccctcacggtactcatccactatcggtcaccaaggagtatttaggcttgacgggtggtcccgccagattcacgcgaaattccacgagtcccacgctactcggggcaaccccacaccagtgccacgcttacagttacaggactctcacccactccggtacgccttcccagacgcttcaccttcacgcaacatttctcactggccaatcctgcggcagcagaaccacaaggcccccacaaccccgcacatgcaaca

SEQ ID NO: 605440 - DNA, 420 bp, Homo sapiens
aaagcacatgggctgggtgcggtggttcacgcctgtaatcccagcactttgggaggctgaggtgggagcatcacttaaggccagggcagcctggggacatgacaaaaccctatctctacaaaaacaaaaagcagggccgggcgcagtggctcaacgcctgtaatcccagcacttctgggatgctgaggcgggcggatcacctgaggtcaggagttcgagaccagcttggccaacatagtgaaactccatctctactgaaaatacaaaaaaaactagccaggcatggtggtgggcgcctgtaatcccagctactcaggaggctggggcaggagaatcgcttgaacctgggaggtggaggttgcagttgccgagattgtgccatgcactctagcctgggcgacaagagtgagacttcctctc

SEQ ID NO: 605441 - DNA, 165 bp, Homo sapiens
  misc_feature (161)..(161): n is a, c, g, or t
agtgacattcgttctgcgcctctcttcatgattgtcatgagtgattcgtgtcacttctcttaggatttagtctaacttgttcacatgtctcgtagagtatgacgtctttcaggacattttatttcctcgcaaaggaagaactcttttctttgtgtgctacnaatg

SEQ ID NO: 605442 - DNA, 583 bp, Homo sapiens
gatttgacacatgaatgtatagcagtcatgggaaactccacagctcatgttttcctcatagtagatgtgtgctcccatctccatggcttgtccctcacaacccccaacccatggtaagtcaggccagtgtcctcccagctgcagagctgagaaggctgcagcagttgcctactgagaacctgcctagtgggtcagagcaaagtgagaacgggcctgtgcccacccaccagtgtgactgtcagcccaagctcttggggatgtagtggaaagtcatggtggatacggtgaggagagatggagccgaggggtgctggcaaacagaggtcacgagatgtgcggtcaagggctcgtcgggcctatgaaggcaacagcaatgacatccgcgtggctggcaacagggaggtgagtgatgactccaaaccggactcagggagcaccagagaggtaggagggtgacgacgaggggtcagcgcaacaacagcctgacctaggtccactgaggacaacaatcggggcaaccaaggagcgcacatggcccacatcccggcagagcccgccaagaccacatcatgaggaccatcga

SEQ ID NO: 605443 - DNA, 205 bp, Homo sapiens
aatagtcaaaagaatcgatacaaaaaaactcctggctaggtgcagtggctcatgcctgtggctcccagactactcgtggaggctcagtgtggaagcgatagctatgagtgtgaggagtgttgaggcttgcagcgatgccatgatccttgccacggtgtactctagccttggcatgaccagacattgagacgctgacttgaggatg

SEQ ID NO: 605444 - DNA, 1083 bp, Homo sapiens
  misc_feature (13)..(13): n is a, c, g, or t
ttctgttcttccncttgtacatgtgtctttctttttcttcctatcacttctcgcgctccttcccgccgctgcgaggtgtgggtagttactgcctcgtccgggacccccttgtgtgcctcaggacccgggcctcccctcgtgttcttcctgctcggggcgatactttttccccgggcccgttgtcccttccttttttggggaccgtaggcacggttcacccaaaaccggtgttcccgtccgggttcccggtatttcttaaccaccgtccccaacggtcctttcaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtgatacagaaa

SEQ ID NO: 605445 - DNA, 457 bp, Homo sapiens
  misc_feature (32)..(32): n is a, c, g, or t
  misc_feature (151)..(151): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (294)..(294): n is a, c, g, or t
  misc_feature (323)..(323): n is a, c, g, or t
  misc_feature (377)..(377): n is a, c, g, or t
  misc_feature (383)..(383): n is a, c, g, or t
  misc_feature (398)..(399): n is a, c, g, or t
  misc_feature (401)..(401): n is a, c, g, or t
  misc_feature (405)..(405): n is a, c, g, or t
  misc_feature (419)..(419): n is a, c, g, or t
ttcaggtagtataaaggagttaagcagaaganacaagttattttgttgatcaaaaagcaccttagaaaatgctgcaaattcagaagaaaaatggattttgggcaaaactaactggtccacaagagaaaatgagaaatttgatttggctgcnaggcacaacttagctctggcagctatgttgcaggagcacaaaaagtntntnggattggggaggaaatgggtttcgctgaaggtaacaggtcccttgaggggcagcaagctgtttggatcattgttcaggggctgttttcagcncagatacctccgaggtgagttcagatcantagaagcagcagtttgttggtggaattcgatggatggcgatggcagttgcagcncaggtnttttggcagcatganntntttntttggaagtttggngaggaggaggggggttggcagcggcggctgttagttgt

SEQ ID NO: 605446 - DNA, 454 bp, Homo sapiens
tgctgcagcagcagctgctctgcatagtggtggccggggccaggccggtggtgcctccctcccaccttctcccgccatgagccatgtaagtcgggggactgtgccgctagattaatagtagaaagtgtatcatgagtgctgaataatatccttctatcatttagctaagacagttactaccatgacactactgtatgtgtcttccacacttgcagataaaagcttcatcatataggctatccatacatttccccaagatgctctactcttaaaatagtgaccattcatttacataggtggagactcactattcacacgactgacgtatacttgctagctgggtggcacacacgagggatcacggacatattagggaaaatacgcattggccttaaaacagagataccattctctcccaaagaacattccttcatgggcatacagattaggaagg

SEQ ID NO: 605447 - DNA, 359 bp, Homo sapiens
  misc_feature (302)..(302): n is a, c, g, or t
  misc_feature (310)..(310): n is a, c, g, or t
tgctgggattaaggcatgagctaccatacccagtctaattttaattttaagtttttttggtatatagtaggtgtatatatttatggggtacttgagatgttttgatataggcatccaatgtgaaataagcacatcatggagaatggggttatccataccctcaatcatttatcctttgagttataaacaatccagttacactcttttaaaatatacaattattattgactatagtcaccctattgtgctctcgaatagtatgtcttattcaggctactttttttgtacccattaaccacccncatctcanaaaagaaaaaaataaagagagatgggatttccccgtcttccacagccgg

SEQ ID NO: 605448 - DNA, 841 bp, Homo sapiens
tgctaccttatgaggccaatagcgagttttagcattctgatatgggcaggcatgctaactgagagtccagctctccagtgtagttcttgcttatggattggaatgtccctgcccattgctgttcgaatgctcagaaagggccttggcctcctgaagacatcttcctcacatgcctgctctagcctgagcctccccggggaaaaggagaggaccatggaagcctgtggacatcccttcctcccacaggctggaacacttttgagagtgagtgaatccactctctttactctctctcttctttgaggcttacatgattcctccccactctccttccctcattaacacacctttgtggggatgctcatagataccggcattactcgttgtcgttcccggccaatatattagaaaacaaagggttcctagaccggaaaatcagaccaccttgcttgtaacatcttggaaatggacttgaaacagactcacttcatggtctcgcaggtgtttattacacattctgaatatgggaataaccctgcgtttcggccggggttattttttcatattgggcctgcccctcgcccccccacccttggtaggagtggatggggtttcaccaactcatttttgggggaacctctattggaaacgactcgtttggttaggaagaaaattttaagtgaaattgggggacattatttcaaagggaaggcgcggtccccattaacagaatctgctggcggcctgtgtcctttgatagggatgtagcaggggtcgcgcttcttagctgcgttcccctggacgattgatttcgggcacgcgtaaaccaaccaacaagcgt

SEQ ID NO: 605449 - DNA, 421 bp, Homo sapiens
ggcggcggaatatggcggctccgatgactggacctcagaaaaaaaagtcagtgctgtggtccagtacactgatgcggtgctcactttatcgctcgtgcatggggtcccatatgcgcagcagtagtgggcctcagtcttcagaatgtggatctgccgaattgaagaggcctgagtttcacgctgcgcaccaggatgcagagttgtgtcggttaaaggttttgccttggttactccactgggtcacgacgagcttataagcgatgtatgcctatgttgcgagaatacagcttggtcgtagccgagccactcaagctgtctgcacaacttcacatattggacttctatgcaaagtacaagcacaacttcgcactttcacgtagcactgggacacatcatgtctaacaatctccagcgaatccct

SEQ ID NO: 605450 - DNA, 385 bp, Homo sapiens
tcgtgggtctgctgcagtacctcctctctctgcatcgatcgccgtcgcaagctactgacgtactcgcgtatagagccgtccagcctcacaccccacggtgctgttcattcagaggatctagtctcaacagacgcctcaggcgcgggcaagctcgagcggacgggggggcggcggagcctctctcgggggagccgcgcctgaggaggcggaagaacccccctgacgcgactgggtgtgcttctgcccgcacgccctcccgtctcaccgggccgtccctggcatgcccctgccgcggaggcagcggcggcagcggctctcttttccacagccggcgctgcgcgacccgctttggcctttcctgagcccgtcgggtaggctctcctcg

SEQ ID NO: 605451 - DNA, 138 bp, Homo sapiens
gcttgtgactaaggctgtgatacatgtgtgtgtgtgcacacatgcatgtacacggtgttggtgtgcatgtgtggctgcaaccgtgtgtgcatgtgttgtatgtgcacatgtgtgcgtgtgagcgtgcatgtacccagg

SEQ ID NO: 605452 - DNA, 179 bp, Homo sapiens
atggcgcgcagtgacttatgggcggggtacactgcggatggggtcttagtgaagaggttcttgatctccgcaatggtggcgtgagctccaacttgtcaagaaacaagttctcccttgtctttgcgtccagaatctccacctcgtaatgcttcatggctccctccgtgccggtccgcaat

SEQ ID NO: 605453 - DNA, 705 bp, Homo sapiens
tgaccggttcaagctggggttcacatgaccccctctttgggttcagttaatttctggagcagttcacagaacttagggaaacacttgtttatatttactggtttattataaagaatattacatgggatacagatgaagagatgtgggtagggcgaggtacaggggaaggtcgtgcagcttccatgccctccctgggcaccaggaacctccagtgttcagttatctggaagctctctgaaccctgtcctcttgggttttatggaagttttatgacatcagcattccttcccccagggtatagggtgggaccctcgcagggaagggtcttaagactccaagttggaaggtggggaaagattagagtcctgccttgtggcaggtgaaaggaggacaggagagagattgtgtttcccgatacctgcccttggggcctaacacacccaacattataacaaaaaactataacaagggctgtgggagttaggaaacaagaactgtagacaaaaaactataacaagggctgtgggagttaggaaacaagaactgtagacaaaaacctatgtatcatatcacattgggttttcatgctcatgtgtgagaagtgcctctttcaaaccttgttctgacacattatcttacatgcaaggaaaaaaagctaaacatacacttaccatcccacttctaggtatttgcccaagaaaaaaa

SEQ ID NO: 605454 - DNA, 102 bp, Homo sapiens
ccaccatgcccggccatacagtaggttttaattcaatgcctttgacatgctgagtacttcggatacagcagcaaaaaacaaaaacatggttactgctgtcat

SEQ ID NO: 605455 - DNA, 764 bp, Homo sapiens
gccgaaaggaggaaggaagcaaaatatcaacaacagccgaggcggctcaggcgctcggcccggttccccgcttgcctgccgcccgcctgctggcccccgcgcccacgacgggggcccaggcctcacggcgccgcccagggtcccgcgcggacgccggcctcatttattattctccctcgcccggagctgctggcttcccggtgttgaagatcccccggaccagtggcgagggctacccgctctttgccgtgacaacaccgttcccccagccgggctggaggctgtgcagaaggtatcctgcagaccatgaactgagcactggttcccagaccgttcatgagcacagttgtaaggtgtgccgagagccagcacgccagcgagcccctacccctccgtaacactgaggacccccggagaagatggggaggaaaaagatgcagatccgagcgaatcaccgacgagcaggaaccgactaggtgacgtgtacaccaaggcggaagtaggtctgatgaagcaaggcgtatgagcgtgagcgtgctatgtgactgcgacgatcgcgactcatcagtcttcaaccagtccagataagctggtccagtacgccgagcgaccgaacatggaccaaagtgctgctcaagtacacggagtacaatgagccacaagagaggccgcccagcgccgacatcatcgagaacctgaggaagaagggcttcaacgggtggacaggcccgagccgacgggaggactcgcgggaacagagcccg

SEQ ID NO: 605456 - DNA, 840 bp, Homo sapiens
aggagttttgcttagctggactaacagatttgtggatggattttacatgctcgacaactgggccaatcaaagatcagcttggagaagtgctcttgatccaattgctgataaactacttatcagtatcttatatgtcagcttgaccctatgcagatcttattccagttccacttaattacatgatcatatcgagagatgtacaatgtgatagctgcgagtaatattatgtcagataccgaactcttcaaacaccacgaacacttgacaaagtattcaatccttgctatgccactgctacgttaaaaccaaccattcatcagcaaaggtgaacttccagcaagtccaagttacatcttgagagggcaggctaactatgggccagactccacgtatttccacactactgctgacaggcattatttaattcttaaccgattactatgggtgtgaaaacaagactttctaccacacagctgcaatcagttactcagtacctcatccatgattggccggacaaattgtacacgggtgcttacacaaggcacggatgacaatgtgcaatccccatcactgtatcagataacgggcaacgcatgtcataccatcaattgggtcaaccaggggacccatgggacaaactgctacacggagacgatgtacccatacttaatctagtgaggtacagcatcgacaacaggtactcgtcagcatttcacactggtgttcattcaaaaatatagttcatggtgcattgacaacatcaaggttgatgactgggatatatgcccgacatttcaacaggtattttaaatacacaatacaattgcataaaatttaatc

SEQ ID NO: 605457 - DNA, 103 bp, Homo sapiens
caggcaaaatggaacatcgagttgatggaaccccttgattaagaaatctctggcatgtggaagtggttggaagagtaaccgcaaggccaccatcttgtgtaca

SEQ ID NO: 605458 - DNA, 382 bp, Homo sapiens
gaaaaaagtcctttttttaatgggcggggaaaggtaggctatccttaaccctcttgggaatttcccccaccgggggaaggtaaaattccctcagggggaagccaggttttatttggaatttatataccacccgcttgggtggaaaaacccttgttttcggaaaccctgggggagttgaactgataggtactgttggggcctgaagttccccctttaaaggggtttccccagccaaatcctgggatgggtataaaagggattggtggcccctcctatgccatatattttaatttgataatggggcccgataaaattataaatggggatgaagcttggggatcccttttcctggggaatccaaaaaccattttattttttttga

SEQ ID NO: 605459 - DNA, 173 bp, Homo sapiens
aacatgcgaacggactgatcaccgcagcaacgccttcgtcgaggcgatgaacgggctgctgcagcaggccaagcgcgccgcgcgcggcttcaggacgagccagaacttcatcgccatcgcctacctgcgcatgtccaagctcaagcacctgccgatcagtccgttcgcatgtt

SEQ ID NO: 605460 - DNA, 631 bp, Homo sapiens
  misc_feature (181)..(181): n is a, c, g, or t
  misc_feature (244)..(244): n is a, c, g, or t
  misc_feature (323)..(324): n is a, c, g, or t
  misc_feature (338)..(338): n is a, c, g, or t
cccgccaatcctcggagtctgtccaccccctctactccgccctcaagaggatttcaaagatggaggcggcggctccctaaaccacttttcgtgttcatccgcctccatccgagatcgaaacgggactcgtcggcccgtaggggcccgacaagaagagggaatccctgagaccaacaggggntatattgacgaggtgtctgagatcggggaccgtcttttgaagagtcagtccctccttagttgnccgcctcagctgaggccgccgccattttcttgctgtccgccgtctgagagcgcgcaagctgccggagctctccgagagnncccaaagagactgntttctgtgcctggccatggcatgggtggttttgtctgcctggatggcccaatgaggaactggcctcccacccagacttagctgggttatgcttggacctgggctggtgcaggggaacctgaggccaccacggactttcctgtggctgcagggcagacagccgagttccttgacggtcaacgatgactgcaaaacgtgatctcccacacaataatgctcacctggggcaagggaatggcagggtatgctgggggctgggccccagaagcagcagcaccagggcaaaaggatacg

SEQ ID NO: 605461 - DNA, 174 bp, Homo sapiens
ttagtcataaaggagaggctggaaaagttgatattggtgccagcagatggcgcgaaagcccttaaatatatcttgtgccaggcattcaaagcgctcaaatagtttaattcagagtcgtaaaggttaggcactggtatatagactataatgctcatatgtacagccatctaggag

SEQ ID NO: 605462 - DNA, 270 bp, Homo sapiens
tgaataataatgtatgatataatagaaaatagatgataatcagatagcaatcgtgcagctcaacagacatacagttgcctacactgtaacaaccgttcaggatgaaccgtataataaattcgtccatgcctagcgtctttgcatgtagcctgatgtctgtggagctgcacattgtaagttattttctgtatctctctattgatatctgcccttcttgtccttacatcgatcttggtttgtggctttcccacctgtgaaattgctcctttg

SEQ ID NO: 605463 - DNA, 1009 bp, Homo sapiens
ttcctgattcccaatcaaggggctccgagaaatgtgtgccaaatcgaatgcgagctatcatgtttcttggcaactcgttttcggaggaaacaggctttgtgggtaagttttggatcctggatgaggccaagatttggtaaattcagaaggacacccgtagggggcccctggtggtgctctacagagtatttagttgtataaagaaattcttagtgtgaaaatactcgttgcacagtcgatctaaggtcttccggttcttggtcatccgttctactcataggcgttggcagtgacatgtttgaagcattataaggcagtgtccaattaatacttcttacttcatgcccatatctttgatggctggggtcttggaggggaggaggtcaaatctcgattttgaacattactagctttgtcagttctaatgcagaagtataccattttatcgcctgtgataactaatcccaatattgttaaattaagggagcaactgttcacttactagtctatttcagcctagaagtaaagagtaatatgagtaacacaaattgcgttgtttaaaggattatagtgctgcattgtctgaagttagcacctcttggactgaatcgtttgcttctagactacatgtatatacaaagtctctttggcaagattcgacagcaagatcatgtagcatatcatcccattgttaacagcgcacttcaagaaatatgggtaacacagttagctaaatttagtacacagttctttttgtttttgtgtgtgtgtgctgtcgcttgtcgacaacagcttctttgtttttcctcaatcgaggagtcgttgctcatttgtgagccttcattaagctcgaagtgaaatggttaaactatatatcctgttagataggctgcatctttttaacaactcattaaacacaagtacaactctggcttttgagatgactatactaaattacacttgttaccagctgtagtgctgtaatacgctccataacagcgtatactgc

SEQ ID NO: 605464 - DNA, 181 bp, Homo sapiens
aagacggattctcactctgtggcccaggctggagcgcagtggtgcgatctcgactcactgcaacccccgcctcctgggttcaagcgattcccctgccccagcctcccaagtagctgggaggacaggtgtgagctgccgcacccagcctgtttctctttttccacccttctgtcgtcttctc

SEQ ID NO: 605465 - DNA, 530 bp, Homo sapiens
atctagaggaccctgcatgatgactgctctaaatttgctcggtccctcactctggctcatgccccgttggtggaattctatcttctagaggacgtgcaaggactgagtgtgaatccatattgattcaccagcactaacagttcccccatatatctccccactgctgggccctgctcacctcagtcgccaaggtctcagtgtgagtgagttaatcagatgcattcacgagtggcaggatgtctggcgcacgccgattctgatgagggaagagaaacagaggggctatgaattcgaggttcacactttcttcaaggcacaggtttcagctggacttaatggtataccttgtaatcccagtactatgggaggccgaggcaccgaggatcacttgatgccaggagtttgagaccatgctgggcaacatagatgagaccccgcagtctctaccaaaaagagaaagaagtataatcccggcactctggtgtgtcccggtagtcccggctattctggaggctgagcgcggtcagatt

SEQ ID NO: 605466 - DNA, 187 bp, Homo sapiens
gtgatggtgatttacacggctgggcatataaaagcattgcaaagcatggagtggagatggatcgtggtgcagatgagctggttcaatcactcctcgtgatcaacaaggaaacaaaggccctagagaggagaaggcaatgcctggccagacgtgggacctgaacccagccagggctctgactcacagt

SEQ ID NO: 605467 - DNA, 186 bp, Homo sapiens
acattcgcaggactgaactgaagctgtactgagtctcatccacagaggccagcgcattgtcccagcctggagccgtggccgatggcttccctacactgttccctttgttgctgtctggcttctcccgacatctttttagcgccagcctccaacgcactctaaaagggcggctattccctgctagac

SEQ ID NO: 605468 - DNA, 304 bp, Homo sapiens
gcgtattctggtgtctgatggggaaggagagcgcatttgctctgagctaaggaaaaggatctgcttctcagattttaactaatccctgttttaggctaacccagagaccaagtgtcccaagaaagaacccaatgcttcaaattcctgagcctccccatgaagtctacagcacaacatcagcctgcgttctcacttgcgctttttagtttaactgacaacgaaactaacaaactaaacatctctagtttgctaactaaacagcttaggctactgggaggcccttcaaccgctaaggaatgacaag

SEQ ID NO: 605469 - DNA, 313 bp, Homo sapiens
cggggtggagctaggcactgcaggtcctggattaacctctacatcaccagaggaacagaggaggaataggataagggtacggctaaaggctataagaactggtcatctagtgcgttcggaacagagagtaaaaggagcagatttctgggcccggaagaatggattcaaggcataatgtacagacaagggtatggtaggatgtgaatacagtgtaggtaaacctaggcattgagtgacgatgagagaggttgtctctagaggcaccatttaggccaggtgaggtcaccccgtcgggtggagcgggtaccgagct

SEQ ID NO: 605470 - DNA, 406 bp, Homo sapiens
gtgtattgaggctatacaaactacagatctgcgtgctagaaagatacaagttgtgccccgaaacaacatctgggcttttaaagcctaagattcacgtcctggtgttcacagcatcttcttcttgactatcactatgatcatatcctccgcagtggccccgatgctgaattccaaatgataccctttactatgtatcttgactgtatggagattattttttccttattaaaaaaaagaaatacgatgatctttccttctttgtccttcattaagaataactgggcgatactctatacaggctttgtaaactctcccttgaataatatttcatacttacagacatttcctgaatggctgctgcgcttaccctctgttcactccttcacataacatgtagcggtccctt

SEQ ID NO: 605471 - DNA, 928 bp, Homo sapiens
ggcggggcccgctggctctcgccgccgccgggcatggccgtgcagctgctggaggagaagctgacctgcgccatctgcctggggctctaccaggacccagtgacgctgccctgcggcacaacttctgcggggcctgcatccgggactggtgggaccgctgcggaaaggcgtgccccgagtgccgggagccctttcccgacggcgcctgagctgcctgcctggcaacgtggccctcagctggctgtgctggaggtggtgctgcggcctgggtccgtcctgggatcccggcccccgatcccgggccctgtgccgcgacgctgcggctgctgacccctgcacggtggctgtgcggtggatctcttctgcctggacctgagggccgctgtgtgtgcagcgtgtgcaccgtgcgcgagtgtctgccttccacgagcgggcgctgcttggatgccgagcgcctcaaggcgcgaggtccagctgaggagccaggctggaggttacccagcagcagggtcactccagtggcgaaggccagctactagagctgcgcaagcaaagcagcagatccagaactcggcttgcatcttggactcctgggtctcgggcaaaggttcagcaaggctagttagatggcctggaataacaggacacgactagacttgagggaggattgaggtgggcaaaatgctgggctggcacaaggggtcaaaaaaaagaggcagggctgggggggccttgggagggtgggggtcaccaaggctggaggagtccgggaggccttggagacagagggttagaaaactctttggaggatccaggcactcaggccaaaggcttttgggcaagctttgtagtgtagcagacaccagtcgtctccaaatcacacctctgggcatcacaagaaagcggggaacctggtacacataggcag

SEQ ID NO: 605472 - DNA, 639 bp, Homo sapiens
ggggttttgtttttgtttttaaaacttttcgggccttgaaaaaatttcccaccaacaaataaggaaatggggcttaggagaccaaaaataggtctctccagtggaacaataggcaataaataaaggttataaagctgggctttgtaaaccggcatgctgggattaaatcctggctcaatttctctgtagaagagaaaagagagggcacaaatcctctgtccatagatgaattccttcacccttcctagcctcctttttctcatctataaaatgggcataatactggtacctctctcatatggttgttttagaaatcggtggtacaatgtgtgtaactgacttatctcagggtcatggctattcactctagaggtggcagacacagtggggaagagaagcatctcggacctccacctgaattttgcttcttccaccttcttctagtgactttgggtggttatgtactccttctctgctttattactgtggagacgtaaaatgagagtaatggaaatacctgtctcatactattgttacgaggattaagtgagttaatacatataatgtctatagaacagttcctggcattaagcaaaagctcaataaatgttagagttattattatgtcattatcatcaa

SEQ ID NO: 605473 - DNA, 102 bp, Homo sapiens
  misc_feature (86)..(86): n is a, c, g, or t
  misc_feature (95)..(95): n is a, c, g, or t
gtgtcagcatttccagcagcggtgtcagcatttccagcagcggtgtcagcatttccagcagcggtgtcagcatttccagcagcggngcagcattnccagcag

SEQ ID NO: 605474 - DNA, 201 bp, Homo sapiens
tggcagccctcctccaaagccctcttcctgacgtggctgagaccaccgctgggactgctcctagatggatatcagcggcaataagctgtgcctgagcgagtttgtagtgacgcactgcacagcacccccagagtagcatgtggttctatatctgtaaagttattgggttaagaaacagttatacagtttgtagtaaacaca

SEQ ID NO: 605475 - DNA, 125 bp, Homo sapiens
tcatataacactcttttttcaaaacggttgaagaatagatgatacgaatgtgttggtctgatttctctatctggcgaactcaaaaattccgggtaatcatcaatcaggtcaatggtccgagcgga

SEQ ID NO: 605476 - DNA, 602 bp, Homo sapiens
tcggcatgtttcccacaggtgttacaggagctgccagctgcaaacacattcgtgggcacgggacaccacgtccacggcctctgagcagtactccgactacagctaccgcacaacccccccaaataccccagcaagcaggtagccagccctttcagctcagcaggattgttctggagtcttatgtgaggtatcaacattcagactccagcagcattgttctggagtcctagtgaggggcaatcattcaggccctcatagcagtattctggaatcctaagtgaggggaaatactcagaatccagcagcagtgttttggaatcctatgtgagggactaacattcagaccacagcaggaatgtcctggaatcctatgttagggacagatattcagacccttgtggcagtgttctgtaatcctatgtgaggaagaaatattcagaccacagcagcagtgttgtggagtcctatgtgagggacaaacactcagaacccagcagcggtgttccggaatcgtatgtgagggccaaacattcagaccacagcaggagtgtcgttgaatcctatgtgagggacaaacattcagaccctcgttgaagtgttct

SEQ ID NO: 605477 - DNA, 1236 bp, Homo sapiens
  misc_feature (1125)..(1125): n is a, c, g, or t
ccttcggtctctgcggctcgcggttggtgtgtgacgtgcttgtgtctgttgcctgggttgggtctttgcccttctgttcttctgtgttgctttgatgtgttggtgcgtgttggcgtctttgttggaccgatgctactactatccacgttgcctattgtgggccggttgcaaggggttttgccggccgttttcccgtcttaggcgccgtttgggaattcggcagaggccatggcgggccctgcgcatcggggcccggggccttgccctgggtgggccccgggtgctccgcgggtttccgacctgggcttcccggcccgggttctcgcccctgaccggggcgcggccgtggccccgtctttctcggaggccctgtccatggtttagggtgatgtcccgtcccccaattggcccccttggtcaaggaaccagaagatccaagtccctgggaaggaaatttatcgtgtggtctgcccctgcccactttaggaatcccgagatcctgtgagttctttccctggggccttttctcaaagatggaagttttgagagaatttatgcccccggtccaggaagctcagaccccggggcccggccccagcgcaaccccgggtttcaaagccaattgttgcttattcgggggactacccaatgggcccaagtccggttcttgggtggtttaagtggcttccccagagaaggttgcgccaccccccaatccccgtggggccactcaatccatggcccaagcgtttccacattgtgccccggtgccccagagaggctaacttgggggacacaagaatccggccaagccccaaaactggtctcccttgcacaaggtgaacaaggcccctgcggctcttgtgctggaacgcctcaatgccctgcacaccccaggggccactggcactcgtttccgcaccctgggcctaaagaaagctgctcacatagagatggctggtaatcgagtgagctgctacacacctcagacccgcgggctgcacctgccacccctgggcaaactttgcccaaggccaccctttgaatgccactttttataagacctacacagctacctgaacccccgaaccttctggaaaggaagaactgtaattcaccccagtncttccctaataccggagattccctgaccccctcgtccagacccccccccgagtttccctgcaacggactccggctcccactgtggctaccaacatagggtttttataccca

SEQ ID NO: 605478 - DNA, 318 bp, Homo sapiens
  misc_feature (49)..(49): n is a, c, g, or t
tattattctgtggctcatttttattttaatcctttaaatttaaacattnttttattttaaaaataattgtcactttgggaggctgaggcagacagatcacaaggtcaggagttcaagaccagcttggccaacatagcaaaaccccgtctctactaaaaatacaaaaaaattagccaggcttggtggcgggtgcctgtaatcccagctacttgggtggctgaggcaaggagaatcgcttgagcctggaggcagaagttgcagtgagccaagatcacgcctctgcactccagcccgggcaacagtgtgagactccatctc

SEQ ID NO: 605479 - DNA, 181 bp, Homo sapiens
tctctccacactggaggagcacaactaaaaagagctgaacaaactgacaatctctttaagcagaacataagagacacgcagatgagaaggcaataatttaacaacattattaagtcatattctggacatgtcacaagatgcacgcatttgtcaatttatcttttacccagtgtggagagag

SEQ ID NO: 605480 - DNA, 325 bp, Homo sapiens
aaagcacaaaatggggtggcctatgtgcaagaacagcgcgcgaacatgccaccacgtgaacctttgtttaaacggcgggaacgtcccaaaaagagcattacggactttggcgatgatccattaggtgtgaaaacaaccaaaactgccacagttgatccagtggtaccacccgctaccgcgccggctgactggaatttgtccgaaccggatattaaatggcagggaccagtgcgcgccgactgaatacagccacccaacgcccggccacccagctgtgtgcgaaccccctgaaagcccagccaagccgcaaccggcaatcaagtgt

SEQ ID NO: 605481 - DNA, 373 bp, Homo sapiens
atagtaggaaaagctacttgcgtagcatgtatatataaaacacacttgatacgtcaggatctaggaaaacacaagatgacctaacacgagaagtagttcacatagtcataacataaacataagctgcccagaaaaatgtaccaaaaatcaatgtaataaatgtcacataatatcaaaaagacgttacctcaatagtctatcaattatcatgtactataagtcaacttcctaaataagataacagtcctttattataagcccctactgatactatagtatacctttaaaaaacgctactacaaaaattttcttttctattaagatacgcttattgtgtacttagctatagataatttttgaatacaacgcctac

SEQ ID NO: 605482 - DNA, 490 bp, Homo sapiens
actctagagttacccctggtacgggagtgggtccccctctgtggacgcaaacatgtttattgcaggaaggaaaaacaaggaactattaacccaagtcacctctggagcaaagaccagctggggccaggtgagcagtgtcgtgctgtgatctttccagaaggctgactctttttccgtacacttttaatttgtttgatcatatccctattttaccttccttatttttaatgccagccagggctttctgggtaagagctgggcacacccaggtagaggcacgtgaccatccgcagctgctctccttgggctccagtttgtattgtttttgtttcttactttctgtggagatggggggggggggtcttactatgttacccaggctggtcttgaactcctgggctcaggcgatccgcccgtctcggcctcccaaagtgctgggattacaggtgtgagccaccgcgcccgggcaaaatcccatcccgtaccaggc

SEQ ID NO: 605483 - DNA, 796 bp, Homo sapiens
gagagagagagagagagagagagagagagagagagagagagagagagagagagagagagagagagcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctgggaggagctcaggggtggcctggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaggaagccgcagaacaggatgttgaacagaacaataagcctcctggggacttggatcaacaacacgagacaagtcccccagaaaaaaacccgggggctctcgg

SEQ ID NO: 605484 - DNA, 321 bp, Homo sapiens
  misc_feature (4)..(4): n is a, c, g, or t
cganctgaggatcccccgctacctggcatttcatgacagtccagcgagccaatcttctgttagaaatgaaggggcagtgagcaaaagagaccagaacaaagcagaagccatattccacttattcgaaaatcaccggcactgctcctcttaagggcctgtggataaaagggaaattaagttagtatcctccaggagacttccattttccaagaaaataaacccttatcaaatttcaagaaagtctgtaggcaggactagagaatcagtatattttataacttaaccatactttttcagcaattactaggtaattaccaagca

SEQ ID NO: 605485 - DNA, 558 bp, Homo sapiens
gagagagagagagagagagagagagagagagagagagagagagagagagagagagagagagagagcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctgggaggagctcaggggtggcctggcattcacaagaaggtggcccggaccatcggcatttctgtggatccgaggaggcggaacaagtccacggagtccctgcaggccaacgtgcagcggctgaaggagtaccgctccaaaaactcattccttcttttcccccagcggaagcccctttcgggcccccccaaaggaaaggggggacgaaccagggtttcgttgccttggaccaga

SEQ ID NO: 605486 - DNA, 174 bp, Homo sapiens
gtagagacgacgtctcactatatggcccaggctggtcgtgaactcttgggctcaagcgatcctcccacctcagcctccccaaaatgctgggattacagacttgagccaccatgcctggctagaattcccttccttccttccctctgttctcccctccccttctgtcgtcttctc

SEQ ID NO: 605487 - DNA, 121 bp, Homo sapiens
  misc_feature (110)..(110): n is a, c, g, or t
tgggctttgacttaaatttccatcaggcctctctccagcaggtaatccctctgcttccgctgggtcccctgggaggaagtgaactcaagggcctagcccaaaacactagnggtgcttttct

SEQ ID NO: 605488 - DNA, 219 bp, Homo sapiens
tcgagccggtacctatctgaaagcagaatctagtagccaggagagaaacgcacacactaggtcagggtccccaacccttggccacagactggtactggtccatggcctcttaggaactgggccacacagcaggaggtgagcaagcattactgcccaagctccacctcctgtcagatcagcataagcattaaattctcataggaactcgaaccctattgt

SEQ ID NO: 605489 - DNA, 247 bp, Homo sapiens
acaccaagcaatcttcagggtcttccctaatccgctccttctgttgaaaagccagcattttactgagaacagtactcgtgtgtgtgaccctgacagtactgtcaacttaaaaaatgcacaaactgaacgttaagagttaggttttatttggggcaaaattaggatttaagcccaggagacagctccaatgtagccccgaaaaacacttctcactcattctataatgtttccctgtatccctgaagat

SEQ ID NO: 605490 - DNA, 203 bp, Homo sapiens
tagccctttactaggtatgaaagttctagatacacttagaaatgatgtttcctctctccatgccataaacagagagatttttgtttcttcggtcttcaccttttaaacttgtggggttcctggaagcgatcaaaacctctaagactgtgggcccccagttttgtctattcctacactagtctacactcttgtacgccagtcaa

SEQ ID NO: 605491 - DNA, 127 bp, Homo sapiens
cactgtatatcaattccccatgtgacagatgaagtgatgtctcaggactctgcgcatattctacaggcacataatctaccatagttatattatctgtaaactgaacaatgacttgattctaagtgag

SEQ ID NO: 605492 - DNA, 551 bp, Homo sapiens
  misc_feature (411)..(411): n is a, c, g, or t
tcacacctgtaattgtagtacttcgggaggttgaggcaggcagatcacttgagctcatgagtttgagaccaggtgtgggcaacatggtgaaaccccatctctataaaaaattagctgggcataggctgggcatggtggctcatgcctataattccagcactttggtaggctgaggcgggcagatcatctgaggtcaggagtttgagaccatgcctgaccaacatggagaaaccccatctctactgaagatacaaaaatttgccaggcgtggtggcacatgcctgtaatcccagctactcgggaggctgaggcagtagaatcacttgaactgggaggcggaggttgcagtgagccgagaccacgccattgaactccagcctgggcaacaagagtgaaactacatctcgggcnacaaaaccatgattccttttctcgagggggggcccggttcccaattcggcctatggggagagtattacaattaactgcccgttgttttacaaacggctgactgtgaaaaccctggcgttcccaaatttaatcgctttgca

SEQ ID NO: 605493 - DNA, 190 bp, Homo sapiens
agtaactgagtacttgagcaggtacaccaatctgctgaaaattcatttcttacccctgggacatttaactgataaacgtagatgaattaagaaagaaatgtgatgactttagatagaaagcatatcagttcttcattcaggaatgcagctttcttaggagaaaaatgtgtcgcaaatgtccgcaagatat

SEQ ID NO: 605494 - DNA, 867 bp, Homo sapiens
gcgactatggccggtgtgaagaccgtgggcgtgtagtacaccatgagaataaagttagggactggccttctgtgcactggggcctgtaagaagatgcgatttgttttgcctccgaagtcttacgggtcaggtcgcctgcgcacccagaatggagggatctgattatgaacgcctccgagaaggggttgatgtagcgaatgattttatacgtcaagttagtgggcagctattgccactaatcccccaggtgatgtgatattggcacgtcttttagcgcgaagttgacgatgcatccgaggataggtcggattgagttggcgcatttgaaaaatgcttgtacaaattgtactgatggtatcccatagcaaaagatcaccctcggtttcgtgttcgacttgttgttgggctcaggactggaacatttgagttagcggagtcatcgtctggttgtgctgtttgatgccactcatggcggtcgcgatcatcatgggtggatttcgaaagcgttcacttttacgatacgtaccaggtcgtcgtctgatagtcgcagttgcgaatcgctttaaatgttcggaactgaatctgggggcgggccctttcgttagattcatggagtagctggacgtgcactaggggaagatcccttgaaatgttgattcgcccgtggcaagtggttacctcgctaaaattcctggcgagttcgacaaacccatttaatgtctgaaagttcagcatctacatccggactgagtgacttcagttttggaagtccaggcataagataggccgaaattatgcaaagactttgacctcgcacggctttatgactatgcgtacagaactgcacttgcggtactcttacaggca

SEQ ID NO: 605495 - DNA, 1300 bp, Homo sapiens
attatcactttaaggtggataaatgatgaaaatgagcacccagttcatctcttaagcaacggtcagtttcaggggctggtgcaaaggcatgcagtgcaccattgttcgcaagccagcaggcaatgcaattcacgaaggcagtcccacttcaaagtcaacactggcaactttgcaacaatgtctgtacagccaacggtttcccttgggggctttgcaaatcaaaacacctaccagtggtcttcaaggttgcaagatgtggttcaggggccaggatggccatattaagtggcacaagacaattcagtcagctagttggaaggaaagcatgccagaagtcaagacagatgcaagagggcagggcaggcatgtgaaaactcttaaagtaatatcgtggaaagacggttcttgacccctgtgcagggatggctagacaaggattacaaagacaaaaaaggtaaaaacattgagattgagtgtatgacaggaatgcatgaccgaatgaattgatgaaagaagggatgaatgagtgaaaagattgaattgattggcatgcagtgactgagggcaacgactgagcggaacagctgacagcacaaaacggacgcacaggggcaagcacccactccacatcacgccgacatgagaacccacgaccccaaaacacatgccagcaaaaaggtccaaacatccgacactcggcagcaacggaagtccaacaaagacaatgcactgaacaacagacacacgcaggacactcacacaacggggcaccaacgcgaacacaatttcttaataacaacgaacaaaaacaacgggacacaacacacgacatcccgttaaagcacgacccgaaccaacgggaacgccatcacgaggtgcatggtaggcaaacgcagccgtagacgaaggccaccagacagacaggcacacaagaacacagacacaatcgaacaacacaaggcgcgtggagaacacaaccatctagcccaacaacaacggctggggaaccacgacccaacaacacgatgccacagtccaacaagagaaaacggtgcgcagcacacaaaactgtggcctactcgcggaacaagtagacctgaccaccacagccagggcgagaactagaagcaagaactccagacagcgggaccgaaccggcgcgaagaagcagcccaccatactaccgaacaccaaacaaggccgccacacagcaacctaccaccacagacaacaccgacagaccggcaacacacgcgtcacaaacgaacgaggacacgcaccgagacgaaaccacccgaca

SEQ ID NO: 605496 - DNA, 456 bp, Homo sapiens
acccgatgatggcgatattctttggcaagcacaatcgattgaacaactaaaagaagattatacgcgtcatttactttatttaggtcataagcccgcagtaaagtctctgttaacaccttatgaaaacttgctatcttactatcaaatgcaccataaagagcctgaaggggagcgtatttggcaagcgttagaggaagtttcgttgataggttatgaggatgttcctgtttgccaattgtcggcgggtcagcaacgtcgagctaacctggcacggttatggttaagcgaagcatcactttggattttagatgaaccgtttaccgctattgatgtggcgggtgttaaacgcttaactgaacgttttcatcagcatgctgagcttggtggtattattttgtttacatcccatcaagcgatgtcgggccattttggatcattaaaactgacggtcgacgc

SEQ ID NO: 605497 - DNA, 108 bp, Homo sapiens
atgctggtccctaccggcaggttgtactgtagagtttgtgtttgaatcaggcagtgcccaggcaggaggaaatcaagccctgccaagtactggcaggcagtctactga

SEQ ID NO: 605498 - DNA, 172 bp, Homo sapiens
gcttttttaaaagagatttatggatttgggaaatgtttggagtccacagttcacacaagaagctggacacggtttggtcatgtaaaaccgtttggggggccaaggtgggctttggtgccatccttgagatgaaccttttaagaaaaataagttaatttcaatttttccctga

SEQ ID NO: 605499 - DNA, 147 bp, Homo sapiens
gggaaaggagttggggaggggtttaaaagcccggggcatgtttggtgtttgtcatgccaacctaaacacctcatggttttgtttcccccccccccctttgttttacattttttataaatgtgccaaactgtgtggcctctgccagga

SEQ ID NO: 605500 - DNA, 677 bp, Homo sapiens
aggagaacgctaccacggacctcctcactaagctgcctgcgcacacagtgggtggatgtgaaatgtgacatggaggtgagctgcccagatggctatacctgctgccgtctacatgtctggggtgcctgtgggctgctgcccttttacccagtgctgtgtgctgtgagtgaccacatacactgctgtccctgcggggtttactgtgtgacactgcagaagtgtgtacctgtgaacagtggtgccccaccaggtgccctgtgatggatgaatgggccccagctcacctcagcctgccatgacccacaatgccttgaagacgacgatgtcccctgtgataacttgtcatgcatgcttgtccctcctccgatacctgcttgccaactcacgtactggggagttgggtgcttgcttgtccaatcccagaggcttgtctgcttgcttcggaccaccagcactgctgccccccagggctacacgtgtgtagctgaggggcagtgtcagctgaggaagctgagatctgtgtgctggactggctgaacgatgcctgtcccgcgggctttccttatcccatcccatgagacatcggttgtgaccagcacaccagctggccggtggggcaggacctgctgccctgagctgggtggcgcgctgggctgcttgcatgttgcccatgctgg

SEQ ID NO: 605501 - DNA, 287 bp, Homo sapiens
ggggggcgctctcgcggtcctgtctgatggggctgctttgcctcgctgctgctacgtgacggcggctacgtacgtggggtgacggcttggcttacgcgtttagacgggctctttgttgtgggtctcatgagttggcgtgtaggctacctcatgctccggcgcggctgacaccgatatcgccgatacggttgtatcggattgcgtgaatggctgctgtgttggcatctgctcgggcgtatcatcaactgatgagcaagaaggatataattcctacgcccattcagcct

SEQ ID NO: 605502 - DNA, 366 bp, Homo sapiens
tccctctctgcgaccattcccaatctcacccagttatcttatgccaaaatagttctccctatcattcttaaaaacttggttttgcccggacacggtggctcaccctgtaatcccagcacttagggaggccaaggtgggcaggtcacctgaggtcgggagttcgagaccagcctgaccaacatggagaaaccccagctctactaaaaaatacaaaaattagccaggcatggtggcatgagccttgtactcccaactactcaggaggctgaggcaggaaaatcacttgaacccaggaggcagaggctgcagtgagccgagatcacaccactgaactccagcctgggtgacagagcaagactccatctt

SEQ ID NO: 605503 - DNA, 106 bp, Homo sapiens
aactgctgttcgctcatgtacatgcacgccgttgcaggcctgccgctgtcgtcgggacgcaggtcgatccatgcaacactgctgcgtacaacaccggttgccacac

SEQ ID NO: 605504 - DNA, 160 bp, Homo sapiens
taggtgactactgtggttgactatcttacagccttttggtactgggacactatcaccaccaaaaatgtatccctggttatatttgaaaatttgttaaattttttcttttttgttccttccttttttttgttttattttgttttgttttgttttacagcat

SEQ ID NO: 605505 - DNA, 502 bp, Homo sapiens
  misc_feature (4)..(4): n is a, c, g, or t
  misc_feature (21)..(21): n is a, c, g, or t
  misc_feature (317)..(317): n is a, c, g, or t
tcanacagagtttcgctctgncaccaggctggagtgcagtggcgggatcttggctcactgcagcctccacctcccgggttcaagcgattctcctgcctcagcctcccgagtagctgggactacaggcacacaccaccatgtccagctaacttttttgcatttttagtagagactaggtttcaccatgttggccaggatggtctcaatctcctgacctcgtgatccgcctgccttggctcccaaaatgctgggattacaggcatggggccaccccgcccagccatgcattttttaagtaatagcagcatctttctttngcaggctttggcaaagtcttctctataatttggagtcagtcacacacctttagagggttgttgtgagttccacagcctcatctgtcctatttgggaatacaaatgggtttttgtaatggtttgttgtcacattgatgctggttcctcatcttatgtttcatccaagcatttgcaatggtggttga

SEQ ID NO: 605506 - DNA, 332 bp, Homo sapiens
  misc_feature (5)..(5): n is a, c, g, or t
  misc_feature (29)..(29): n is a, c, g, or t
  misc_feature (42)..(42): n is a, c, g, or t
  misc_feature (60)..(60): n is a, c, g, or t
  misc_feature (272)..(272): n is a, c, g, or t
gcacntgaagatcctggtgtcgccatggncgccgcccgcccngttgttaccggtattgtnagaacaagccgtacccaaagtctcgcttctgccgaggtgtccctgatgccaagattcgcatttttgacctggggcggaaaaaggcaaaagtggatgagttccgcctttgtggccacatggtgtcagatgaatatgagcagctgtcctctgaagcccttgaaggctgcccgaaatttgtgccaataagtacatggtaaaaaagttgtggcaangatggcttccatatccggggtgcgggttccaccccttccacgtcatccggatcaacaaga

SEQ ID NO: 605507 - DNA, 116 bp, Homo sapiens
  misc_feature (67)..(67): n is a, c, g, or t
  misc_feature (93)..(93): n is a, c, g, or t
ttcttttaatttactgtttttggggggttttgttttgttttgttttgtttttgttttttgagacagnacctccctctcttgcctaagctgagntcgtgccattgcgctccagcatc

SEQ ID NO: 605508 - DNA, 766 bp, Homo sapiens
agcggggcggtggctgagaaggcagcggggcggctggtgcggctgtgcggctgttgcgtgctgtggaggccgcagtccgggtcctggcttcggcctcagccccaccatggtgacgcttgcttgaactgctggtgctcctggcctgctctcctggccacggtctcgggctatttcgttagcatcgacgcccatgctgaagagtgcttctttgagctgggtcacctcgggcaccaagatgggcctcatcttcgagagtggcaggagggcagtcgcttcctggacatacgaccgtggaggtgcgaggctagactgcaccagcagctgagggcttggtcgacgatggccactcgggggattggtggcaacctgggaccaagacgcggtggcctagatgatgagggagtgtggctatgagaaaagattctgctggtcgctgaagatcaccttgggaagaaaggccacgaggggccaggaacggaggcagaagtaaaagactggaatgcaccccggggggcgaaagagacagacgcatgaccgtagagccaaagcagggaacacaagccaaggtggcaaagtcttgaacggtgggaggtttgaggttggaaatataggcataatgagggaagcagtaagatgcagggaaaatagaagatagagagaggggaagagaagaggggatattaggtaagatgttaaaagaaaaaggggagtttaaatgttattacaaaaaaaggagtgagagtaagaaggagaaagtgtagaaaga

SEQ ID NO: 605509 - DNA, 612 bp, Homo sapiens
tgctgttccagaggatccccaggaaacagctatatttccattctttataaaatcccttccgctccacagattacacaagagcacacaagctgcaaccctcctgatgtccactagcacaaaccaacctcagggcttctatggtgcattcattattttgtagtccatttacctgtgtattggtataaatcttacgtgcctatcttttttcccatagtgtcgctgatgaaggttctgagtattgtgtccctgttttctgcacaagccctgtggtgtttattcatcatgctgtatggcacggtgatttttttagaaacacacgggttgcatcatagcaggactcagtgcattgactttttatttagatatattgctggactcggtaagatttaattaagatgtccatgtctagctcgtgtatatgtaaaaagtagaggctcctctttaaaggctttactccccgtctaattaggaataatactaacttctcttagaagcataatttattcaaagacctgtgctaacattcttaaatatctgctggccgtaatgaggaaatcaaagtactttatgttcttagctcgcacaattcagcctaaatatttggcctggcat

SEQ ID NO: 605510 - DNA, 100 bp, Homo sapiens
tgccaccacctctccgatcgtactctctgtatatcattttccagcaatagaaactgctttttgaaaacagcactcattttctctctctacttggggtggt

SEQ ID NO: 605511 - DNA, 319 bp, Homo sapiens
tcagtcggggtctcgctctgttgcccaggctggagtgcagtggcacgatctcggctcactgcaagctccacctcctgggttcacgccattctcctgcctcagcctcctgagtagctgggactacagttgcccgacaccacgcctggcaaatttttttgtatttttagtagagacggggtttcactgtgttagccaggatggtctcgatctcctgacctcgtgatccgcccgcctcggcctcccaagcttgtgttttcaattttctttaacaaccaagaatgtttgcagataaactattgatgctattgcggctggttct

SEQ ID NO: 605512 - DNA, 243 bp, Homo sapiens
cttcctcacctggctgcatgacggaaagctgctgccaagaaagactgcgcccctcccctgccctctccctgaaataaagaacagcttgacagaagccctggctctcctgctgtcctgtgggttgggttgtgggtgttgtcgggggccctgcagtccccttgtcttggtgccctgctctgtagccactaccctctcctgggtgcttgcctggttgcagtgcacatgggtcaccgcagctcgcaa

SEQ ID NO: 605513 - DNA, 1990 bp, Homo sapiens
acacctccttattcagacgtccagatgactaggaccaacctatgccacaaacattcattattgtcaccgactcaacaagtcatacagacgataagtacagatcagcagaccctagtgcgactattgataattatatctttctgtcatgggtaatactcgcatcataatcaggcgagctatgagtatcctgaacgtgagttaccccctataattaatctgtgctgccactacagtagttatgtgcgctatcacacactgacactataagcaacggtagagccttctgaccttctataccctcgccatcctcatgcactaacgtccatgcgtacgggcaatcatgtctaataaggtagggaagcgccgcgaagcctagtgatacacgcgcattgtaagccaggggtcctagactcttaccacgtgtatggcacgggccagacataactactcacattcgcctgcgctagggctcgtactcgacgtactgagctctgaatacccaattcatttcttacccctttcatcaagctcatacagcaccatgctgttagatacttaccccgtccctcactccttttaaaggcgcgtccttaatacaatactctcccctatgactaacacacaactccaacaatacccattgctaacggcattcccaaacagaggcgcaccgcgcaaatggcccacgacatttccaatcctccccgaagaaagttaagcccttaaaagagggagggccaccacacccattccgtttacggggttatcggatgggacacagtcaccggtgtataccacataaaagtttctcatacaaaggcaccgaggcgacaccttatagacctatgtacgtccccctcttaaattatgtacgatgctcccccaaggatacacacgttaaatgaacggtaggacgaattggcgggcgtatttcaaaaccgccactttcaacacacttcaaccttcacaatccatagaacacccctaggacaaacagcaaccattcccaaccaccagacccaactcacattttccatatgcaggaagcctccccctgaccaacagagacaccccgaaaagtggaagggaaccccccccaattttcacttactaagccccataacctaaccgccataaagtaaactttggactttcttctcacacacgcagttccaaccctccttcgaataaagctataacctcaatttcccttatacatgtcaccgtgaaaccaaaagggagcccttttgccaggggaccaataaagttccattcgccgccaatgcacttgacaggccaaccgcatatcaacataacactacccgcggcaaagaaaaatcgctaacacacacgacaatttcgcgaaactacacaagtacagctgtacttatcgcaccctgtcaagctctgatcagaagcatctccacaactacacggaagttacggcaacagcgagaaatagcaccacagtgtgttacaagcaccacaccacgacacaacgtctgtaacaacagcgtgaccaagcaaaagataaaaacccgcagacacgaggacaaccccacagacacacaatactagcacaacaccgagagaacacaaaacagcaaataaccgaagagagcacccccaccacgggcgacacaaacaacaacattgatagcacatgcacaccgcagccacacacccaaacgagagaccgacaggctgacaagtaacctcggactacgctcgaactagagagacccgaacacaaacaccactcgcagacagcagcggatgacctacaacagcacaacaggcacgaccgctcccacacaacgagacaaacagaaagacaagaagatcagacacaacaggacagaacgaaaatcaacgaaacgacaagcaaagtagacacagtgacgcacacaagaacacaagacagcacagcaaacaacagcaagacaatcagacacgcaacaaataaacaacaacagcagcgaagaagcgc

SEQ ID NO: 605514 - DNA, 913 bp, Homo sapiens
  misc_feature (579)..(579): n is a, c, g, or t
  misc_feature (913)..(913): n is a, c, g, or t
ggtgaacagatttatctaagaaaaaaaaaaaaaggattaaaatagcgaaaaattaggaccaatttacgataactagttagtcaaagctctatggaacatgggttctcctgggccgaatgggtatgacacctaagttagaacacagcctgggtgggggggtgccctctctagcctggtatcagcagctgtgtaacccctttccgggtaaaaggggtcatcttaccaaagtcatccatgatgaggggacaaagtcgccatcccatctgcggggaatccatgagctcctttattcctggctcacagaggcagccacgaggcactacaccaggttattatattaaaagccattaaattttggaatggccctgtgacaagtttccttaaaaaaaaacacacaacaggttcatcatcctggtcacactttctatcaaactccccaacttttctgggtgggtaagccccttggcggttgttttggtggccgggcccattcttatcacgtaattactggggcagggggagagggaagtccagggtccccagactttcaacccggtctattttgtgaatctggcctangcgtttcacccctgttaaactcggtgtcggggacttcttcccaacagctacgcttcgggggggggacaaccacttaacgcatcactgggtggcaaaccgtccaaggcaagtggcttttatctggccttcacagccctgggtaacaaaggagacagaatcgcttccttaacagggcgcccatggtaagattagacgcgcaacacctcttctcgtccgggtgagtaaaccaacgcgcagtgcgctctctcgcaggggagacggcgggagacacacaacgcttttcagcacaccactcttcgccgtctccgtcatcgcagcgcacactaacacaccn

SEQ ID NO: 605515 - DNA, 108 bp, Homo sapiens
actacgacaggatgacgtgaaggaggtgggtgctgcgggttagcctgccggcgttcccacagagcaaaggtggttcgtggcattgtgaaggatgtaagacaggatgag

SEQ ID NO: 605516 - DNA, 444 bp, Homo sapiens
tggcaattcccggaaagccggttcttcgcctaacgtgctggggccgatggaacaaggacaggcgccgatctttatcgtgctcaatgccgcgccgcaggagatcgtgttcaggatgccgaggatggccgaatacaagagctggcagcaggttctgaacacgacgaagtcggagcagaccggtgaccagattgcggccggcgccgataccaccgcaccgccgcgttcggtgctggcatttgcaggctccgcatgagcgcgcagcatttcggacccgaactgaccgctgatggcgcgcgctttcggctctgggcgccggcggcgaagcgcgtcgacctgctgctggacaagccgcacgcgctcacgcgcgatgcggccggctggtacgtcgccgagattccgggcacgcgcgacggaacccgctacaaattccgcatcgatgaagag

SEQ ID NO: 605517 - DNA, 324 bp, Homo sapiens
  misc_feature (252)..(252): n is a, c, g, or t
attagatccactatcagtctgtgatatctgatatttcagagtctttggtggttcgtgtcacacacgatgcgtgttacagtgagctggagagacggctctatatctctgagcaaaatcggccggcgaggaagcaggagagagacaggtaaagcgcagattctgcgtgctggggcaggtcacagttgtatggtggagcgaccagataatcatcagtcacctcacaagctgtgctatgggcgtgtctcacaaggnctgatcaacagagcagctcggcacatattaggattggatagtgtgtagtgggacgagtcgatcgtatatgcc

SEQ ID NO: 605518 - DNA, 288 bp, Homo sapiens
tggaacattcgtgtcacgaaattcgggttgagggaagcaccacccacaaggaagccatccactattaggctggctggccagtctccttgcaggttgccccagtcacatagtctccataaatgatacgggtgctctgacccatcgcttcagagacgttgtacttcagtccatcctcggatcttctcgtgtacttcctggtcctgttggggtgttccagtcttgccagtaccactggaacacatcaggctcatacgccatgacgacctttcctccggacacgaatgttca

SEQ ID NO: 605519 - DNA, 349 bp, Homo sapiens
  misc_feature (59)..(59): n is a, c, g, or t
  misc_feature (63)..(63): n is a, c, g, or t
  misc_feature (147)..(147): n is a, c, g, or t
  misc_feature (185)..(185): n is a, c, g, or t
  misc_feature (199)..(199): n is a, c, g, or t
  misc_feature (202)..(202): n is a, c, g, or t
  misc_feature (205)..(206): n is a, c, g, or t
  misc_feature (208)..(208): n is a, c, g, or t
  misc_feature (214)..(215): n is a, c, g, or t
  misc_feature (225)..(225): n is a, c, g, or t
  misc_feature (236)..(236): n is a, c, g, or t
  misc_feature (250)..(250): n is a, c, g, or t
  misc_feature (256)..(256): n is a, c, g, or t
  misc_feature (262)..(262): n is a, c, g, or t
  misc_feature (278)..(279): n is a, c, g, or t
  misc_feature (294)..(294): n is a, c, g, or t
  misc_feature (296)..(296): n is a, c, g, or t
  misc_feature (300)..(300): n is a, c, g, or t
  misc_feature (303)..(312): n is a, c, g, or t
  misc_feature (314)..(314): n is a, c, g, or t
  misc_feature (316)..(321): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (336)..(336): n is a, c, g, or t
  misc_feature (340)..(340): n is a, c, g, or t
caaaataaaaatcacacataaactcaccactttggagatcagcatggaaaacatttgcnatgngtcctttgtttccctataagtgcatatatggttggcaatttttattacaaaactaaaatcatatgtattacagaggagtaactngcttttttccccacttaacattatattgctggtatttnccaaagtcattacntanttnncncaaacnngatttttacngactataagtncaataagccatttncaattnttttcntaactaatatatttcnncttataccatatttntncttnccnnnnnnnnnntntnnnnnnggggnggngnttggnctgngtcgggggg

SEQ ID NO: 605520 - DNA, 307 bp, Homo sapiens
aaaatagcagctgcaaagctgtggagcactcaagatggtaatacttgtgtagaagtaattgttaccaatgaaaatacatcatgtacctgtcctagcagtggcaatcttttggggtccctaaaataaagaaaggctatctccacactgtaatgggagtcattgtggatattcatctagcatggaaggcagttaaacaggtttctcggagggttcggattttccctcacttaaggcatttataatcattatgaacacggtgatgactcttgttttacacactgttgagacaaagaggttgtatggttat

SEQ ID NO: 605521 - DNA, 1267 bp, Homo sapiens
  misc_feature (1267)..(1267): n is a, c, g, or t
gtgccatgagcttgatgtgttggtgcccggcactggaggggcctgcggaccaataggctctgccctgcaccttagtggctcgggatgctgctggccctagccagggtgccttgtggctctgggtggcatgctgctggagtgacaggctgtgggctccagctctgtcacctgttgtcctgctgctgctgcttgctcctactgctggccactggcctagcacttggccttggctgcctgcctcagcctgtgactcagtgtgtgctactaccaccctgtgccctggcctatgtgtgccgtgcttgttggtggcctgcactgctgggatgccttgcttcttggggccaggccccccaaggtcagcttggcttgcagtgcccgatgcttgagctggggtccacagacaatgacctgtgagcgacatggaggatgagcatggacacagactatgaccacgatcgcggatggtggcctgcatggctgaccctgggggaagggcgagcagcaatgttggagagggcgtccagcccagaagcagggtcccctgtgcgggcttgaggaagccagagacctgtgacactggatgtgctgactgggtcctcggctccccagtgacagcgagccgcagggggcaggtgctgaggcccttgctgaggtgagctttcacgccttttgcttgtcagtgcgcaggcttgggattacaagtgccagggcagcttgtgggccagggcctccagtgtcaaccgaacttgtagatgccggtcattgggttgtcccaattcccttttttaccaggcaggattcaatcaccctagtagctcttagataccaatgattccaatttgttgattgtgaccactatcccatattaacaattccttagacttttacaccccataacagatacacacagtcatattttacactggtacaccatgtaacgtgcccaccatacacatgattatgcgccctttggacattcagactcctttgacctttgtaatcaatagatataaaagaatcaataagaataaatgatagaaaagagaaaggaggtaattatggggggaaagagataaaaagaggcgattatgtattatcatgaaacgattatagaagaggaggaggccagatgggtatttcagagagtagaaagaatgacgaacgagagagaagtagaagaagagcgaggactttatgggcagaatagataacatatagatagtcagatagagtagatgagaggagatgaagagtaaatggagatagn

SEQ ID NO: 605522 - DNA, 195 bp, Homo sapiens
  misc_feature (36)..(37): n is a, c, g, or t
aatctttagtgttgtgagcccttaaaagggacagannattgtgcactcggggagatcgggattttaaggcagtagcttgccgatgctcccagctgaataaagcccttctacaactcggtgtctgagaggttttgtctgtggcttgtcctgctacaagctgagattgcatcacatacccctgcactccagcttggg

SEQ ID NO: 605523 - DNA, 443 bp, Homo sapiens
acggataccagatagctcccggaacgtagcgaagtgcacaggtggcatcggtcttgaaacgaaagtcattgtcgtgatagagcgggggtcaggtagctacccttcactgggaaagaagatactctcgagcacgtagaagtcttgcataaggccatcacgctctggttaggtactcaggctccccacagtgtgggtaatgcctcactagatagcacctttcaaggctgatgaggttctctttttatatttcgtctctcctgaggaatcaacacttctattgcctatatccttgatgggcatgccacaggcttaaggcacctcacatgccaagggtctcttgattccagatgctgctgaggacaaggtacaggatgggaccgcgggatctaagtgatgataaaccgatcgaagaccattgcccgtagaacgcaaagccatcttag

SEQ ID NO: 605524 - DNA, 568 bp, Homo sapiens
aggctcggccggtggttttgcatgaggcgggcaggtgtctgtgagggacctgacggacgcacgggcgggcggctgggagccatggagcgcggcctgggcccggtgggcgcgggccgggggtgtgcgcttcccacggcacgacatggagacctgtggttgcgaggctccctgtgggctcggcttggaccgcgatggggctgggccctggcctcctaacggggctgctgtctgggtgcggtaagcatgggggtggcagcatcgtcaccaccaagtgaccagaagagtcggagaagcaaaccaacaaaaacggtcacccatgacagatgcacaagagcctgtagatggacattcgttagtaagaggagacccagagttggacgagacacaggaacatagagaagggagcagcagcatagaaatgaggcatataagaatgaaatagagaacatgaaagaacactactggctgaccagaacaggtgccaaacggagccggaataggcatggcaacaaatcgaccgtataaattgaacgggcgggaagcacaaaccatacgacgccgtggagtg

SEQ ID NO: 605525 - DNA, 764 bp, Homo sapiens
  misc_feature (32)..(32): n is a, c, g, or t
  misc_feature (119)..(119): n is a, c, g, or t
  misc_feature (257)..(257): n is a, c, g, or t
tacctccggaaggcttattgagccggttacgntggcctttgaaataaggtgagttttctcccaatgccgaagccgtaaaggtcccatcttctgaaattaggcactaagtcccgtggtcnaatgtccgttagtcttagagctcatcgtacatcttcgattttgtgtgtcactacacatctagttcatattctagtacgtgtcggctcatctgcatgtgcaatccagtactgagtcagcatactgtgctgtgtttttcnatctggcactcctagtggcattacactcgcgacagtctacctctaagcgtgcagtcagtgcttatagtcaagtaatgccatctgcagcaggtacagagagcataatggagtgaatctcaatggtctgctcaggcacgatgatggtgggcaactcaaagtatgcgatcgtgttggctactgcatttagatccgtagcagctatgccatatgaaacacttttcgtaagcgtgaactaggccacagttaactgagattcaggcacggttatctcaataaagggaatcaaggagtcatctggttgagaatattttgttaacgcatcaacttcagggaattttacctcggtgagtgttggtaggttgagggcaaatgatcaagttctcagcttcttatagatttgtatctctctgaagtcaagtttgcacgatgcaacgtgcagatctgtaaatggtacatggaacgtaggcatgacaagtactgaatttagatcatttagtttcagctcag

SEQ ID NO: 605526 - DNA, 942 bp, Homo sapiens
  misc_feature (137)..(137): n is a, c, g, or t
  misc_feature (942)..(942): n is a, c, g, or t
cggaagtagtcggggagggccgcgcagtcggaccggctgctgagacgaacgcttcactggggcagtctctgcatatcatggggagatagacgctgctgcctttaattggccttggtccctcacagctccaaaaaganacaggatctcgataagctctatgagctgaagtccaaagctcggcgcaagatttatgaccccagttgtggcccttcagacccataatcaaacctcctccatttttctccatccaataaaaaaccgggaaccaggcccagaaccccctccacaaaggtctccaatgggcccaatttagtactggcagtcggtaaaagtatacccagggccactccttggggaccagggagggtcggtcttaggcccttgaaaaaacaaaattcagggttatttggacccaaggaacgacatttacagggacttacgtaagagcaaggtgggatccctaatggagacaggtgtggtttgaagattgtggaggcaaaatgctgctgaaagtatggctgattgatttcaatcgagacggtgtgggtgacagcagccttgtccagctgggccgggaattcggaaggttctaaccaccctggagcgtggaaagtatgtcccagcctgcccattagaggcgccagtggacacccttgtggctccccaggatttgtgctctagagaaaatcgacctaaaaaaaaggttgcaaccatagaaaggttccacaaaacagagaagtgcctgtgatccggaaaacaacccaagaagataacccccggaacaggtccggcatgcacggcactgtttgggaagattcttggacctgcaatcagcatttccttctgggtttttttagaccgtgcaacagaccctttttttttacaccggcgcaattacacggggagggttcaaaataacttcacccctgggcgcctccgcan

SEQ ID NO: 605527 - DNA, 121 bp, Homo sapiens
tgtgcctcggacctgcttacccgggcgtatgctatgtttctatgtctggtacataagctactacatattaacatatgtcatccactggaatgtacagtggctagaattctgcgtgaggcta

SEQ ID NO: 605528 - DNA, 1349 bp, Homo sapiens
gaacatctatcaaaataagtaactgtttatacaaattcagtttttgtagggtcttccaaggaaaaatcaccttggcttgaatgtattctcactcattcaaactttgcacgaacgtgattcatattcagtactgttttttaatcacattattaaaatatacaggaccgaatgcaaggaaacccaaacgttcactcaactacactctctactatacacctaaaataacaatacgatgtggacgggactctgctgatccactactaacaacacgggacgcggttacctgaacacgaacttccacgccaactactactcgacttcacggaacaaggagctgatactcgataacatgatcatatcactggtacctaactggttctactgtatactattcaatcccgaataaccttatacatacttaaaacgacgcgtaaactagtcgacaagtcaagactgcgtcactcacttactgcactcaccatactacttcacacgctcacgactggcacgataaacctcactcatctagcgctacgtgcgctactagtagtctgctgaactgtaaaccacgtactctacttcaccgcctcctactaacaagcacggagtataccacgcaccaacagtgcccctacctcgagacacgcaggactaggcccaacatggtaccaccacacgacgcctgaggcactcccgctcactccaacaccacgggataaattaaaacccaactgcacaagaacaccacacacaacgaaccacactgaacacgaacaccagcagcatacactacgaccgcgacacacaacaatatacaccactaaacaacaacacgctactaagcaacacacctacgcagtcagaatacgagcacagaactaaccaccaccaggcagcaggcaagcacggagaaaccagccgagtacaaacaaaacggggatacgtcaacaagaccaaaaatcactggcgatcacacacgacaaaagacgcaaaagagaacccaaccaaccacaaaaaactaacaaccgaccgagagagaaccaacagagtcgtcctaaaaaagccacaacccgaaggagaccacacagcgccccacaacgcggcaaccaccaacaaccgtgacgcccccagcgaggctcacgcaatacccaccacccgcgcgcaggcacacgaccaaccatgcagacgccaaccccaccacaacccaccacacaccacaccacacgacgagccccacccccaccacctccagcccgacacctccgccaccacgcagtgtcacctccacccacaccaccgccccccccacccccatcaccacgcctcacacgaccaccgcccacgctaac

SEQ ID NO: 605529 - DNA, 248 bp, Homo sapiens
ctaactactaccgcattccttactattcaacttggactccagcactaagtacctactactatctcgcacctagaaatacgctaacatgactaacacccttaattccatccaacctcctctccctaggaggcctgcccccgctaaccggcttatttgccccaatgggccattctcgaagaattcacacacaaaacgatagcctcatcatccccaccatcatagccaccatcatcctccttaacctctac

SEQ ID NO: 605530 - DNA, 763 bp, Homo sapiens
  misc_feature (7)..(7): n is a, c, g, or t
  misc_feature (17)..(17): n is a, c, g, or t
  misc_feature (24)..(24): n is a, c, g, or t
  misc_feature (29)..(30): n is a, c, g, or t
  misc_feature (88)..(88): n is a, c, g, or t
  misc_feature (101)..(101): n is a, c, g, or t
  misc_feature (545)..(545): n is a, c, g, or t
  misc_feature (716)..(716): n is a, c, g, or t
cttgganaggaaccgcncagccancttcnnggggacacacctaccacacagcacaacagacgcggcaccaggttttccaccttcacgncacctgaggaccnctgcacgggcattaaagcccgcacccaccagccctttcctcccacggtgccaagcaaggcttatgattcaacagttttgaagacaagaggtaatccttatagatatgaactgattgatattcccaaggtttttttcaacaaagcactgactgggccaggtcaaggtgtatattatgatttttccagaggtgttgagaaaaataagccagtattctacccaaaacctcccaagaccttcgctactaacacttgattaaaagcatgggaccctcatcgccctgccaaagaagccatcctacacagaaatcttgacagcgccccactggctcacttcgtacactcatgattatacaggtctggggcccatggacccccttgaactgcatgattaccgcgaaaagatggcagcacagtcaacacgagagataggatctgacccgtagncgccagaacatctgcgacctgctcttcatacctcccacaccgaccgaaggaccagttgccctacttctctacaaacttcattttgttgcaaggtaatagatccagcaaagaccacaacgaaagtaaagaatgtacttcataaaggtcagtggcacttttattacataagtncacatctataacgagttgccggcacataatcgatacaaagaaaagag

SEQ ID NO: 605531 - DNA, 397 bp, Homo sapiens
tgctgtgttatctttatagcaacactcatccttaaccaactaggtaccgtgagtttacatacaggagaatgatggaaggaagggaggaaggaaaggaggagaaaatcgcgtcttcagctggcggcatttattttaaatccttagcactgagtttgaatggtataaaaagtataactcccatcgatgagtttttatatgaaggcaccccaaagaccttctttgccctaaaccgggggatgggaaggaaaggtctccatggagtacatctcatgccagtttagtaatcaattatgttgatattgttaaactggttcaaagaaataaactggcaatatgtaaagtaattcctcatttgtgtcactatgatatagagatattaaaggaatgttggtttgtt

SEQ ID NO: 605532 - DNA, 146 bp, Homo sapiens
tcttgagttatccctaatacaggatgtgtgaggatcaaacggcacacattctgctagctaaagagatagcaaactacccccaacccttataaagataagaccctgaagggggctgggtacagtggctcatgcctataaccccagca

SEQ ID NO: 605533 - DNA, 248 bp, Homo sapiens
accctttaaatccccttgtaaatttaactgttagtccaaaaaggaacagctttttggaccctaggaaaaaaccttgtagaaagagtaaaaaatttaccccccatagtgggcctaaaaacagcccccaattaaaaaagggttcaagctcaaccccccctccctaaaaaatcccaaacaaataattgaactcctcccccccaattgggccaatttatccccctataaaaaaactaatgttagtataagta

SEQ ID NO: 605534 - DNA, 100 bp, Homo sapiens
gcggaccagcgcgacgcttcatcaactcaagaactagccagccgggagtttctagtaagtgaaactgacttggttctgcttcctttcatgaaaacctttg

SEQ ID NO: 605535 - DNA, 989 bp, Homo sapiens
ctctctgggaggctgaggtgcgcagtcaattgaggtcgggatgttcaagaccagtctgaccatcatggtggaaacctcatctctactaaaaatacaaaagttaacccgaggtgtgtggtcgctcagtcgtgaatccccagttactcaggaggcttgaggcactaatgatatgtgaagtatcacttctctagactcagcgaggcagatgtgttgccagctagagcccgacgattcgcaccactgtgctccagctcgggttggataacacatataataagagtagctcgtcgaatcttgttgaaaaatgcagatgcctcagatccaataatgagagctcagactgtgtaacgagggcccaggacatcttgcgttggtacaaaaaacctcgtatgggtgttccatgcagcacaagaggatgtctgagaaccagttgtatctgaaatgctgctcccaattgggacaacagtgccgtgatcattttcgcaaagagaaccaaacaaatggtcgtctctgcctagtgttcagtcttactaatgaaagtctgtctggttgagctactaggactctgagacttatttcttattaaccctctgagatttcgccttgtattaacattaggcgaaaaatgcgtcggacctgaaccatggtagggtactaaattttggtgtaaccctttggtgaacttccgaggaaattggccgggtaggctgtgctcaaggatgggtagcgcacgtaaaaaaccacgtggcgcgttaggggtttcaacaaattaatgtcgagggttaatggtgccccggccggggtcgtctaattccaaatattaagccttccaggttggccacttcctggaagagttggggaaaattagggatgttgcccccacgttaaaccgggtggggctcacacatttgtgttgggtgacaaccgttttctcacaaaaaagagtgcggccccagaaataggcggacgaggttcatgataacaacgaa

SEQ ID NO: 605536 - DNA, 440 bp, Homo sapiens
atcactgtgaccaatctgggatcaaaagtcagtgttcctccaaaggagacctctcctggctgggatcatccttcctcttttgctccaagcatttgcagcagtaggtggatacttgagtggcagaactggcaacacaagaacataaaaggtgtgatctttgacaatcctgtgtacttgaaaaccatggaagaggacctcttaatggacatgggtagacatggtgcttctggtggatgcacgtgcccagtaataccggtcataagcacagatgatgactcagcttgacttctaagaccaacttagaagtctcgacttctgaggtccacatcaataattccctactttggaagggtaacaaagccagaagatgaggccgtttcttcctccagcctggaggaacctcacgatatctctgttgtggataaagcttgtgtatttga

SEQ ID NO: 605537 - DNA, 211 bp, Homo sapiens
tggttggggtctctgtgtgttgaaagcctttccgtgttgcatgtgttgttacaattttttgtggtacttgcaatttttgtttggggggaagtgaaaagtttgccttttggcctcatttcctttttgatcagtggacccttacattttgggggcaactttgtcaattggttttccttacaccaaatttaggttaattgttgcaaaaaaaaaa

SEQ ID NO: 605538 - DNA, 172 bp, Homo sapiens
gccgatcatctgaaaccttttcttgatgattctactctccgatttgtggacaaactgtttggggcttttggggaaggccgaagcttttggccttccaagtttagcagtgacaggagcagaaaacgggagctaaagggtgggttttggccataaggggcgaaactctgtctca

SEQ ID NO: 605539 - DNA, 210 bp, Homo sapiens
ggcctggactcttcttcacagagaatgtgacagaaacagcccagctgtcccactgcctgcaagatgagggatgcggggacgtgcaggaggcagcttggggaacggtggcgggcagcaggagggttgggtggactcagtgtcaaggtcaggatgcaccgagtctaccgtgcagcacatgctctgagccactcttatttcctctgagtgagg

SEQ ID NO: 605540 - DNA, 692 bp, Homo sapiens
  misc_feature (107)..(107): n is a, c, g, or t
agaagaaaagtgagaaagagaaagtgaagaagagaggagaaaggagaagagaggtgtggagaagaggagggggatgagagaaaagaagaaaaaggagaaagaaaagnagaggaggataagaatgtgagaagaagaattagggaaggagaaagagaaagagaaaaggagagaagaggaagaagaaaaaagagaggaggtgtgggggagaaaaaggaagggagagaaaaggaaaggagaaggggaaaaaaagctttttgatgaaaaaggcaaaaaggaggaaaaggaagcttaaaaacgattaaaaagcaaaaaggggaataaataaagggtggaaaggaacaaaacaagcattaagaaatcagagaaaggaaggaggcaagatgaaggaaaagaggggaagtccctcagaagaaaaagaaaagaaaaaaaaagaaaggagatagagatgatgagaatagcaaaaagaaggaaataaggaaagaaaagaagaagtagaattgaaaaaaaaaaaatggttagtataagggaaaacggaagaaaagagagaagagagaagaaaagaagaattgggaaaaggaaaaacagaggaaaagtaaataagagaggggggaagatatataacatatatactcgctctctatatatactatactatatactatatatatactatactctacctcgtgccgaat

SEQ ID NO: 605541 - DNA, 508 bp, Homo sapiens
  misc_feature (387)..(387): n is a, c, g, or t
gtatcgtagccggccaattgatacctccctttactctcctccttccccatctggcagcgaggaggctatgtcctagaacacttccacccctctctggtccacgtcaacgccccggcctttacttcagtaagatggtgcccgtgcgccggcttccccggacacgtcggcgtgctggagtaggggcccaacggcctgagcgtgctccggccctagtagacttcgcgtcgcccgcgagcccagcgccgccgccacacgacgtacccagaggtgtcagacaccaacgaaagcacacgagcgatgcagacgccgcccgacgcagcgtcgacccgatggagtgcagggtggcgctccggcaacggtgatagcagaccctttaagccccatctngcatagggaagatcaatgatcgtgaccgcgcagtgacgcgggcttgcgaccatttcgttggcgtgggacgcgagaaataaacgcggcactcgacctacggtgggacagagacaccgcagct

SEQ ID NO: 605542 - DNA, 151 bp, Homo sapiens
aatgtataacacgtacaggactggaggtttcaccactgttggccaggatggactccatctctatgaccttgtgatccgcccgaatacggactcccaaaatgctgggattacaggcgtgagccatcaagtctggcgagtgaaattacggcca

SEQ ID NO: 605543 - DNA, 516 bp, Homo sapiens
  misc_feature (405)..(405): n is a, c, g, or t
  misc_feature (451)..(451): n is a, c, g, or t
taagtttctttaatgcccatatgcttgggttagagttcttgactatctttaataatgtaggtactttgcttaaaagtgttcagattcagcatatatgtttctaaaatatatattttataatatattgctggtaaatgcaatatagagctacaaaaactgagttgagactcagtctgtctccaactagctgtctgatcttggcaaagtcacttcagatttacctactattacaaattttgattttcttattttaaaaaatgaaggtaatacctgttctagctaattctttcagatcaaggtgagataacatacagacataaaagcatggtgtaagctctaaagtgttatataaatataagccagttattatcagctggattaacttagcccatgttgacattgttngagtcactggataattccattagagcataagaagctaaactgcgtnacctggatgtggtgcatttggaaggtattatcccagctaaatccagaccaaggagccaccaaatt

SEQ ID NO: 605544 - DNA, 580 bp, Homo sapiens
  misc_feature (149)..(149): n is a, c, g, or t
  misc_feature (153)..(153): n is a, c, g, or t
  misc_feature (254)..(254): n is a, c, g, or t
  misc_feature (376)..(376): n is a, c, g, or t
  misc_feature (464)..(464): n is a, c, g, or t
  misc_feature (486)..(486): n is a, c, g, or t
  misc_feature (521)..(521): n is a, c, g, or t
  misc_feature (540)..(540): n is a, c, g, or t
tcgagatcttactcctgtcataaccatttacatacttcctgccataaaaacttaaacctggctaggaatattaaataaaacatgcaaaaaactacaagttcaggaagtgactgtatgtattatatacattaagttcatattccaatctnaganaaagctgaatcacccctacttaggaaaaccagtattatgttttatcatctggggtgactaatcccacaatggcccgtgcagtgaactttaagggtaagaanggctttctcttttgcactaagctcagtccatagttttgtgggggctgtcaggacgtctcgcaagtctgccgtgtgtaatgggctgaaatacactgttacatggccccagaattaaaactgtnaagatccaaagacttactttaggttaattttgcacactttaaatgcatatgccagttttcctttggtgcctgcctacttccttaaaanaaaacaacttccttaatgcctnagctttaccttgccgggttgggaaaatccaaaccngtgttcactccccatgatnaaaaaacctgcgttgacagtttgttttaccaaacaggcac

SEQ ID NO: 605545 - DNA, 204 bp, Homo sapiens
gtactctagagatcccaggattcgtagatcaagagaagttgggtcagaggtaggagctggggctcagtgtggggggttaaaggtgaggcaggtcagcggtgaaggtggagctccgaggggaggggtcaaaccataaaccagaactttattggtctagaggtaaaatgggattcatggggggccgaggtccacggtgaagccgaa

SEQ ID NO: 605546 - DNA, 864 bp, Homo sapiens
ttccgagtatcgccgggatttcgaatcgcgatgatcatccgctctctaaaggagctggagcctccctcaagtacagtgacctgcacaacttagccaagagtctgggtctccggagccaacctgagggcagactagttgttataaagccttgaatggctatcattcaacatgaggcaacgaataggaaatgacgaatctaggatgaaagtcaaggttctgcgtcctcttgtgatgagactgagatcctgactcagtccccaggaagaagctgcgtagacagcctacttgtggcattgtcgaccaaaacaaggagaagcgtgctagactggtccgtgctggaacccgtgacgtcacagcagatctctggcatgagataggaaataaatgtaactcccacatgtaagtcccagcacaatcagttagatcaaggctggggaaaaggcccacggagatccatcgaaaacggctacactgcggaacaacgcttcggcacttcatctgacgcgacgactggaagcattccaaaaggaaatgcatgacgcaaattgcttgtgatccctacaagacgttgatgcaagatgagtctccaaagcgtacgcgttccaagcacagggacctcagagacattcatcttcgtacgaaccatgaaatgcagggtcaactccccaaggacgcggtgcgcatacacacgcttacaacgaggagacatgtgctcactcaacattacgaccctcagaacgttttgacagaaagacttttccattgcacagccctcactattgtaacacgcggacacattggggagatcccaggtagagtccaacgtatatttcgacgaagagaaaaaatgcaacacatgacgta

SEQ ID NO: 605547 - DNA, 345 bp, Homo sapiens
acatgctgcagaagatgaggtgatgtcataattgcctgagttgacaaaatgaaacataaatggcaaaagtagaattttaaatgtcaagcttttatttcttcttaatttaaattttaattggaaacacttagcttttatttactgcaaaaaagtaataatttttgccagagattaatgtatccctttattgccaaggatgattctcttcctgtaaaaaaaaacgcagaaaatattaaatattggctctgggaggattcatttatttgtgagattctatttgctctgttatttaaagtgcttctatatacccattctactcctagacatttagataaacttcaagtg

SEQ ID NO: 605548 - DNA, 113 bp, Homo sapiens
  misc_feature (113)..(113): n is a, c, g, or t
agatccagtcagggtcaagagcttcagctgtatcgccaaatcgtgtggcatcattgcaggcagcctagggagcctctccagctggaggtagtccaaggggctggcgactcttn

SEQ ID NO: 605549 - DNA, 102 bp, Homo sapiens
  misc_feature (60)..(60): n is a, c, g, or t
gaccactgcgtggattaggacggatagacgaagaggggcgttggtatgggttatggcagngggttttatattagataattgtcgtaatgagatgttggaagg

SEQ ID NO: 605550 - DNA, 603 bp, Homo sapiens
ggacccacatcatgagacagcaggcttaatgtgtcccagccaggatcttcctattcatgagcatggaaggttgtttcattgttggtatcctcttttatttccttgagacagtgatttgtagttctccttgaagaggtccttcacatccctggtaaggtgtattcctaagtattttatactcttggtagcaatggtgaatgggaatacactcatgatttggctgttggtctgttattggtgtataggaatgcttgtgattttggcacattgattttgtatcctgaaatttagctgaagttgcttctcagctaaaggagattttgggctgagacgatagggttttctaaatatacagtcatgtcatctgcagacagagacagtttgacttcatcttttcctattcaaataccctttatttttttctcttgcctgattgccctgggcagaacttccaatactatgttgtataggagtggtgagagaaggcatccttgtcttgtgccggttttcacagggaatgcttccagtttttgcccattcagtatgagtatacctatgtaacaaagctgcacattctgcacatgtatcccagaacaccgtcga

SEQ ID NO: 605551 - DNA, 399 bp, Homo sapiens
acggccctgaacgtgggaggcggggaagagggagggaagcctttcctagcaggtgggggcgccaaagagcgcgtcatgagaaacgcaagcgaatcagcgcaaaacgcgtggggcgagtgtagtacagtgattggggacctcccgaacaagggcctatagcgctgggagaatttttgtcagccaaacaggtcaacctgggttcccgacccttgctaacattaggagaaataacccccccctactaaaccccattaaacgcctggggggcggaagcctatttgcaggatttttcattactaacaacatttcccccggatcccccttccaaacaacaatccccctttacctaaaactcaggggcctcggggtcactttcctagggcttttaacagccctaga

SEQ ID NO: 605552 - DNA, 570 bp, Homo sapiens
agagtaaggtagatagtatcaattgggtgcggtgagaaaggtaccgggagggtcttgtaagtggtaaagccagagttacttgtaagaaaaagcctatgattttagtggtgtgaatctagaatcatgacacataaagcttcagcggtatgtatttgtgcaaatttgtgcaagggtcttaacactataggaaattcaacaaaaactgaaaaacaagcttgatatctttacctgacccatgccttcttccattattttggtagttaaatattcactccagcactgcatacaaaacttatgtccacattcaaggccagtgaaatactgtaagaaaaacaaaacatgaacttaacaaaggtattatcagaaaactcactataaacagtgactcaacagggctctgtaaggtcacatttcttacgtggctcaaatgtccaatttgacaatagatgggctcctaaaatgaacttttcatggtgaatctagacatgcagatacaccgaacacacatacatcttaggaaaggcgggcaacaatgtttgtattacatatcaaaagaccaatgagcatatg

SEQ ID NO: 605553 - DNA, 903 bp, Homo sapiens
gaaaggctcctggtggaaggtgagacagagagagtcacgtgatagaacagggcaagaaggtggctggctgtgtgacggggaatcgaaaagtgcagtcgtacccttggtgaatgctgaggtgtgggccccatgggcctggctcccacctgttgtccagagcatgcccctgcccccaggtgatggaggactccatgtagctctggccactcatccatgaccacgccgcaaggtatgacagtgtggacagtccgtctatctatgcatgaatcaacgaggatgaatggtactggaggtgctggatccagctcagccatgacgtgcctcgatggtgctgctcttcttgccgtggtgctgagagtcatctggtgcgcatgacaaggatggtaccaagacgtggtcaacggatgttggtcgccttgaggaacgtatccgtgccccgccggtgttgcaccgactctgtcccgtgtatagtgttggaatgggctcctgtcctcatctcacaacgtgtcttgccttttgtgcttgattcccgcgtggtgctgcggtcagggagacactctgcagtctcttttgctgccagggctgtgtggacttatggttgttcctgttcttttaggttgggggtgggggctgagtcccggggttagctggacagaaagtgaggggggtgagtagtgtgaaggctttgaaccatcgaataggaagggacgggccggtttgccgtgttatttataaccgaaaaagggagggggacttataatactggggtgcaaaaataatgttccatgaaaaaatgtggcagggtgccgtgtattttaacaattttgtgacatagcaaatttaagcgtgtgttctaaatgaaaaaacccatggggaacagttttttttgtgatttttctccga

SEQ ID NO: 605554 - DNA, 630 bp, Homo sapiens
agggggggtatcattttatttattggacgacttacacaaaagggttgtatttcagttatttatgcaaatagggctactggggtcccaacagctttggttctgggcagtacaagaccctttgtccactcccagctttccaaagaacccaaacccaaattcctgtcagctccaacttgctcagcactttaattgctacagtggagccacactggtgccacaactgctcccaagcaacaatatttgcctttaacgtgtctttctggtgacaatccttcaagacaaaagaatgcctcaaacacaagtggaattagcccctgtgcgaatttttgggaagcactttgggagagggttctttacgtttgccttactggggacaaaaaagggcaccgtgttgccggctgattatggacttgctttggccaatggccctttctagcacatatgtttattgatcgaaaaatctccccattttttaaaacacaattcttatgccctggccttaagtaccctctcgcgaacctagggctacttaatggaaaggcttttattttttccttatttccccccaaaaggagtctcttagtctaacgcgttttaccccccgtggcgttggctttcttggcaaacccg

SEQ ID NO: 605555 - DNA, 100 bp, Homo sapiens
gaaggtgtcaggatgaggagtgagggtgtcaggctaagagagtgagggtgtcaggctgcaagtgaggtgtcaggatgagagagtgacggggtggggggtg

SEQ ID NO: 605556 - DNA, 333 bp, Homo sapiens
atgaaatcctgcaaatccaacctgtctattggagagaggcgtgtgagagagagtttattccttgaagaggtgtttccctcgagccagtgaagagaaagtattcgtggggtacctccaatgtctgtccacacagtaagcttcccacaggtgtgaccgtgagatttatctctctgtcaatagtttgaaagactgcctggttgcaaaaggaagaaaatccaattgagctctgatgtttaaacacatgttttgctagaaaatttctcatttgtacacttttcatgaacacatctagagtgtggtttgtagtctaaaatacagtgtcactacccggta

SEQ ID NO: 605557 - DNA, 509 bp, Homo sapiens
agtgatcgtatgttcttgccccatgtcttgacgcagtatgttgactagttagagacttatcattcttttgttaagccaacaagttgagaatttgagacctggtgagatccactgtagtgggcactagctgctctttggccaaggccttcataaagtgattcagtctctcattatctgtcctctagccccacaccctgatctagaccgaggcaaaaggaagaacttgaggtcaagaccaaccaactctgtgcaattacagctgatatttatcactctgcaaagggagcttagctatcaggtctggagctatgtgcagaacctaagcaggctgtagagagtatagaagaaggcagtattacatgtaaggcccagaacaaccatgggaaaaggttcatgtagtgtatcttagtgtcctgcctagctgcctctgggacaggcttgacttctgatgtccacataagctcgtacctaaaacctgattgctgaatgcagcccttactcctgtaaac

SEQ ID NO: 605558 - DNA, 264 bp, Homo sapiens
tgacacacagcgaaacgaagatcactcaccttccccttgctctaccccaactttgtataaatattcaattcagctacaaaacaaaatactggacccacttcttgcagaagatgatgaagataccttatatagccctaagagttaatacctagtcagtcataattttatacagattgtaaatctgggactgtaatgctctataaagtgtatatacgtaatggccagattcatgggtacctggagctccgaaattcggtacatcat

SEQ ID NO: 605559 - DNA, 499 bp, Homo sapiens
  misc_feature (412)..(412): n is a, c, g, or t
cacaccacctgagtccaccggtgagttcggtgaggatgcgaatggcttcgagcatgtgctcgcgctcctgagcctcgtccatgtactggtagtcgatccagcggtagccgtggctgcaaatctcgtggccggcggcgaccatggcgcggatcacatccggatgccgctgggcggccatggccacggcgaagatggtcagcgggatgtcgaattctttgaacaacttgaggatgcgccacacaccggcacggctgccgtactcgtacagcgactccatgctcatgttgcgctcgccttgcagcggttgcgccgagaccatttccgagaggaaggcttcggactctttgtcaccgtgcaaaatgttgcgctcgccgccttcttcgtagttgagtacgaacgacagcgcaatgcntgccttgcccggccagtgggggtgaggagggttactgccgtaaccgatcaggtcgcgtgggtagtcagcgcgctcgtgttggttccg

SEQ ID NO: 605560 - DNA, 294 bp, Homo sapiens
cgcctcctgtgctcatgcctcagccttccaagtacctgggactacaggcgcacactaccatgcccagttaatttttctatttttagtagagacggggttttgccatgttgaccaggctggtcttgaactcctgacctcaggcgatccgcccgccttgaactcccaaagtgctggattacaggtgtgagccactgtgcccggcacctaaacaacatagttttgatataggtaagcatacagcatatatcttgatgctaatttcaggtaatttagctctaagaacacggaacaggg

SEQ ID NO: 605561 - DNA, 752 bp, Homo sapiens
  misc_feature (27)..(27): n is a, c, g, or t
  misc_feature (88)..(88): n is a, c, g, or t
  misc_feature (94)..(94): n is a, c, g, or t
  misc_feature (96)..(96): n is a, c, g, or t
  misc_feature (100)..(100): n is a, c, g, or t
  misc_feature (143)..(143): n is a, c, g, or t
  misc_feature (219)..(219): n is a, c, g, or t
  misc_feature (280)..(280): n is a, c, g, or t
  misc_feature (288)..(288): n is a, c, g, or t
  misc_feature (292)..(292): n is a, c, g, or t
  misc_feature (319)..(319): n is a, c, g, or t
  misc_feature (340)..(340): n is a, c, g, or t
  misc_feature (408)..(408): n is a, c, g, or t
  misc_feature (441)..(441): n is a, c, g, or t
  misc_feature (466)..(466): n is a, c, g, or t
  misc_feature (482)..(482): n is a, c, g, or t
  misc_feature (497)..(497): n is a, c, g, or t
  misc_feature (554)..(554): n is a, c, g, or t
  misc_feature (599)..(599): n is a, c, g, or t
  misc_feature (620)..(620): n is a, c, g, or t
  misc_feature (654)..(654): n is a, c, g, or t
  misc_feature (663)..(663): n is a, c, g, or t
  misc_feature (685)..(685): n is a, c, g, or t
  misc_feature (688)..(688): n is a, c, g, or t
  misc_feature (724)..(724): n is a, c, g, or t
gactgtggctgacggcctcaagaagcnggaggaggtggagatggacttcgcggtcgggctcaccgcagtgacaactgcaggggctgangagatngnggtntccctggccaagcccaagcaccgcgtgaccatgaacgagtttnagtacctgaagctcgctgggcaagggcactttcggcaaggtcgttcctggtgtaaggagaaggccacaggcgcgcntactacgccatgaagatcctcaagaaggaagtcatcgtggccaaggacgaggtggcgcgcncacactcnccgngaaccgcgtcctgcagaactccaggcnccccttcctcacagccctgangtactctttccagacgccacgaccgcctctgctttcgtcatgtgtagctacgccaacggggggcgagnctgtatctatccaccctggtcccggcgaaacgntgatgtttctcccgaagggaccggngccgcgcctatcgtantgggcgcatgaaganttggtgatcagccccgtgggacataccctgacatctcggaagaaagcaacgatggtngtacccggggaccctcagaggctggaagaaacctcaatggctggnacaagggacggggcacaattnaagaatcacgagaactttcggggctgatgcaagngagggggantcaagggacgggtggccaccantgnaagagcctttttgcgggcacaccctgaggtacctgngccccccgagtgtggctgggagggacaa

SEQ ID NO: 605562 - DNA, 189 bp, Homo sapiens
  misc_feature (116)..(117): n is a, c, g, or t
  misc_feature (158)..(158): n is a, c, g, or t
acagaaggactttgtctctttagcttgtttagctcaatgaacattatctcggcaaatgactctgctttctcgaaggtccttctccgctccaggtttacttgcatctctcatacttnntacagccaacatgaacactctatgtattttctaagctttcntctgttcaagaactttgaatttaaaacgtct

SEQ ID NO: 605563 - DNA, 617 bp, Homo sapiens
gcacgagccgggagtttcagccaaaagcagcgtatggtccagatggccttcataccctctgccagggaatttgacaccaatagtctccagccacttaaggtccccgctcacgtgatgaccaacaaatgcccttgaccatgtcttgtcttcttcggtcaccgggaccaagtaatagtttattagtgattgaatgaaatgcacgcactctttcaagctcaaaacatagctttctcccaataagtagcaatccttgtagtcacagacccatttttggtttctaagttccagggactcctcgataattaggtggtaattctttgtaattggaaccattgacggcaccatattttccctggggtcataaattgaaattccaatttcggtgattacgttctggtttgtttcgaaagcctctatatcaagacaaaagcatattgctctctgagaggccatcagcctgatgcatttctccagataagcaaattcattcgagcgtgaatgtgcttccaccatgggccagaacgtcttcctcacgctgtttttctcgtcagccagtagtttctgttctgtctctaggagcttgatggtaccattcattcctaacattttcttctgaa

SEQ ID NO: 605564 - DNA, 176 bp, Homo sapiens
tcgctgatagccccgtgtatcgaggtaacttgccggtcggagcactaccaatgactaaacacagatagcaggccaaggctacgcggaacctcatatttcccagatatctgctgagaaaatcatacagctacctaccctactctggctaccatggattgattgtgtggacagcctca

SEQ ID NO: 605565 - DNA, 138 bp, Homo sapiens
tgagttacagatggatccagttcgcgtatgcgggcaggcaccgacgcttgctcgatgtggccatccagctgaccttcctgcgcttgatgtccagcgaggcctcccagaacatcacctaccactgcaagaacagcgtgg

SEQ ID NO: 605566 - DNA, 241 bp, Homo sapiens
gcccagtcgctgggtccactagtacttgccgtagtactcttaaaactaggcggctatggtattatacgcctcacactcattctcaaccccctgtacaaaacacatagcctaccccttccttgtacctatccctatgtggcataattataacaagctcgtcataccgaagctcgtcataccgaagctcgtcataccgaagctcgtcataccgaagctcgtcataccgaagctcgtcataccg

SEQ ID NO: 605567 - DNA, 744 bp, Homo sapiens
gagaggcagccatctttctcttgcactggtgctggtgttggaggaccctccctgcttcagatttatcaacacgcatgaatcaagaagagttagccaaacttcagtgctcaggtccggatagggggcaaggtgtacatgctcgccgaaacgaagaaggtggtacatagaagcagccacagctgatgacaacaaagcttcaggagttctcttaaaaaaactggcctgtgaatacatactacgctggttcatttcgacgaggtgaccatgcattaccacgatgactggggacagttattcatttccaagcaattcccaaagtccaagcttccctttcctgctacataccttttgccacattactggctcagtgcatgaatgccaaaccaatcaacacgcacatgcttcctggcactatccactgtcagctttgattgctgacatgtttaacacagccttccgcacagttcagcttgaacaagttcccaactggcacagtctttggacacgtcacaagcatccaaaagccatcaacgacactctgatgacggaacgacatgactgcatagttccccgatccttggttcgacccccatcccctgcatgacgtgctcttcaacaggaactgcacagcctcaactcacacgctttcggactcgtcagtgcacggcctgtgcattggcacctacgcctcttaaccacatccagccatcacgttgcgatccagaacgtctacccgccatcgac

SEQ ID NO: 605568 - DNA, 163 bp, Homo sapiens
gactcttacggctgttacaacccgacctgagcggtcgcacagagctgggggtgacaaaggtcacgctgcgcctgcaggaaatcacggcgaaagcctccaaggtgctgtcagagggcgagcagcgcgcgttgggggatggctaatgttcctctgccgagcctcg

SEQ ID NO: 605569 - DNA, 157 bp, Homo sapiens
tgcgcttttacggagttcttactttttccctgataaagaggtatctttactataaaagctattgtgtaagctcgtcataccgaagctcgtcataccgaagctcgtcataccgaagctcgtcataccgaagctcgtcataccgaagctcgtcataccg

SEQ ID NO: 605570 - DNA, 383 bp, Homo sapiens
tccctgaacgcagcctgctgagatacgcagacagggtatgatagacaggattgcagttataagcctcggaatgcggatctcaatcccataacaaagagatgagtctatcctctagtccttttggagacacagaagttttggctttagatgaactcattgcctcagatcaactcttcagccacataattacaaagactccaatatttgagaatctgagtcactgctcaatcctcagattagacagacagagagaccagcacctctgttccagtatctcagctggactcagttagatccaggcaggcccagatctcatcattaataataaagcacgcagctgggcaacggtgcttcacgcttgtaatcccaacactttgggaacc

SEQ ID NO: 605571 - DNA, 389 bp, Homo sapiens
tacacacagcaccggcatggtatacacagtgagtgtatggttcctgtaagcactaagttgagctgttttcatttaatgacgctgtggtttgaacccttggtgatcactaccacacattatcagcaccagagctgagcagctatatccttgttattaatcactggtcattcattccattcattcgattcacaaacatatttcatgatgtatttactcgtgcaccacggtcccactgccatagcacatgggagacacaagttagtggcaatagtagacaaacgcataagtatcatattggagcgttagagtccagtgaggaatacatgtagataagtgagcacaatcagaatataaacttgcaaagatgtcacaggatgtgtagcatgaga

SEQ ID NO: 605572 - DNA, 141 bp, Homo sapiens
tgcctttggagactaagactcttatgcgtagagtagggttggtatgggactgccctttctcacagtaaatgaggtggaacttcatgaggtggacttcccttaatgtcgttcttttcttcttttcagattggccttatcgag

SEQ ID NO: 605573 - DNA, 93 bp, Homo sapiens
tgtgcgaaagacttctccgggaacggcgctggggttgactcctggggccagggaaccctgatcatcgtctcctcaccatccccgaccagcccc

SEQ ID NO: 605574 - DNA, 369 bp, Homo sapiens
ctactcaggaggccactacgtcatagcagctactcaggaggccagctactcaggaggcccagcttctcaggaggccaaggcaggcggatcatttgagcccaggagttcgagagcagcctggccaacactgtgaaatcccatcttcactaaaaatacaaaaattagctgggtgtggtggcggacacctgtaatcacagctacttgggaggctgagaccaggagacatcgatttgaagccccgggacgccagaggcttgcacgtgaacccgaagatttgcactccaggccctggaaccgaacagcaaagacatcttgtctccaaaaaaaacgcccgcctaaagaacccagaaattgaagggccccctttct

SEQ ID NO: 605575 - DNA, 415 bp, Homo sapiens
gtcttagtcatattgcattaatcaatagtgcccaataaatatttgttgatttagggtcagtcctctatatctgtggtttctgcgagctatggattcaaccaactgctgataaaaaaaaatttggaataaaataggctgggcacagtggcttatgcctgtaatcacagcactttgggaggccgaggtgggtggatcacgaggtcaggaaatcaagaccatcctggctagcacagtgaaaccccgtctctactaaaaatacaaaaattagcggggcatggtggcgggcacctgtagtcccagctacttgggaagctgaggcaggagaatggcgggtgaacccaggaggaggagcttgcagtaagccaaggttgcgccactgcactccagcctgggcgacagagcgagactccgtctg

SEQ ID NO: 605576 - DNA, 213 bp, Homo sapiens
tttatttaatgggctgatctatgtaatcacagaggccagtatgtacagccacagtgggaggtttaattcctcggtctcttcctccttggataaagtcttgatgatctcctccttctgggccgggaggcgctcttcagggcgctggcgtgctccctgggtcttagactggggggcctcagccgggtcagccaggagcttctggcgggccttatc

SEQ ID NO: 605577 - DNA, 300 bp, Homo sapiens
gggtatctaaggatccatccccggtctgggtacatctgacgctcttctgggaaccatgaaaggttcacgaattcgctggaactttgagaagtcctggtgggggcagaatgtatacacatcatgcgctggcacaacggaacacggtcagcaacgtccagaatgacattctggtctaaattaagggggaggcagcccttggggtcaagaagaaagaaactgaagggcggctcattccatgttcaccatgtagggggagggacttttgttcaggaagaaatccgtgtctccaaccacactatc

SEQ ID NO: 605578 - DNA, 279 bp, Homo sapiens
  misc_feature (181)..(181): n is a, c, g, or t
ctctatgaatttggctgcttgaatcatatagtatgtgtctttttgtgactgtcttatttcacctagcataatgtcttcggggttcatccttgtagtggcgtcagaattttcttctttaaaaatgtctttaaaaattagccaggtgtggtggtgggcgcctgtaatcctggctacttgtggngctgaggcaggagaatcgcttgaacccaggaagcagagattgcaatgagctgagaccgcaccattgcatgccacctttggcaacaagaacaaaactcc

SEQ ID NO: 605579 - DNA, 585 bp, Homo sapiens
  misc_feature (20)..(20): n is a, c, g, or t
  misc_feature (95)..(95): n is a, c, g, or t
  misc_feature (126)..(126): n is a, c, g, or t
  misc_feature (140)..(140): n is a, c, g, or t
  misc_feature (179)..(179): n is a, c, g, or t
  misc_feature (206)..(206): n is a, c, g, or t
  misc_feature (221)..(221): n is a, c, g, or t
  misc_feature (240)..(244): n is a, c, g, or t
  misc_feature (313)..(313): n is a, c, g, or t
  misc_feature (321)..(321): n is a, c, g, or t
  misc_feature (386)..(386): n is a, c, g, or t
  misc_feature (397)..(397): n is a, c, g, or t
  misc_feature (430)..(430): n is a, c, g, or t
  misc_feature (495)..(495): n is a, c, g, or t
  misc_feature (503)..(503): n is a, c, g, or t
  misc_feature (569)..(569): n is a, c, g, or t
aaactgaacaataaacactnaaaacattttgcgattggaaaaatgtaaagacaatatgaggttttgttaccatcttactgcaattttcttatgtntaactagtttacataccccatgtgttctgtnatcatgcagaagtnaatggaagtgtgaatgattaaataaatgaaaagtccgtntactgcagggaatacatttaacaaggnagcaaaaccgggttnagagaacaaaactattcannnnnttctccacgtatttaggttcattttagaatccatgaaccttaagctgttcctcctttacaatgccaacntccaaganaaactggcagatgtattttctttggtcaccttgaagctgaataacctctccgtattcaggatgtncaatcacagtnccattacaggcaaatatctttttgaaagctttnacaagtttctttttgttataatcatctgcaatgccctgaacagtagtgagtgtatttctgccgtnccgttgcnggattattatatgaatgtaatcctcagtgcctgccgggagtaagtagtcacccttagttgcatcancaaaggggtagaaaga

SEQ ID NO: 605580 - DNA, 498 bp, Homo sapiens
  misc_feature (20)..(20): n is a, c, g, or t
  misc_feature (95)..(95): n is a, c, g, or t
  misc_feature (126)..(126): n is a, c, g, or t
  misc_feature (140)..(140): n is a, c, g, or t
  misc_feature (179)..(179): n is a, c, g, or t
  misc_feature (206)..(206): n is a, c, g, or t
  misc_feature (221)..(221): n is a, c, g, or t
  misc_feature (240)..(244): n is a, c, g, or t
  misc_feature (313)..(313): n is a, c, g, or t
  misc_feature (321)..(321): n is a, c, g, or t
  misc_feature (382)..(382): n is a, c, g, or t
  misc_feature (390)..(390): n is a, c, g, or t
  misc_feature (403)..(403): n is a, c, g, or t
aaactgaacaataaacactnaaaacattttgcgattggaaaaatgtaaagacaatatgaggttttgttaccatcttactgcaattttcttatgtntaactagtttacataccccatgtgttctgtnatcatgcagaagtnaatggaagtgtgaatgattaaataaatgaaaagtccgtntactgcagggaatacatttaacaaggnagcaaaaccgggttnagagaacaaaactattcannnnnttctccacgtatttaggttcattttagaatccatgaaccttaagctgttcctcctttacaatgccaacntccaaganaaactggcattgtaaaggaggaacagcttaaggttcatggattctaaaatgaactaaatantgagaatntctcttcgaatangttttgttctctaaaccccggttttggctgccttgtgaaatgattccctgcaagtaaacggacttttcatttatttaaatcattcaaaactttcc

SEQ ID NO: 605581 - DNA, 468 bp, Homo sapiens
  misc_feature (439)..(439): n is a, c, g, or t
  misc_feature (454)..(454): n is a, c, g, or t
acaaaagtctggaaagtgcttttttagacacacatttataatataaattcccagaaaataaggatttggctaaaacttggttctccatgaaaatgagaaatgagtcctcagcctgttgatgccaacttgaccagatgaatctcttgtccctgagttccccaaaatgctgataaagtcatattttattccccagaatacatgcctaattggagttctaactagttgactaatggctaaaaaatttagaatcatggggaatgagttagagtaaggagatggcttagaaaaaaatgaattctaagtattgatgaattctaattatgataataccaagttccaactatcatacctcaaatctctgatttcaccttctgtcacaggggggaaaaaagtttctcccatctccaaaaggtaacagatactttttataatataaagntaggcccggctcggnggctcactcctata

SEQ ID NO: 605582 - DNA, 1584 bp, Homo sapiens
tagtgtgtgtgttggtcttccgaccaaatgtgtcgcctcactcttgggcgactaaatacccgataactatttgtaggttgttgtacaatcacaccacgcatggggtccaaacaaagaggtctagaggtacacaactaggagcaaagaacaattgtgtggtgaatagttcttctggtgggatatagtgaagatgtttctactgtagtgtaccaacacccatcgtggtacaaattggtcacccatatgtcattgctgtgggggtcagctcgccgccatcggggattgagagtgatcgtctgtggtggatgttgtggggggacccacccccgttctccccagcggcggaattaataaatctttcttttgtgggccctcgtgttatattgtgtgttctacaccccgtagggaggccttgtgttgctccctacagaagaacacatctgtgcaaaagttgccccccgacgaccaccttctttgaataacattggggtgacagaacgtcgtgcctcaataaaagaaagacattcgtttttggtcatacaaaaataggtgggtgcaatatactcccacgtcgtgtaaagtctcggtgtactgctcggggtaaaaagatcgtttaaaacctggggggacacattggggccgcctctgtctgccactggtggttgtcgcccccaaacactgagtgcagacaacaaaaacagctgggtgtcaaccactgtggggttgtgggaagacagctccggaggacgctctgtacgcccttgtgttgttaaggaggaaaaacatcgcctcggcccccacacaattaatggggagagagtgaggacactctcatcacggagaatagtgtgtgtgtgtgattatacatcaccgaggagtgtcgcgagaggggacgccccacctctcactaaggggcaacattccctcggggcggctttataacacactctgagagacacacaccacagcgttggtgttgtgtctctcctctcctctgagacgtctgtccactgcactcggcagtagacacacaccacaactggtcgtctctcgcacaccactctttgtgagacacacctgtgcggccgatgtgcgcaaatttgccccactgctctcatacctgcgacaccgcacaatgattggtgtctaaagacgagtctcaagttgtctctactgggggtgagagtcgacacacacaggcggaatttttgtgcgtatcacacacgcacacacagagaggtgtgggtttgtgtacacactctaatgtggccacacaacaacactgtgcactctctaagaggagtataaacacctcatggtacaccacaccagaccacccagctatagatagacaaatatataaagagaatataatatatgaagacaccatctacattcatgtgggtagattcctattcctcacacacatccagatctcccctcacccacacacactgtaattgtctccctctcttctacagagtgcacaagtagaaccaccttgtaaaatagggagagggccaatgggagaccccaaccgttgttcaagggacccatccagttaaattaccctggtgctccaat

SEQ ID NO: 605583 - DNA, 896 bp, Homo sapiens
cccgcgctgacgggcgggaagatggcggacgtggtcgtgggtacaatgacaagggcggggagcagcggctcatctcgctgtcctctatcccgcatccgggtcatcatgaatggagctcccccgaggtgtccagcatcaaccaggaggcgtgggtgctcacggccaaggacacggagctctttgttcaatgcctagccacctattcctacagacacgggagtggaaacggaaaagaacgtactgacttacagtgatttagcaaaccactgcatcagcatatcagaaacttttcacgtttcttgcaggatatataccaaagaagattttagcctagtaaatacctgaaactgcgttaaagaggaaccgagggaagaagatgaggagaatgacaatgataatgaaagtgagcatgcactgaatgctgagctcctacagctaccaagtgctttaaacaaccagcctggcgaggacagccctggagccattccaatgtctctaggtaaagacagcactgcccgcttagagcgtcttcacttcttcacagagttccagtgcgtggtatcttccgaggtattctttccaggccgagatggagcacctcatgtaactacgccacagacaggcagagggaacgcgaccagaagcagtgctcctcgagaggccagcctgcaggtcaggcacaagaagccgcgatactggcagcataggagaccaaactgcacaggaaggccaattaaccctttcaaataccgctcgacattgaagagcttctcacctatcggaccggtcccacccatactgcaccagggactcacgccaataacccgcgcgaatacgacaaccacacccatcgcgccgaaacatgtcaactagcacactcgccccagaaagtacag

SEQ ID NO: 605584 - DNA, 885 bp, Homo sapiens
atggcacatgcagcgcaagtaggtctacagagacgctacttccgcctatcatagaatgagcttgatcacctttgcatgatcacagccctcatgaatgcagttgtgtccttatctggcttcctgagtcctgtattgccctttgcctaaacactcacaaacaaagactaactaatactaacatctcagacgctcaggaagtagaaaccgtctgaactatcctgcccgccatcatcctagtcctcatcggcctcccgatccctacgcatcctttacataacagacgaggtcgacgatccctcccttaccatcaaagtcagattggccaccaatggtactgaaccgtacgagtacaccgactgacggcggactaatcttcgaactcctagcatacttcccccattattcctagaatccaggcgacctgcagagtccttgacgttggacaatcgagtagtacatcccgattgaggcccccgattcgtataataattacatcacaagacgtcttgcactcatgagctgtccccagaatctcaggcttaccaaacagatgcaattcccggacgtctaaaccaaaccactttcaccgctacacgaccgggggtatactacggtcaaggctctggaaatctgtggagcaaacaacagttacattgccatcgtcctagcaatgagtgccctaaaactctttgacataggcgcccgtatttaccctatagcaccccccgtcaaccccgctctagacgcgaaaacagaaaaacacaacgcagagacagagagcagaaaaaacgagacaagagaacgagaggagacaaagaaagaaaaggcggggcaagcaggagaaagaaaacacagacaaaatggagagggagaagagagagagac

SEQ ID NO: 605585 - DNA, 304 bp, Homo sapiens
  misc_feature (66)..(66): n is a, c, g, or t
  misc_feature (108)..(109): n is a, c, g, or t
  misc_feature (174)..(174): n is a, c, g, or t
  misc_feature (198)..(198): n is a, c, g, or t
cgagcgcgcaatgactacgtcgatgtctcaggctgagcgatcatcgccacgagcacaccagacgcnctactgcggggcctgaaaaaaaggaggtgccgtaggagaggnngaataacctttagattcgttacaactttctttctccttttgtagctatgactagggtggaggganatgatatatatggcccagaaaggnatatacgagggtgctagcattgagtgtgccctactgctttctgtgaggcttttttgccagctctgtcataaacacagagatctgtgcttgtgctcgcacttatagc

SEQ ID NO: 605586 - DNA, 947 bp, Homo sapiens
agcccaagcagaggaggaagaaccttttcaggatgggacttacgactgttctgtgtcctaacagtgaggttccatcacaaaggggcagtattaattagcagctagcgtgcaagctcagtacgttgtaacatagtgggatgattttaacaggagaactcagttcagagactctttcgggtaaaggtatacagtagatttaaagctaattctttctgggtctaaagcaaatcttttgtgactccattacaaaatgtgatcataaaggcatcttttcataacaaaaattttaagctgccagtgcaacaacgttaccctattgttacggatgtcccatgaagaaatattggggtttacacctcaaaggtgtgggtagcttctttaaacccacaggaatttgtttttgcccccaggtgagcttactttttcactaccttaacatcttctacacattttcccggttctgcatttattgtccagatgtgctttttcaaaaaacactaaaatgctaaggtgcttgcaatagtctatcaggttacttgagctaactgtttgcttccccttgataacagtggacttcttaaatcagtcctcctggaatagaattggtaccctggggcacaatattgttcgagttgtgattggaaacaattctccttggttaactaccagtcaaatcccagtctagaattgatggagtatttacctgtgaagttaatgtgcttgtttagcaggttgattcccattagaccatgtgcagagttgaagggtctccactttgtggtcgttcccctaaacaattggctaagacagtctgtgtgaccccggggaatttcaaagcggccatataggcgtaaacagagaggcggcgctggaacacaaggagttaaaggccgccgcaaaaggcacatcctacttttagtatggtcagatgacgcgtactcgtgtgg

SEQ ID NO: 605587 - DNA, 930 bp, Homo sapiens
  misc_feature (48)..(48): n is a, c, g, or t
  misc_feature (88)..(88): n is a, c, g, or t
  misc_feature (99)..(99): n is a, c, g, or t
  misc_feature (104)..(106): n is a, c, g, or t
  misc_feature (256)..(259): n is a, c, g, or t
  misc_feature (313)..(313): n is a, c, g, or t
  misc_feature (317)..(317): n is a, c, g, or t
  misc_feature (355)..(355): n is a, c, g, or t
  misc_feature (366)..(366): n is a, c, g, or t
  misc_feature (390)..(390): n is a, c, g, or t
  misc_feature (395)..(395): n is a, c, g, or t
  misc_feature (409)..(410): n is a, c, g, or t
  misc_feature (420)..(420): n is a, c, g, or t
  misc_feature (422)..(422): n is a, c, g, or t
  misc_feature (488)..(488): n is a, c, g, or t
  misc_feature (530)..(530): n is a, c, g, or t
  misc_feature (542)..(542): n is a, c, g, or t
  misc_feature (544)..(544): n is a, c, g, or t
  misc_feature (547)..(547): n is a, c, g, or t
  misc_feature (555)..(555): n is a, c, g, or t
  misc_feature (558)..(558): n is a, c, g, or t
  misc_feature (569)..(569): n is a, c, g, or t
  misc_feature (584)..(584): n is a, c, g, or t
  misc_feature (589)..(589): n is a, c, g, or t
  misc_feature (598)..(599): n is a, c, g, or t
  misc_feature (608)..(608): n is a, c, g, or t
  misc_feature (611)..(611): n is a, c, g, or t
  misc_feature (621)..(622): n is a, c, g, or t
  misc_feature (660)..(660): n is a, c, g, or t
  misc_feature (666)..(666): n is a, c, g, or t
  misc_feature (674)..(674): n is a, c, g, or t
  misc_feature (677)..(679): n is a, c, g, or t
  misc_feature (698)..(698): n is a, c, g, or t
  misc_feature (713)..(713): n is a, c, g, or t
  misc_feature (717)..(717): n is a, c, g, or t
  misc_feature (723)..(723): n is a, c, g, or t
  misc_feature (731)..(732): n is a, c, g, or t
  misc_feature (750)..(750): n is a, c, g, or t
  misc_feature (787)..(787): n is a, c, g, or t
  misc_feature (829)..(829): n is a, c, g, or t
  misc_feature (833)..(833): n is a, c, g, or t
  misc_feature (838)..(838): n is a, c, g, or t
  misc_feature (923)..(923): n is a, c, g, or t
taattgatttaaagttcacatggttgtgggattctcagtttcttgtgnggttagtaaaaaggaacttcttatttggagacagcaaganaaaatgaggangatgnnnaaggggaaacccctaataaaaccatcagatctcatgagacttattcactaccacaaaaacagtatgggggaactgcccccatgattcaaattatctcccaccgggtttctcccacaatacatgggaattctgggaatacaattcaaaaannnntttgggtggggacaaagccaaaccatatcattctgcccctggaccctccaaatntcgngtcctcacatttcaaaaccaatcatgccttcccaacantccctcaaagnattaactcatttcagcattaactnaaaantactcactccaaannatcatctgananaaggcaagtactttccgcctatgggcctgtgaaatcaaaagcaagctagtttcttcctagatacantgggggtacaggtattgggttattctgttccgggtggggggnattggccggggngnagnggttgggnggnccgtgggggtntggggcccggcgggncggtngagttttgnngcttctgtntgntctcttttgnntccgggtctcacattcaggtcatgctgacacaaaaggngggttnccatggtnttnnntagctccacccccgtggcnttgcagagtaagccncccncctggntgctttcnngggctggcattgagtgtntgtggcttttccaggtgcatgatgcaagctgccgggngatctaccatcctgggatctggagattggtggccgttttctnaganctcantaggtagagcccagttggggatctgtgttagggctctaatcccacatttcccttctgcactgccctagcagaggttatccttgangggctct

SEQ ID NO: 605588 - DNA, 221 bp, Homo sapiens
ccagagtatcagcaatgagagaatctgactctgatagaccaacatccagatgtgattttagtgtctgagaccacaccccagtagcaggttacgccatgtcaccgagccccattgattcccagagggtcttagatccatggaaagtcaggccaaccaagcaacgatttgcactcactgttatctcattaagatattaacaacgttttatatattctaaacgt

SEQ ID NO: 605589 - DNA, 1161 bp, Homo sapiens
tcactgcttcaacagtgcttggacggaacccggcgctcgttcccacaccccggaccggaccgcccatagccagcccatccgatcacctcttcaccgcaccctacggactgccccaaggaccccgccgaccgctccagcgccgacgcagcacaccgccgcacgaccgccgacatctcctatagtcgccgccagtgacagaccgcgatacacactcgcaggtgcgccagaactaccaccaggactcagaggccgccatcaaccgccagatcaacctggcgctctacgcctcctacgtttacctgtccatgtcttactactttgaccgcgcagcatgtggcttagcaacaactttgccaaatactttcttcaccaatctccatgcggcgcagggaacatgctgcgcacactgcatgcagctgcagcaaccaacgcaggtggccgaatcttccttcaggctaatcaagaaaacagactgtgatgactgggagagcgggctgacatgcaatggattgtgcattacatatggaaaaaaatgtgaatcagtcaccatgtgaactgcacaaactggacacatgccaaaaatgacccccaatagtgtgacttccattgacgccacattacctgacactgacccggtgaaacgcatccaagcatagggttgaacagtgaccacataggcgccaacgatggagaccagaccaacttctggcctggcagcgcaaaatcacaatagacacagagaacgctgggacgcacagtgatgaagtaaaagctaagccacccggctaataacacaaaagccgaggggcgaccatcctggtacaccaggacagcatgcaaggtcgaggtacacctaaacctttccacacggtggtcccacaccatcacgtcagctcattaggagactacacacagtacaaacccagactggaccccaagacacccacagccacgcaagaaaaccagaaaagaacacgcacaccaacacgaccgcgcgggcccacaaccacacagcgggagaagagcaaccgtatgacgggcgagcggaaaaaacgacgcgataatcacaaagaaaacaagacacattgtcacaacaaagaacaggtacggatctatcgaaaacaaagccacagaataccaccgacaccgaaacagccacgc

SEQ ID NO: 605590 - DNA, 339 bp, Homo sapiens
gaaggagtacccgatggattatcgacagctgggccgcaccgatctgaatgtaagcgcgatcgcttgggcaccatgacctggggcgagcagaacagcgaggcagaggccttcgcgcagatcgaacgggccaagtccgcggggatcaacttcctcgacaccgcagaaatgtacccggtgccgccgaaggccgacacctatgccaccaccgagcgctatatcggtaattacttcaaaagccgtggcgaccgggccgactggatcctcgccagcaagatcgcgggccccggcaataccatcgactacatccgtgacggccacttgcgccacaaccgcaagcgc

SEQ ID NO: 605591 - DNA, 681 bp, Homo sapiens
gcctcgtgccgggcgtgtgcgcacgtggccccccctgccgagaccatgagagagctaccacaggagcctgtaccagacagatgctgcaggccttgacggacacggtcaaccggttacgtatcagctccatccaggccaccactgcagtgggctctgagcaccccacgtcatgctgcagcgccgcagagatcatggcgtgtcgcatcttttatccacatccatgcgctacaagtgccaggatcgccccggtgaatctcgcacaatgtaccgctattgtgcatctccaatggtgctcatgtcggcgtcctcgatcctctacgcggtctgggctgaagctggtttcctggccgaggcggagctgctgataccgtgacggaaggactcatgctccttaacttgtgaccgtggcacccgagtacccagaaagcatagtctttcagccgagcgtcgcgtcacttaggcatccctgggccatgggcctcgcgggcccgcttgatgggacttggctagcaccgcgcgaagtacttcgactaaggtccagtctaccgtagtctattgcttgctgggagacggggagctgtcagagggctctgtatgggaggccatggccttcgccagcatctataagctgtacaaccttgtggccattctagacatcaatcgcctgggccagagtgagcc

SEQ ID NO: 605592 - DNA, 144 bp, Homo sapiens
agcccgtcacgaggttgtaaaaggggcccgggtgaaaaagttttccgggccccccccagtaaaaaggcgcccggggccaaatttttttcccccccccccccccccattttataacaaacacgaccgccaaacaaaactaaaaac

SEQ ID NO: 605593 - DNA, 149 bp, Homo sapiens
cagggggggcccccccccccgttttttcaaaaaatttttaaattttcttggggcggggggttgggggggaagaatgggggaattgtttgggccccggggtttggggtgtcggggggccctttttgggcccccgttttcctccctttgga

SEQ ID NO: 605594 - DNA, 102 bp, Homo sapiens
  misc_feature (58)..(58): n is a, c, g, or t
  misc_feature (93)..(93): n is a, c, g, or t
acccttgggccccaattggaagcaagagcttgtaaaccatgaaggactgcccatatantgtgtgcatacaaacgtggtgaccgtcaagttcanagtggtggg

SEQ ID NO: 605595 - DNA, 153 bp, Homo sapiens
accaattagtatgttattcagacttggcacccatgtctaccaaagtttacaagttcataatgagaaaagagaggatgtactataaataagtggtccatgtgttgtgtgcagctgtggtggagatgttgatttggagattaaatctcttgatga

SEQ ID NO: 605596 - DNA, 115 bp, Homo sapiens
tactagtcaattacaagctcttgcacacgtaggtgaacattaaaaaaaatgaaaagacaacttacagaatgggagaaaatactgtcaaatgattcggtaggtatgatgaaggacg

SEQ ID NO: 605597 - DNA, 202 bp, Homo sapiens
ctatccaagcactctatgaaccaatgtgcttgatacatactattcccatgaaatttatgtgccattatatgcatggttgtctctgacatggaaaaacctacctcccaccactaggaaaccaaaagtctcagctcaagaaatacctctgagaagtcttccctgcccatgtatgtcttttcatggctgacataacaaaatatta

SEQ ID NO: 605598 - DNA, 766 bp, Homo sapiens
  misc_feature (437)..(437): n is a, c, g, or t
tggtttgggaaaaaatccgggggcacccgggagggattggaaaaaaaatttctttctctctacagcaaatttatggtgaggaagcctccctccaactcctggggctatttagggtccaaaatctcaggttgcctaggggaagattcccaggggattgatttccggggagagcatactctgggtcatacctggagagtccgtgaacaagtgattccccattatggacgcagtctttcagtataaacacctctggttttgttcccctcattttggggcattaagcgtggtctccgcgggggaagtgttcacagttctaccaccgcggtggtaggtgtgtgtttttttttagaaacccacctttaacttcccttttaagggtttactccatatttttcacaaatatttttatgtggattactcctagtggttaccttatnttttggggtcgtggctccaatattgttgtttggtacacactgcggtgggtaataatacacgggcccggggtggggggtcctcgtggcggtcccacaggttgtatatattatcccggcggaagaggttctcctaacacctggccttttctgcgagtgagaattcccccctttttttgtcccttattaacgtatttggtcccccaaaaaggttccactgtgtcccaggacaactttcggttttcttgggacctctttgcgccaccttgtgctgtccccacccgcttaaaaacaacttgtgttcaccttgggttttgggcataaccatcctg

SEQ ID NO: 605599 - DNA, 82 bp, Homo sapiens
gttgatcgcagatgctgtgaagttgacaatattaatcacacctggatatatgtgctgttttacctactgaatcttttcagaa

SEQ ID NO: 605600 - DNA, 384 bp, Homo sapiens
ccgttaacataatcatgtttgatagatgtatatatttctcataagtctgtcagttttttcacaactggggaatgagaggaatcaagagagattactaccctgccagatgagctgtcacaatatcatatagtggtaattacattgcacgattgatgcattacactcccatgctgacgcttgcatttgcgcatatggggcatacatagccgcacactatgctgctgtggatgactgtaagcatgcgctacactgatcacagcatcaacgactgaagaatggagatgagatgctatgctgtccttactatgagacctgagctgagcttactgagttagaggataagaattggtactgcatattgtgaatatactgttgcatgattgt

SEQ ID NO: 605601 - DNA, 307 bp, Homo sapiens
  misc_feature (13)..(13): n is a, c, g, or t
  misc_feature (137)..(137): n is a, c, g, or t
  misc_feature (143)..(143): n is a, c, g, or t
  misc_feature (154)..(154): n is a, c, g, or t
  misc_feature (156)..(156): n is a, c, g, or t
  misc_feature (228)..(228): n is a, c, g, or t
tttgttttttganagggtcttgctttgttgcccaggctagtctcaaactcctggcctcaagcagtcctcctgcctcagcctcctgaagtgctgggattacactgggcaacatggccaacccctgtctctatcaaaanaaaaanaaaaattagtntngggcctaacgcacacctgtagtcctaggtacttgggagggtgaggtgggatgatcacccgagcctgaggagntcaaggcggcagtgagcggtgattgagccactgcacaccagcgtactgcacaccaggccacagagtgaaaccctgtctt

SEQ ID NO: 605602 - DNA, 656 bp, Homo sapiens
ctccaaaggttacccctgtcccgctcataagattaagccattctggtgctgtctctctttgatggaatcgctaaagggctcttggtgctgaaggacttggggatacaggtgcaccacaacattgcctcggagttgtgtgaggactccatcacggtgggcatgttagcggcaccatgggaagatcatgtacgtcggggacgtccgcagcgtcacacagaatcctatccaggagtggggcccattcgatctgctgattgggggcagtccctgcaaggacctctctatcgtcaaacctactctgcaagggtctctactagggcactggccggctcttaaaagagttctaacgcctcctgcatgatgcgcggaccaagaagggagatgatcgcacattcttctgactctttgagaatgtggtggccatgggcgtttagtgacaagagggacatcacgcgatatctcgagtccaaacctgtgatgataaatgccaaagaagtgtcaactgcaaacagggcccgctacttctggggtaaccatcccggtataaacaggacgttagatccactgtgaatgatagctggagctgaagagtgttgaagatggaagaataccagtaagaaagtgagacataatagaagcaatcctcgaagggacga

SEQ ID NO: 605603 - DNA, 834 bp, Homo sapiens
ggagccttttttcctcccccatcccctgcagctgccttttttgggggcagggtgggggttgatgtgaactttaagagtttaaaagtttagcttatgagtagttgtcatttaaacatataattgcgaatatcagaaaactcatactggaaaactaaatttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccatacccagctaattttttgtgtttagtagagacggggtttcaccgtgttagccaggatggtcttgatctcctgacctcgtgatccacccgcctcagcctcccaaagtgctgggattgcaggcatgagccatgaccccaacccctggaaaactaaattttaagtgcttatttttatagaacgtttgaaaatttaatgcaggcggtgtgtaataatcattttcgactggaccattaaattctgcttcttaaagtcagcactccacttgggcctggttgaaattggaatctatcttggtttgggtaaccaactctggggaagattttggcgtgcacttcctcaattattctcctaaggtttctacctaaaacaaacacgtgggtactggcccactgggcctgcgcaactcggggttggggaacttacaaccgcgggaagagcgccgcgggggagggtgaggccctatgatgccaaaaactggccgggggggagtggggaacgcccagaccggtttttataaaagggccgc

SEQ ID NO: 605604 - DNA, 149 bp, Homo sapiens
tgcatcagtgcttgacctcccaaagtgctcagattacaggcgtaagccaccgcgcctggtgagaaaccaatattacatcaaaactcaccacagtgcgcaagcggaagcgtgtaatcaaattgtagtactcaatactcattgcaaggact

SEQ ID NO: 605605 - DNA, 308 bp, Homo sapiens
ttacctgttctgaagcaactatactgtctttgcatattgtcacacccctatttgtgcacgagcgcatttatcgacttgcgcaacttggcgttcagttccgttagcgacgtggcattatacgtggcagctattactgttcgtgtagatctagtgcagggtacaactaacttcgttatttcaagaaacttggcccaggatcacgggaacagcaagcacaattctgtacttcggttataccatgataatggtttagatcttctttctttttacaggaacaattggcttctttgcatgcttctgggtttcga

SEQ ID NO: 605606 - DNA, 264 bp, Homo sapiens
aagggctcagggccccagcaaccaagccagcccccggggggatgataccccccccccccccctggccagcctgggggtgccctgcctgccctcctggtactgttgttttcccctcggccccctcccatgtgtattcaccagccctatggccttggctctgggcctgatgggccaggggtaaagggaaggtgagcatagcccattttcctaaagcgagaattgggggaaagctgtttttttttttttaaaatcccttcagatgta

SEQ ID NO: 605607 - DNA, 211 bp, Homo sapiens
ccctttcttatctaaccctagaccattcctggatacccagaccatcgtgcccagtggtgcccccatcctctcccatccccgctgccctcgtggccagtcccggctggttttgtaagatactgggtaggtgcacagtgatttatatctggtaatttaaagaggcccagcattggtggttctattgaatggacatgagataatgttagagata

SEQ ID NO: 605608 - DNA, 259 bp, Homo sapiens
gcactctatagacttacattaactagtcattgtaagagtgatatagaagagcttattatttttgaaatttgaagtataatatcgcattacataaaatttaccagattaactcttttgaaatgtgcattcagtggcgtttagtacatttcacaatagttgtagtaatcattagctactatatagtatccgtagatactagttagacacggacaaatagaaaaccctattgcccactaaagcaagtcacttagtataacat

SEQ ID NO: 605609 - DNA, 304 bp, Homo sapiens
cgttcgggtgacttctcctgacttagaattttggtcatatcatttcaaaacattagcatattggttggttgcatatgctttcctcattgatcccaatacccaaagtcttagaatcactctcatttaaaatactgagcggtgattcgatatacttcgaagtcgagaacaggcaatgtgcagccctcatttatgagaaaaccctcaggaaactcccagggttgatgcttggagaacctgtgagttgagctgaagctcggagaacttcctccagcagcaaagggcttcagaaagaaagaagaactct

SEQ ID NO: 605610 - DNA, 522 bp, Homo sapiens
agaattcggcacgaggtgtctcggtaagggaggactcctggcttccctggtcctaataagtatggtgactttgtatcccagtgtccctgggcgttctggtggctacagtaaggtgtgtgtgtctcaggtggccgccccacttggcaacgatgggggcgcctggttgtggaccgttctccgcagctttcatgatgctttgatgtttgtggttttattcaaagttcctggtctcacaacaggctcggaagttatttaatgactgcattttatagatgggtgtacctgcggctcagagaagaggagggacttcctcggcaggtgtgtggccgagctgggatccaagggcaggctcttaccctctctggcatctgggtccttttgctctgaagtgctcacgtttctgccaaatactcagggtctgagggtcttagatgagacggcaggcagaggggtgagggaggctcgttcggatcatggctcgtcttggaggaagtggacccatcacaatagacctggcggccg

SEQ ID NO: 605611 - DNA, 122 bp, Homo sapiens
cggccagagggatacagcgagcgtaggattggagatcgtccaagttaaagattacaaacgtgttggggatcaagaggaccatggttcagccaagaggatctgtggaacgagaagcggcgaag

SEQ ID NO: 605612 - DNA, 539 bp, Homo sapiens
agcggcggagagcgtggtctgcttggctcgccgcgcctctcccccgtccgtccatattgctgcagcccccgagccgggaagcccgggccgcccgggggcgggggggagggagggacgggactagaagcctgccgggctcggggtgggggcgtcttgcgaggaacgggcggggggggacgcacgcctaggaggcctggactcagagtggggggccttcctcgcccccccgccccgactagtgggcctcggatattacggcggcatgacatctaactggagaggaggacgcacctcgacgtgaacaccgaaccctagctactgacagggactggggacccagaagaccccggaggaaggacgtcgcagggccgctcatgctagaccaagattcgaggcgggggaggcagcctcgggcgcgcccggctactccgaggggggcgggcgcgcagatggccacatcaggtggagccgcgagcatgcctgggggcgcccacgactctatgcagggcagcagagcacggggggctaggtgaggcaag

SEQ ID NO: 605613 - DNA, 837 bp, Homo sapiens
gaaaatctttttagttagattgtaggcttctggggccgtcccatgccaggactgcaaaggtgatccacgccctacctgtcttcccacctgtgtgtcccccgtgtgggaaggtcggtgtcactgccccttcccaccctcacatctgcttagccagtgagccacacccctaaaacatcagactgcaccatccaggtgcagctccagaggctagccagaaaggcttcatgggacctagaatcccgcatccctagcttctctcgtcccttcctccatcaagaccttggatctggttattaaggggtgccgtgtggatgcatggagagtcatcaagatcatgcataagatgcacgatccatagcccccagtggctttgagagagaatccatcatcgtgaccatatctgtccaatcgtccccagatgggttaagtcgtatataatttgtcttaaattggtgttaagatctaagaaggttagggggtagagcagaggaggttatatctgtgtagtagtgagtggcttcatgtgtggaatattcatttgcttactgcagtgggacttggggtggaagccagccctacctactctgtgtggtcttagccctgaatatggtgacaggcgtaggcctgcagtcagccatcagtgtgtgcatgtgacaggcatcaattgtgattagtaatattgtctgttcctcccgttgaaagtggtcgtgttaagtctgagttttaaaagctggcaggcagctgactgtgatggtcactttgtgccctgatttttaccgcctcgtgggccacgatttacagggtgttcccacccaccagttcctctaagacaatatc

SEQ ID NO: 605614 - DNA, 321 bp, Homo sapiens
taggatcctgtattgagtgcatgtaggagtgggagagcgcagcctcattgaaagggcagcaggagcggttgtctgggcggggcagtggacacggtgtcctcgaagtgctgcctactcagtgcaggcacaccagcagtgcacacagacaaccaaactgccaggaaacacactgagctcagatgcaaaagaggtgacgccaccccaagcataagaaggtttaagcctacagtgaggggtcccccaagaccccggtgttgtctccctgctcgtggttctgctgtgcaatgtccccatccacagacccacactgatgagtcttct

SEQ ID NO: 605615 - DNA, 600 bp, Homo sapiens
tgaaacagagtctctctctgttgcccaggctggagtgcagtggcacaatctcggtcactgagcctccgcctgccgggtcaagcgattctcctacctcagcctcctcagtagctgagattacaggcttgcaccaccatgcccggctaattttaggggtttcagtagagatggggttccacccgtgctggccaggctggtctagaactcctgactgcaaatgatcagcccgctcagcacccaaagtgttgggattcacaggtgtgagccattgtgcccagcgtgattttttgttcttttaaaagacaaatcttgtccttgggttttcggcaaacaggctggtccctcttatttagaccatacatttcctgtgggggctgaacccccagtggtctcccacagtttttggcttgcttgcactttcccccgttgtggctcctcactgggggcgcatgggcccctcttttctaaatttaaccttgggccccgggggaatcacactcggcttggcacgggttaggtgagccccctcttgtatttcggacgcgccccgacgtcttcttgggagcctgctgtagtaactcctgcgggttctggataacg

SEQ ID NO: 605616 - DNA, 114 bp, Homo sapiens
tagtaacagttgaaatttgtttgcaaattatcagcgtacttattatttcaggctgggcacagtggctcatgcttgtaatcccagcactttgggaggccgagtggggtggatcac

SEQ ID NO: 605617 - DNA, 717 bp, Homo sapiens
tttcctcgaggggtctttggttcgcgaacagcggagcgcgccctccacgatattatggggttcccccctcgccccccccttctcggtagtaaacggcctctgttcaagcacccaccgccgggggctttttgatcacactgtggcgccgcatcaaatagtcgctctttacttagctctcacacaggcgtggttcgtgttcacacataggggacctctgatggtgatagcacggggaggctcttcacgcacgcgattttttggcccccctcacggggggggtcctctccgagagggatccatggtgtagcgcgcctggggtccctacataacacatgagccgcggctccaatagctccaagtccgctgcaccagcgatataatggcgcccactcccgcctcccgagagaggcgcacctcttgtggacgttccacgccgccgctcgctgtgtccacgcacgcacctgggtctcactcctcttggtgtggctcgcccgtcacctgcgcggcgctcctagccggttcttatctattcaagggcgtctctacaagggggcgcccgacggcccccccggcaagcaaatggcgcccgcgccccacgacgacacgcacccccgggtgagctcccgaccacgcacgccgctatggcctcctgctcgacgagcggggacaagaaagagaacaagagagttatatctttcaaaacaaaagacaaacaaa

SEQ ID NO: 605618 - DNA, 522 bp, Homo sapiens
  misc_feature (332)..(332): n is a, c, g, or t
  misc_feature (344)..(344): n is a, c, g, or t
atcatccagttggttggcatccctggcctgggggcacgcggttggattgcagccctgtctacactggataatcattccctggccatatcagtcatcatgatggtggtggctggcttcttcaccctttgggccgtgctttcagttttcctcctgcagggggtgcactccctctaccgacggacaggggccagcttccagcaggcccaggaggagttttcccagggcattttcaccagcagaaccttccccagagttgttttatttgttgcccaaggagccttccaggggaattagtcctcctcttttctttcccccccagcctttttttggcntgccctctgagntgccctttccctgggggccttatgtggtggtggttgtgcccagcacaaacctggcagggttcttgccgtggcttttcctcctccctcagcgaccagctctccctggaacgggagggacagggaattttttccccctctatgtacaaaaaaaaacaaagctttctttccttttttggta
